United States Patent 11,549,145 (METHODS AND COMPOSITIONS FOR INHIBITING AND TREATING NEUROLOGICAL CONDITIONS) - sequence listing, part 44

SEQ ID NO: 940 - DNA, 43066 bp, Homo sapiens
ttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttc

SEQ ID NO: 941 - DNA, 43953 bp, Homo sapiens
ttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatct

SEQ ID NO: 942 - DNA, 43953 bp, Homo sapiens; identical to SEQ ID NO: 941

SEQ ID NO: 943 - DNA, 44254 bp, Homo sapiens
ttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaat

SEQ ID NO: 944 - DNA, 44254 bp, Homo sapiens; identical to SEQ ID NO: 943

SEQ ID NO: 945 - DNA, 1126123 bp, Homo sapiens
gccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgagcttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgcagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaacaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagactccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattattcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttattataatatataatttttacagttattttttgttatgctttatatacattgaagtatatgtcttagctatataattttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactgccatttaaaaaataatgacatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgtttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggtggctcacgcctgtaatcccagcactttgggaggctgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaagaactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccgcctccatgattcaaatacctcccacctggtccctcccttgacacatggggattatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaacgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacataatgtgtgcatgtgtctttacagcagcatgatttataatcctttgggtatatacccagtaatgggatcgctgggtcaaatggtatttctagttcaagatctttgaggaattgccacactgtctttcataatggctgaactagtttacagtcccaccagcagtgtaaaagtgttcctatttctccacatcctctccagcacctgttgtttcctgactttttaatgatcgccattctaactggtgtgagatggtatctcattgtggtttgatttgcatttctctgatggccagtgtgatgagcattttttcatgtgtctgttggctgcataaatgtcttcttttgagaagtgtctgttcatatccttcacccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttctttttgcttaggattgtcttggctatgtaggctcttttttggatccatatgaactttaaagtagttttttccagttctgtgaagaatgtcattggtagcttgatggcgatggcattgaatctatacacttcatgctaaaaactctcaaaaattcgttattgatgggacttatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaacaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataaatttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatatcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctacttagggactgtaatttgaaaagaggctgtgcgtggtggctcacgcctgtaatcccggctctttgggaagccgacgcaggcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaagaaaagaaaagacgatttattggttaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattgattgtcatttactctaaactttgggaagaagacacattaattgttatttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaaaaatttctgggagaaactatgaaataattattattgagtagatatttaaactgaaaattacagattatgtttttatttttatcaagggtcatatgtatcgaatatttacatgacactatacagaaagcactttttagtattacatattatgagataaatttttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtattttccattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctatgagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatacaatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcgtatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattgctgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtgtatatatatatatatatatatatttttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatccttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactgatttcatcttgatagtctgggccaatcaccccagccaagactgtaactcccttcttagcctgttgacttaaaggtaggaggagcccaaagtgtccaagtggcaatcttaactttcagtttaatggaatcattgttgtgtctcttgatggcagcgttcctccctctggaactaagacctctaggccagcaggatcaatgttgtgggaacaggaagcaagaattttgctggtggatcactaggggtgatggtgagtggtgccacttccacttccaccccttggttcctggaaccatgaatcctggctatgggagaaacagtaccatatattgaatgctgattcagagcatacacaccttctggagaactttgcctcagcctagtaaagtattgtcacctagttcgtgttgtaattgtgacttcaaaaggcaattctacggttttatcaatccagctgcttcaggatgatggggaaacatggtaagaccagtagattccaggagcatgagccccatgctgcacttctttagccataaagtgagtgctttggtcagaggcaatgctgtgtggaacaacatgatggtggataaggcattccgtgagtccacagatgatgtcttggcagaagcattgcttttaggataggcaaacccatatccagagtaagtgtctattccagtaaggacaaacctctgccctttccatgatggaagaggtccagtataatcaatctgccatcaggtagctggctgatcaccccaaggaatggtgccatattgagggctcagtgttggtctctgctgctggcaaattgggcactcagcagtagccataaccaggtcagccatggtcagtggaagtccatgttcctgggcccatgcgtaacctccatccctgccaccatggccactttattcatgggcccattggtgatgacaggggtggctggggaaagaggctgagtggtgtccacagaacggggcatcctttccacttgattattaaaatcctcctcagctgaggtcatcagttggtgagcactcacacggaatacaaatgtcttcacagtttttgaccactcagaggtgtccatccacgtacctctttcctgaatttccttgtcaccaattttccaatcgtgcttcttttaagtccctgaccatccagccaaaccattggctgcagccgtaagtcagcatataatcacacatctgaccatttctccttccatgcaaagtgcacaaccagttgcactgctctaagttctgcccactgggaagatttcccttcatcactgtctttcagggatgtcctagaaaggggctgtggtgctgtagctgtcaactttcggatggtgcctgcatattgtgcagatccatctatgaatcaggccctagtcttctcttcctctgtcacctgatcataggtaactccccatgatgccatcagtgcaagctgggagacagaaggcagggtgacaggaatggagaccatggacatttgagccacttcctcatgtaacttacttgtgccttcgggacctgcttgagcccgatcacacatacaccactttcatatgatgaaggactgctgctatgcatgacccagtttatggctagatgtgtcagaaagcatccagttcacgacaggcagttcaggttgcatggtgacttgatgacccatagtcaaacattcagtttccacgaagcccagtaacaggccaagagctgtctctcaaaaggagagtagttatctgcagaagatggcagggccttgctccataatccaagaggcctccgctgtgattcacctatggaggcagcattggatctgctgggttatatggccccagtggtagagcagcttgcacagcagcctggacctgtttcagagcgttctcctgttctggacctcactcaaaactggcagcccttcgggtcactcgataaatgggccagagttacctaccccaatgaagaatgtggttgcctgcaaaatcaaaataggcccactaggcattgtgcctctttcctggttgtaagattttactaattgactaatatatctatttcaagaatacaatcagaagccagggaaacaatgaaggaatgggtccataaatccactgggcttaccgtaaaatagacttataccacaacactgttgatcagaaggctatgataagcccctaatttagctgttagatggtgttttggggtctctaggaaagggcatttattcagagccaatttctaattatatctgaaaggtatgaagcaaaagagtactccatgtaaatgactgctgttcctttagggaaggcttggaggaagacttacaatcagatttctgtagtgaacccaacatgatacaatgaacacatattttgtccagtgaaaataaaaaaacactgacccttctaaaatggtccaacataataagtatgccagtaggtggctggcaggtttttcatggtacggtgccataacaacggttccatgttggtttgtgctgttggtaagctggacattcagcactggatggtagctgaataaactttgcttaggagaagcctttgttaatgattccatacgtagtcttcatctttaacacaaggctacatgatcctattgagcatacagagggagagccaaggaaaatagccagtattcacaagataaggcatgtgatccacccgattattgaaaacctgttttgcagtggattttttaaaataagtatacccatgggacaccaatatttccacacttttgcctattgtgagagatgtagccactaaccatttccttagatcttatctcagaatttccaaccttattcttttataaacccctaaccagtcagccagactgatagccactgccaataaataggtatagatgtatccgctgtaccatttatgtttttaggcaacataggtgatcagatatactgccaagatttctgttcacctgaaggcttttcattcatcactgtctttcagcgctcccattggaagacttgtaatccagtgactgtccacttatagctgaatttgggtggcacattgtacaaacctgtatggaaatcaggctagttttttttttttaatccattctctgatagctggtcatggtgagtatctcacaaagccgtaggtatagttgagggacatgtgacattgaaacaagagtggaagtttggaagtttacctgctcatgcaacttacttgtgcttttctgatgttctctagcacaatttaaattataattcttccttttttaagatgaattgcttttacatgtccagactcatgtctttgaggacctcctggtttatgatgagcaattcagtttacttagttgcttggtgttataagtcctcagtatctgtcagagctcatgaacatagtaggagctaacccttaatagagaatatgtaaaagtagttatcaacaaggtgaacatgccttttctccagaagtctggaggtcagtactgtggccctctgttggggcttgttataggcttcctatagtatcttcattttctacagatagtttgagcaccattgggtctgctgggccataaggcccaaggagaattgtcttatatcctggacatgttgtaaactttttggggtccaaacatcatttatactatgttctttattcagcatggaggacaaaagatacagtaactttgccttttatttagaagcattatcttaccatgttccaggcttcagaatttctttggtgtttgtttcttctctggcacaagcatattgctaagacatctagggtacttgccacttcctgctcatcagatccatttagggggattttagcaatatagtggaatataaagatggtcaaggttactttagtttgacagagaataggggagtttatatggccccgaggcaaaggagtagaaagttttctgctgcctttgtcatgtaaaggcaatttggattaactaccatcacagatgggaggagagaataaaacattcaccaaatcagtagcctcataacaagtagtagagggtatttttatctgcttcagtaaagataacacatatggcacagcccatatgttccagatctttacatgattctctcaatcttgtaccccattattttctgattgaattcttgagcaatgtttggacagtaagattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccacatctacatcctttgtttaaatctgtgccattttccaccaccctccccaatatgcagtattattttttatgaacttgacagggaaaggagcagttttcaagtctcctacttggcatttcccaccatagtatcatatatcccacaggtcaagaattaatgtggaagttctgcaaaataccaagtatgttctttcaacttgtttggaatctgttaaatgaccatcagatgggttcatggattccatcttactgtgagccagacctgggcaagctatatttattacttagtccctatatgcctcagcctcaaatctaagatggtggagggtgagagttataaaactatgagtccctgagtatcaacgccatgctagaccctgtgtcaacagtttcacaatgtctgggtctttctttttctgtagtgtattgttacctaagcctctggggaaggaatggaggaatcattgtatgtacttgctatggtgtaggaggatcctttttcatagggactgaacttctttcgtcaggaagttctgtgtgtgaaaactggctaagatctggaaaccaggcaagagatagtgactttttacaaggttgctgctctcagtatcctgatcatccatcctgtttcttctggtcgtacagattgaacattaccactgttggcttcccatctttcagccctttaaagattctatgttctattgactatcttcctagcgttctatggttcaggatatcctgatagcccttaccaccttgctgttcttttccataattgtgcccatcttgcttttgacatttacgtgcttctggctggcctctgctttctcaggagtctataatctaaattgctttcagggagtgtagttctctaataacatactctctactatcatcttagagaaccacaactgagcttctcaatgatgttgctgctcctctcaccttactgctttcctagtggacgtattctctggtcatccggtggacatggttatctcatgggatttttggccttttatggtgtatccactctcacaggctcacttctctgagtatttagatcctcctttgttgtggaatgtagcattggcttttctagttcacttagtttggtaatcactttttcccctaagcttcaaagagccatcctagcttcacataaataccagtttcctttctagggtgttaagttctgtgttatagaagagtactctcatattgataaactctgccttgtccaactttatattctacctctcttacctcaatgacctcaggacccaattcttcatgtactgtcgtggaacccataggtacatgttggctagttcctgcagttccttggaagtagttcttttcatctttataacagagtcattacttacctgaataggttttatttttatttaaatgaattttggtctgttggccagtaaggagggtggggaatatattgtaagaatggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgcaaaacaaacttagattaaatatatatatattttggttggatttaggagggcatctagcagagattttgagaggtctcctgaaactatccctaacctcctattgcagtttccccattttcctttaattctcactcccatccttctaaatctggtctccatgggctacattcacaaccttgcaggctgtctttcaatagttcattctatgtttcatggattgataactttccctaaaacatgcctctataagctcgtctaatcttccttagacaattgtatatctttacttctcaagccagttgggtatctagcttgttgatattccatgataattcttatatatcttttataacattataaatcacattttacttatatattttacaaagttggttacattttaaagtcaattcttatggtttaaactattttctcttgaattaggggaacaatttttgtgaacattagggaagccattttcttctgaaagttttttagccaatcagtggattactaaaatagtcagtggattagtctttgtaaagataactaaatattacaacataatttcattttacctgtggaatatattttatcctaaaggaaataagagccattatgcaattaattggatggtttttgcaatctcataagtcaaaattaagagaaaaaagttactgctttattgagactaagaatgatgattatacatgtgaaactttcagtgtgtcaacatattattttaaggaacagcagaatggaagagtgccatacagatttgaatagttttaaaaggtaatatttatacatagaatttccttttttgttgtagaagggaaaaaaaggatcaaatggtatccactgtagtccaaattcattactttaatgactccttgtagagttaaattggagctagattataatatttgtaatatattaaaaatctacctttcaccttgtattttgacctatatattcaatgacagtgcaggaaaggtgaaaaagcactattattaaaagtattttaagaaaatagaaaggaaattagaaaagataaggggctgctaacttgtttcttccatcctttttttgcccaaattcttagtcttttttgggttggaatgaaatgcatgctctttttttttttttttttttttttttttttgagacagagtctcgctctgtcgcccaggctggagtgcagtgtggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccattttggccgggatggtctcgatctcctgacctcgtgatccgcccgcctcggcctcccaaagtgctgggattacaggcgtgagccaccgcgcccggccatgcatgctcttttaaaagaaaattcttccctagtgaaaaaatatttagattgttttgtttctatctgtaaacatatttatatccctaataccccttctgggtttctgctggaaatggtgttttaaaatattataaagatctagtaagaaaacatagaagggaggattatgggaaggtggcagagtgggaagcaccagggatgcctcctcatctagataacaatggcactagcaaaatctgtctgatataatgatttggaaagtctagagtctgttgaagtctttcaatgtccacaggaaggattggacagtaaattatagttaagttgggtcaatttcaactcttagtatatcagcacctaccttcagccaccctagctctgtggcaggcagctgcacacaaattccaggagtaccttgcaggagcctgggtgggcaaaaagcatcctgtcctgcaaatatcagggatctgtgctcttatctctaactactgctttttatcatagaggtgcagacaaagagggttatagcaattgttgttttatcttactccattattcacccttgtctccctctctagctgaagtgatttccagggacttaaagggccaagtctccttttcccaccttcgtttttctcattccccactttggggagccaaacattaaagtctatgacattcagaagcaactgcatatatggggaaaattagaaagtgaccacacaagcctggggataggtggaggctcagaaaagtcctgagaaaacagtaaggttactgatccttgaccagagacagtccataacaataaatttttttaaaaaataaataaacacaaacaatagtaaaaaacccagcaaaccctggggaaggaggagaatctgatttccagactccaaattacaacacaaaatcatttgtatttctatacactaacaataaacaatcagaacaggaaattatcaaagcatttttatttaaagtagtgtcaaaagaataaagtacttaggaatttgtcaaagagatgaaagacttgtacaatgaaagctaaaaaacattgctgagggaaattaaagaagacataaataaatgtaaacatatcctatgttcacaatttctatcaaaatcccaaagaccttttttttgcaaaaacataaaaacccatcctaagtttcgtatagtctcaagggacactgattagcccaaacaatcttgcaaaagaagaacaaacttggaagactcatactttcttatttctaaactactgcaaagctacagtaatcaaaacagtatggtactggcataaagacagacatatagaccaatggaatagactaaacagcccagaaataaaccctcacatatatgatcaaatgattttgacaatagtaccaagaccaatcaatggggaaagacagtctttttaccaaattgtgctgggaatactgggtatctacatgcaaaataataaagttggacccttactaataccatatacaaaaattaactcaaaataatcaaagacctaaatataagacacaaaactataaaactctcagaagaaaatataggacaaaagtatcatggcattgattttaacaatgatttcttagatatgacacaaaaggcacaggcaacaatagaaaaactggactttataaacattttaaaatttggggcatcgaaagactgtcatcagagtaaaaaggcaaccaatagaatgggagaaaatatctgtaatcatatatctggcaaggaattaatatacagaatatatagagaattcctaaaactcaacaacaacaaaaagtccaatccaaaaaaggactttaataacacatttctagattgaagatatataaatggtaaagtacatgaaaagatgcttaacatcattaatcattaaggaaatacaaatcaaaactgcagtagggtatcacttcagactaataagggtggtttccattaaaaacaaaaagaaagctggtgaggacataagttaattggaaccattgttcactattggcagaatgtaaagtggtatagtcactatgggaaaacagtatgacagttcctcaaaaaataaaaaatagaattaccatatgatctcacagtttgcacttctgcctatatacacaaaagaattgaaagcagcatgttaaaaagatattttacacccatgttcatagcagtgttactcacagtagctgaaacatggagacaattcagtgttcattggcagctgaaggaataagcaaaatgtggtatatacatacaatggaatattattcagccttaaaaaggaaggaatttctagcaaattccacaacattgatgaagcttgaggacattatgctaagtgaaataaaccaataacagaaagacaaatactatatgattccgtgtatatgaggtactttgagtggtgaaaattataaatacagaagtagaatgatgtttgttagggctgggggagagggaatgaggagttactgtttaatgagtatagagtttcagttttacaatgaaaagaattctaggagatgggtgaggataattgttgcagaaagttatataaatgcatttaagaccattgaactgtatcctaaaattggttttatgttatgccattaataacttatgatgcatttttattacaataaaaacattattaaagaaagatcatttccatatggctaggaacagaaggcatgttaggaaggatacataaacattgcagtatgtacaacaaatatgttaaaacattttatatcttaattcaaatgtcaaaggttaaaagaaaaaataacttatgttttgggaaatattcacatcaacttcatatttaaagaagattttaaaaacgtttaaagcagcaatttaaaagcctacagtaaaattattagattatttgctcaggcagcagctggtttagcaacatttattcagagcttattataagaaaaatatcttttgctgaagtttttaaaaaatagcttctaattgccattaataacttatgatgcattattttttaatcatttaattttatgtttattaatcaataatacatgttatatacaaatggcttttcaaagcttggtttatactaccaatatagctattaaaataacagctttctcataaggtatgaatgagttttcaaaagctatagctgagttttcatttttgcccatttattttaattccttttgatctttagaaattatatggccaggcgcggtgactcatgcctgtaatcccagcactttgggaggccaaggtgggtggatcacgaaatcaggagttcaagaccagcctgaccaatatggtgaaaccccgtctctactaaaaatacaaaaattagctgggcatggtggcacgtgcctgtaattccagctacttgggaggctgaggcaggagaataacttgaacccaggaggtggaggttgcagtgagctgagatggcgccactgcactccaacctgggcgatggagcgagactccgtttcaaaaaaataaataaataaatgatacataatattttgttaagggaaaaaaatattttagcttataacttatccttgtgtaaattaactatcataatcaattttttgtttaccttagcatctgttagcaaattgtattatgtactttggcaaatattcttttagagtatgaattagtttgaagcctaatatgtattttagatccaggtctaccacttattacctgtacaaacatgggcacattacctaatttctatgtttccatctctataaactgggaagaataccatgtttatcaaagggttttttgttagtattcaatgaaataatatatgtaagatatctaacactgtgcttataacaggatttagactcaagtaattttgtttcgatagaaaaggttatttactaagggaagataaaagatctctaatttttaatactatttttctcttttaagtgtgacataagttacactgaatatgtctgctaaagacttccagattcattactttttaactactttagccattttattatgcaatggcatgaacaatttaccagtagttttccctgattgtgagtatagtttccctgtttcagattatatacaaatagaaacatggagattagagaattacggtggctaattctgatgttccaatgtttgcatgtcccctgttacatatttaaaagtgcttctgtgctcataaaacctgtacacaactctcagtttctttagggctattctatattttgatttctttaatgaaaaaatggaatgttatttaatatctttatcataacacctgccagttattatataaaataggtggtaatttaaacgtaaccatatgcaaatgtgaaaaggagagaaaggtttcctctactctgatacaatggtatatgccattgtgttgtgttatgtcaccctggcatgataatggcacacttcaactaatccacttaagtgctgatactttgcatttattgtagagtttagttgcatttagtacagtattcttgaatgtttctttgcagctattattattactttttgcctaaagtgtcattgcataatgcagagtgactctggcatcaaccaaggatctgggtgctattttgcaggatttgtaaatattacaccaaaatgttaaataattttatttatcacacatggagtttctaaaaaagaatttagttttacattttttcagtttgaaaatatggaagttggtaagaaatctataaccatatgcaaatgggaattttaatactaataatatgaaaatagtgttgaggctgggcacggtggctcacacctgtaatcccagcactttgggaggccgaggtgggtggatcacaaggtcaggagttcaagaatagcctggccaacatgatgaaaccctgtctctactaaaaatacaaaaacattagccaggcgtggtggcgggtgcctgtaatctcagctactcgggaggctgaagcagagaattgcttgaacccgggaggcagaggctgcagtgagccgagattgcactactgcactccatcctgggtgatggagcgagactctgtctcttaaaaaaaaaaaaacagtgttgaatatcttcagcagttgaaataattcatttaaacatctctgaggaaatatatttaccaaaatatttatttataatatcatgccatgttaaatagataagaattaagccaacatatttataattctgtgctaagtagaaaatcaaataaacagaaatacttacattattacactaaatatattctgcttacataaagagaagcaaatgtgaatcagaataaaagtaattaagagatactaattattcttaggttttaaactctgctccctatttttggattatgcatgtatagccctggatcatttgaaaatgcataactgagactgcagtaaaaaaaaaatgctgaggatttacaacattttgaaaactttggtcattataaatacttacattagctatatttcaactgttgatttatgaaaaataagaatttgtagattaaatatagcataatgaaaaaataatattcaattaatgttttagttaaaatatatcacatatatttgaatataatatataaattaaaatatatttttaaaatgaaaattacaaaatacatatgtagtcttcaacttgcttttttgattcgatttttgtttctaagagtctttagtgttgctgtaggtggctctaggtcatttcacaatatttacttttttgtattattgttacaatgttcagttggtttccaatgtcttggaaataaacagtgctgccaagaatattcttgtatgtctccaagtgcattagtggaagattttctgtaggacacaaacctaggggtggaattggggatgagggttttatgaaatagtgtcatttttttttcaaaccagttgaatatatttataaacccacacagagagctcctactactctatatctttctctgtattcattattgccagggttttttatttttcccaagcaaatgaaatatgtcgcctcactaggtcttaatttctatttttctgattactaattaaattgaacgtgttctttttcatatgttagcttctgtgaaataacagttcatatcttttgcaatttttttccattagattgttggcccttgaagtatacttgaaatgtataattgacattaattttgtgatcaattctattaatgcggatatcttgctccacatggtgacttatattttctgtttctttattattttttcagtgaatataagttcttcattataatgtagtaaaactaatcagtactttcttttatgatagcacttactgtcatttgattaagaaacccttttttatctcaagatcagagtactatgttcatatcttttttagcatttttcttgtttattttttcctttaccaaccaattcagacataaaaacagatattatctttcataaacccaatataattatctaaatcaagaaattaacattgataaaatacttttattttaatctatagaaattatttaaattttactgtgttgtactgtctctgtaatttcttaaaactaatatttttactttgagatagctttagattcacatacatatgtaagatataaatcagagagatcccatacagtctttacccagtttcccctaacggttacatcttggaaaactataatatagtatcaagattaggatgttgacattgatataatcaaggtatggaatagttctgcctgccagaggatccctggtgttgcccttttatagccacactgatttccctttagctctgtccatgcctaaccccaggaaaccactaatcttttcttcatttctgtaatttttttaattttaagattgttatttaaatggaattatataatatttaacttttgggggttgactgttacacttggcataattccactgagtcatccaagatgttgtgtggatcagtagctgatcatgttattaaattgctgagtagttgttgattctctttaaaatatttgggagaattcaccagtgaaaccatatggacttgggattttttggatgggagctttttaattattaatacaaatttaatttctttaatgcctatatgactattcagattatctcactttacttgagttttggtagtctgtggttttttaggaattgttccatttcatccaagttgttaaatttatgggcataaagttgtttatagtgttctcttattattcttttaataactgcaagatctatagtgataccactgttttattcttgatatttgtgatttgtttcttctcccatttatttttgtcagtcttgctatatagcaatttatcagttttatggactttttttcaaacaaccagcttttttgtaaacttttgtattaatttcctattttcaatttcattgatttttgcttttatctttatttcctgtcttcttctagctttgggtttattatgttcttccttttagacttttttgaggtaacaacttaaattattgatttgactttttaatcttgtaatgtaagaatatagtgctataaattttcctctcagcattgtttttgctgaatcccacatattttgttatattgtatttttgtttttattcagttttgaatatactttacttccatcaagtcttcctctttgacgtatagattatttagaagtgtgctgtttaatttccaggtgtttagagattttccggtttgatttctagtttgattccattatggttagagatcacattgccttttgttgctagattgggagtcagggctggctcaccttcttctgttgggtggtgaatgataaaatgccctatcattatgctcttcctccagtcctggaatctctgatcattttacctccctgtttccacctttcagagttccccttagattgtctcttgcatcatttccagggtttatagtttagttaccagggaagaatgggggacagttgagtctacaccactttggctggatagaacatcacttcaattttgctttacaattttaaatatttaatttccttgaaattgatttttcatgtagagtatagtaggaatccagtttcactttgttttattcagataattgctgtttcaacacaattatatggttcttcagtggtctgaagtatcagctctaactgttatttaactagtttccatgcatacatgagtttgcttctggactttcttttatgtttcactggtgagtttgtttattcctgtggcagtagcatacctctagattattttagtttttaacatatttggatatatcctaaggtaattatcttcaccttactattattcttcttcagaagtgttttagctagtcttatacctttatttatccctataaatttaatagtaggcttgctaaattcctaaaaaaattctcataacatttattgaaatattttatatttttatacattaatatggagattctagcatcttttcgatattgaatctttcaatgcgtgaatgaacatagtttatctccccacatatttggacattctttaacatctttcaataacaattttataattttccccatgcagatcttgtacatgtttttgttaaatataattctaagtaccttatagttttgctcttgtatatgatatctttttaaataaataagcttgttcctttgttggctttgaggcctccttcaacagaaatcaagagaaagcttatgagctcagtgcgagaacagccctctgtctaactccatgcctccatcagcagcagtggacagggaactctcaaacttggaataagaccgtacctctgcaggacactattggcaggagacaagagaacaacagtgcacaccagcacatcgactaagactgcccatcttcaggacatttgtcagcaggagccaaatgggaaattctgagcaacaggtgttcctggcttgttctcctccaatcctccctttcgtcaacacccataccctttatctgtgttctttacagtcttcataaaaggagtccaggacttccagttaatcatttatcccagaactctaatcctccgtaaggatcctttttttttgacccaatatttccctcttctgactccccaaaccctttctttgtactctattgaattcaaggtcagtcaacaaaaaagtcctttatattttaatattttactatgagtgttcccttcaccttctgtgctaatgaaaatctagattttccttcatgatagtttcccctgcatccattgaggttctggtaaatgttttaacaatcaactctttggaagaagaaaacaaaagccttgatttgtatagtgttttccagtttctgtgctgttaaacactcacaccatagccatttaagctatcttctcacttcactgaataaggagcctgggacttgatgtccacactcagctctcctaagccagtatgagagagcaacaacacatcacatcttacagtacctttaagggtaactgttctctctactccactcaaatgtagcataggtcctgaaagtcagataagtgtcccctttgcttctcattgctgctttcagtttgttctccctccttcatgaacatacccttccgtgaatctcatgtcatcagatttgcccactcattgtacctttttgttatgggcacctcttctcacctcatctttttgtcaattaaaaaaattaatccccgtgatattgtcactttcttaaaagtgattcctccataatgcttcatgattgaaatgttgatatggatgatccttctaactctctgaagtttcagttccttgacagcctctcctccagtgatccacttaactcactttcatagtcatttcctaggccttgttattgcaagtaactgctataatttttcattgcctctattgtttgctccctaccccccgaatctctgcatactgaggtgtttcaaggctcagttcttgaccctctgttggttgtcttcactccctaggtgatctcatccagtcttatggctttaaattctgcctatatattaattatcccttaatttacatcttcaactgagatctcttctctgaactctagtttcatatatccaactgcttactgaacacctccagttaaatgtcatttcttcatttcaattatctccccttccatgttctccttcttaattaatggaaactccacactttagttacttagccaaaaaactctagagtcatccctgagacgtctctctctctcacatctcacatctgataagaaaaagaaattattttggctctatctttgaaaaaatatctacattttcattttttcttaccactagcacttttgctctctgtttttttttttttgccaccgtctgtagtttgtattattgcaaaagcctcctaactgatctctgcttttgtctttacttttcttcagtctcttttgaacacagcagccacagtcatcttcttaaaacataagtctgtccatgacatttctctgctgaaaattttccagtaacctcccatcttactgagttacaggtaaggtcattataacctctgaggccctacattacctagatcccttttacctctctgacattatctcctgctaccctcccatcttttgctcaattgcaggcacactagcctcctacaaattctacttatttatagaacactgtaggtatgccccaccttgaggctcttgcacttgagtttttatcttctgtctgtgttattttccttcagataattcagatggctcatctctcactttatttaaagctttactcaaatgttcccttttcagagagacttttcatagccatccaatctaaattttaatgctgcctctaattcactggcacttctttggcctctatcctactttaatttttctttttgcctatcttacatatctctcatatgctatgttgtacttattaactcattgtatcacttcccactagaatgtaagtcccatgaaagcaggaatatttattaattgtattcactgctatattctcagtgccagaaaaatgcctggcaaatagtaattatcccataaatatgtaaatttgaaggaatgcataaattaaaaaatgtgttttgttagttgctattgtatagatatgcattgattactacaagttgatcagaaatagagtgtttctgctaaaccccctgtttctataatttgtctataggctttttgggaattttctttgtaagtagtatcatctgtgaaaaataatagttgtgactttcatttttcaattctaaaaatttttatttgtatttcttatatttgtgctttgtctaggtcctccagaaagttaaatagaagtggttaaatagtggtggttatactatttgtgattttaaaggtgatgcatctgatgtttcaacacaaggaatgatatttattgtctttggtggttattctttatcaagttgaaaaaatttgttttcctttgatatttaaagtttgtgttttaccatgagtatattaatttttttgaccataagtgattggtaattttatcatgtttaagttttaagattttattttatcatgaataagtattgtattttctgcttctgagactgttttctccattaatattttaatgtggtaaatgttgccatggattttaaaatgtaaacattctctttcattcctggaataaaactaatgtattcatcatgtgttatttgagttacataacactggacctagttaatcattttttcataggatgcttacttctagtttatgaataaaattgatctttaattttcctgttcagtcactgtctttttataattttagtatcattgaataagttgtggaatagttcctttcttctattctttgaaagatttttataccctggaagacctattccttaaatgtatggtagaagtcttctgtaaaactaattggaactgttatatatttataggaagattttatactgtggattcagatttctttgtaatgtaatagaagttatttcttccttaatcaatttttataaattctgaagtaatatgcttacatgaatatgaccatttcatctgagttttaaatttactggcttaaaatatttatcatattttttattatcttttaaatctcaaatggatccataattatattctctttaatttgtgaattctatttcttgccctcccttccaacagttttcccctcccttcccatctcacatcattcttcctgtaaatatataaattttgttggtacttttaaagatccaagctttggattttataatcattatgtttagcttttttcttgtataactttgtagtttcattgttatgatcttcttctgcctatagtctttgagtttatgctttgtttctttttccagcttcttaagttgatacataactcattaatggttggcttttctactattttaagtacttaatactattaattttccccaaatactgtttcaactgcatcccacagatgtttatatgtagcattttaatttttgtttagttttaagtattttaaggtttccattatggtttgttctttgtcctgtggcttatgtagaggacattttcaaatttacatatgcatgggttttgggttatttttttatttgggttattatgtatttgtagttgaaataaatcatggtcagaatgcatggtttgtatgaaaccaattcttgaaatttcttgggagttgctatggcagagatttctagttttctaccaaaaaatgttttctttattcctgtagttttcatgatatagctgggcatatagttaggtacctgtatttttcagtatcctgtacacctagatgttaccatgaaactaaatgttgccagtggaatttgcacttaatagttgtgtgtttgtggaattacctttcagaaatatttactccctcccatcattttaaagaaaggattctacttccctgatttttttagtctttgtttttttcttttttttgagacagggtgtcactctgtcacccaggctagagctcagtggcatgatcgcggctcacagtagcctcgacctcccagggctcagctgatcctcccacctcagccttccaagtagctgggactacaggcctgcaccaccacacctggctaatttttatatttttttgtcaagatagagttttgtcatgttgctcaggctggtcacaaactcctggactcaagagatctgtctgtcttggcctcccaaagtgctgagattacaggtgtgagccactgcacccagctgtttcctgattattgatgtagagcttggccttggccatgtaacttattttggtcaatgataatttgagaaacctgactctacagaagcttgatatatgcttgcacatttaggtttgctctgtctgccatgggcatgaaaagaatgcggccatttcccttgataatatatgttcttcagaaacattagataatgtcataatgcattattacttggatatttcacaatgtattttatgttcccatgtctactcattttgtttatttccgttgttttgctgtttcaaataattctatgaggcaattcttatacattaaattctgttcatatcttattgtttctttggtataaaactcaagaactggtgatcttggattaaaggatataaacaagtgtttgttctattcttcatttttacagtgaaatacaaaaaatctcctttaaaaagctactccttgcatttcatgttagtatttgcctggtacatcttttttcatccctttattttcaacatttctgtaatatgtttagttgatgtttctaggaattagtatatagtgggcagtctctttcatttatctggtgattttgtccacttatatttatttaagtgttttccacttattttgattattcatgtttttggacgtgtttctaccatcttattttttgctttatgttaatttatctttttatgcttgcatttatctttccttgctttataatacattgatttgttttcactatgtatttttctctttcagtgtttgctctgaaaaaatttagcatgcacatgtaatacaatctaaaattaattacttggataatagaaaaacttcaaacgttttaaataagatcaaaacacttcctatttacatatatttttgtctggtcatatattttttaatataatgaaacattattatttaagaaaggtaatttataaagacaatgcttatttcaatttatctacaaatttactaattttatttttctaactggttttaggatctcatattatctttttttgcccaagtttcgtcataataggtataattttttaaaaatttatttcatggactgtattatgtttcctgtatttaggtggcatgtcttttatcatttctcagaattcacactcatgattgcagtaaatatttcctttcctccattaataaaaattcattcctttcagagatgcaattagatatgttatactatctaattctatctgccatattatttaaactctcttttacattgtttatattcttatctccttatgctcaattcccaaaaatttatttatagttttttttaaattttattattattatactttaagttttagggtacatgtgcacaacgtgcaggtttgttacatatgtatacatgtgccatgttggtgtgctgcacccattaacttgtcatttagcattaggtatatctcctaatgctatccctcccccctccccacaccccacaacagtccctggagtgtgatgttctccttcctgtgtccatgtgttctcattgttcaattcccacttatgagtgagaacatgcggtgtttggttttctgtccttgcgatagtttacagagaatgatggtttccagtttcatccatgtccctacagaggacatgaactcatcattttttatggctgcatagtattccatggtgtatatgtcccacattttcttaatccagtctatcgttgttggacatttaggttggttccaagtctttgctattgtgaatagtgccgcaataaacataatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcatttttcatgtgttttttggctgcataaatgtcttcttttgagaagtgtctgttcatatccttcgcccactttttgatggggttgtttgtttttttcttgtaaatttgtttgagttcattgtagattctggatactagccctttgtcagatgagtaggttgcaaaaattttctcccattctgtcggttgcctgttcactctgatggtagtttcttttgttgtgcagaaaatgttatccagcatataaacagaaccaaagacaaaaaccacctgattatctcaatagatgcagaaaaggcctttgacaaaattcagcaaccttcatgctaaaaactctcaataaattaggtattgatgggtcgtatctcaaaataataagagctatctatgacaaacccacagccaatatcatactgaatgggcaaaaactggaagcattccctttgaaaatgggcacaagacagggatgccccctctcatcattcctattcaacatagtgttggaagttctggccagggcaatcaggcaggagaaggaaataaagcgtattcaattaggaaaagaggaagtcaaattgtccctgtttgcagatgacatgattgtatatctagaaaacctcgtcgtctcagcccaaaatctcctcaagctgataagcaacttcagcaaagtctcaggatacaaaatcaatgtacaaaaatcacaagcattcttatacaccaataagagacaaacagagagccaaatcatgagtgaactcccattcacagttgcttcaaagagaataaaatacctaggaatccaacttacaagggatgtgaaggacctcttcaaggagaactaaaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagtacacatggaaccaaacaagagcccgcattgccaagtcaatcctaagccaaaagaacaaagctggaggcatcactctacctgacttcaaactatactacaagcctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttcctcacaccttataaaaaaattaattcaagatggattaaagacttaaatgttagacctaaaaccataaaaaccctagaagaaaacctaggcaataccattcaggacataggcatgggcaaagacttcatgtctaaaacaccaaaagcaatggcaacaaaagccaaaattgacaagtgggatctaattaaatttatttattcttaattgtccagttctctttctatatgttaaatctttttacaaatgctttgtatttttctaatgagtaattgtatgttttacttctaaaggtcatatttgattctttaaaatttttttttaattattggtagctcctttttacttgaacttatttgtgtgtatactttttgtttaaccatttctaggattatgcttccaaagcttatggctgacctaaagcttactctccaaattgcagttctggttttggcatttggcaacataccccaacagtaagcatgtgcttatggttgctagctcctatacagttattttactttattttgtccataagctagtaatcgtaaacacatgctttactttttcactactgtcgagtgtaacaatgcaacaagatgaacctaaggtttacttaagtgccagttgtttttgtagtgggagaatccttcaaagtatgtagtcttacatattgctggaattaaacatcctacagttaattttagctattaagatttccattttttatgttttttggaagaatataagtaaatgattgtcctaatttaatccatggaggaaaattataacaatttttaaaattttatactatcatggatacataatagttacacatatatatggggtacatgtgatattttgatataaacatacaatgtgtaatgatcaaatctgggtaaatgacatatccatcacctcaaacatttatcattcctttctgttgggaacattccaaatattcttttctggttattttgaaatatacaataaattatcacaaactatagttgccctatggtgctctcaaacactagaacttattccttctatataactgtatttttgtacacattaaccaacctctctgccttttctctcccaccttcttttcccagtctctggtaaccaccattctattcattacctccatgaggccaacttttttagctctaatatatgagtgagaataagcgatatttgtccttttgtgcctggtttgtttcacttaatgtaatgtcctccaattccatccctgttgctgctaataacaggatttcattcttatttaagttctttattcagaattaaagtattttatagtcaatggataaatccaactcttgattagtttatatgttctagggaggataagagaaagcaaaataagggttttcaaagttctttaatctggttagcacaaaggctacaggagttgaagtatgccaaaaaagaggtttacatttggataataagaagaggcataaagtaaaataaaattatagtcaaaagtgaggttgccttaggttcagcatctttaagctgatagtggcaaaggcaatggtcaattactgtaaatgtcattttctcacccttttcaatagtttcctgttttccagaattttgtttttttgatgtatcatgaattggatagtggagctttgtagtagaagaaatggcttattaactatgtgcagttactttattcattcatttctttactcatcagaaatttgcatacagtttgggaggcagtgggtaggaatgggagataccaaggaagatggaaaagccctgcttttcaggatttcacacgccagatcaaatggatttcataatcaaaacaaaaattatttcacttgattctaaattgctaactttggaatagttgtgtatatatactaattgagagccaaggtgatgtcattattttatttaaccatacattaagttgtaatttttatttatgtgatttatgaaataatgttatgaaccaaaataagtcaaagcattgtattttaattaatcaaatattaacaattttaattccctctattaggataaaggatgttaccatattatacagaaaaaagttcagtttagaaataagacctaagcggtgtgctcaccattgttccatctgtatgggcgcacccttctatgtagaagtaacttgccttgctgagaattaaaaagaaaattttatatgcgagtgcaatttcttttgtggcaccaaaactttatatataacaatttggggtctctcccgggattacattctcctccaggacggtctctcctctctcgtgaggaggcgcacccagccctagtgtggtggcctcaggggtgagaaatcaagacccaccccagtgcaaggaataacccgagctctcagcgacgcggatttaaaaaaaaaaaaaaaaaaaaagggaaaagaaactggccagcaacctagcttaaaggactctcacatactgcggcgaccactctgtgcacagaccaaggaaggagaagccgcgggagcgggtagagtaccttggtggtcaaattctggagggctaaatgtgtgtgtgcgtgaatgatcacaaacaaccctgcttgcagtgttgttcgtgtggatggtgacaagtcctactgctggacagtgtgagtgggtcctctttgcagttctaccttggcggagcggccagagaggacagcacaagtgggaagtgtgcaaaggaccttcagagggggaaagggagaaataggtcaatcttccaggacaggcaagacaccccctggtttgaggggttgagccttccagggcaagcaaggcaagacgccccctggtttgagggcttgagccttccaggacaggcaaggtgagacaccccctggtttacggggttgagccttccgggacaggcaaggtgagacatccctagtgttgaggggttgagccttccgctaatttcaagggttgaacttgacacaacccccccgttcaacccctttcctttcttctcgggagaagaaagagtagttgcactcccgcaggtccctaccctaggagagagagagacaggagagagagagagagagagagagagagagagagagagagagagacagacagacaggagagagagagggggagagagacagagaggagagagacagaagagagagagagagacagaggaaagagagacaggagagagagagacaggagagaggcagagagagacaggagagaggcagagagagacagagaggaagagagacaggagaggcagagagagagagaggagagaggcagagagagagagacaggagagaggcagagagagagacaggagagaggagagaggcagagagagagagacaggagagaggcagagagagagacaggagagagaggagagaggcagagagagacaggagagaggcagagagagagacaggagagagagaggagagaggcagagagagacaggagagaggcagagagagacaggagagaggcagagagagacaggcagagagagggagaggcaggagagagagaaagagaaaaatagaagtagtaaaaaaacaaaaacaaagaaaaaaaaacaaaaaaaccagtgtaccctattcctttaaaagctagggtaaatttaaaacctataattgataattgaaggtcttctccgtgaccctgcaacactccaataccaccttgttgtaagtgtaaacaagggcatagccagaaagcactgaggccactgacaacctgtagccttcctataaaaaatccttaacctagtaatctgcggatggccaaatgcattcaatctgtagcagcaactgctttgctaacagaagaaagtagaaaaataacttttagaggaaacctcattctgagcacaactcaccagtttagttcaggactatcctaagtcaaaaaaagcaaaaaggtagcttactaactcaaaaatcttaaagtatggggctattctgttagaaaaagatgatttaacattaaccactgaaaatccccctaacccagcaggtttcctaacaggggatttaaatcttaattaccgtacaaaggtccgaccagacccaggaggaattcccttcaggacaggaccatagatgtttcttcccgggtgaatgagggaaaaagacacaatggttattcagtaattgatagggaaactcttgtagaagcagagttaggaaaattgcctaataattggtctgctcaaacatgcaagctgtttgcactcagccaagccttaaacagaaccaggaaggaaccatctataccaattctaagttaatttggactaaacaaggtcttattaatagtaaagaataattaaaatcccaaacttagaaggttttcaagaaacgtagcttgctaaaagttagcagtgtaacacgtattatcctaacttttaatcttgtggccttagacagtctagtccacagacatgaaggaagttcgctttgaaaaagaatggttatcttcaagagggaaaaaaaaaagtggggtgggagaatttacataaaaaggaatgttccatggtaaattattgtcctgaaataaattaactgttttttttttttaaaggggatgtttgtgacaagtcagaaagttgaggcatgtcgaaaaaatatctctgaaagttgtgggaaaaaaaggttataaaagggaatttatgcaagaaatgttgtataatttaaaagtaactaggcctcctgaatgtaaaactatttattctataaacagtttatgtgcaaggtgtgtaagaaaagtaaaatatacttttggtaaaaagattgtagggaggcataagaatgtggatttttacctacattaacaggttaaaaaatatatattttgttttaaaggtttaagcaagttgtaaaacgttaattgtaaagaaaattgtgtgtgtaaacatactcgctaaagttaaagaggtatcatccagtttttctgtgaactggacagtaaaagcataacaggtttttcttaacgcactaacctgctctttaacaaaaattataaaaggttaaaaagagtctataaaatcttaccttagggccagacattaaaaattgaataaatatatctacaaagttttattaaaactaagtttaacattaataacacactaatataaaggtgaaatttagctcatcgggtataaaaatcatacaagaagcattatcaaatataaaatggtatttggctttctttggtctaaaaactaataaaaataggtgctaaaggaaatttctcagtaagaaggcaccaaggactataaagtcctctgcagatgtccccacacttaaaaggtcaatttcttagaaattatatacttggtttatcttccactttccttttcctcaaaactaaaagtcttttagcacaggtaccatccctagaatttccggtaaacgggaaccagcctgaagatcacgttcttatctagggtggaaagaaagaaaactttagcgatcctgggaaggaccctaccttgtgctgctaaccaccgagactgctgttcgtacagcaaaaaggggatggaatcatcacacccgagtcaagaatgtgccaccccctccagagtcgtgggccatagtcccaggggaaaaccctaccgaactaaagctaagaaaaatttaactctctttcatctattctattactctttattctttcctctatctgttgctgaccatctagttattaacataagcaagtcaattttgcctcaaactactgcatttaatgcttgcgttgttataccctgaaggaacttaccaggtcaaagacagttttctatttcagaaaaggaaaagtacctgtgtccctcctgactcttctcagactgggcattagtaaattgggaccatttaatccaaggagatttcgataaagacctaaatgtcaaccaggagtcttgcccccgatgtagagcttttatgctgtagttggtccaacgttctgtggcccactgaagagcaaagatggactgcaaagatggactacaaaaaccaactggtttttgtaatttcctaaaaccctacattcattttactagagaatcatagaagttaaagacttaaactttggcaattaagacaggataccaagatgcaaatgcctagttggaatggatcaaatattccgtccacacattaaacaaaagcaattgttacacttgtgcgcacggcaagccagaggcccagattgtcccctttccactaaggtggtcctccagtcgaccaggcatgggctgcatggtagctcttttccaggattctacaccctggagtaataagtcgtaccaagctctctctctctgctatatcctgaagtccggcaccctgcgggtcagcccccgagggccatccagcttccgtctcccaacagtaagttaactttgtgtctctcatgacagggaggaaacctagtgttccttagagacctgaagggatgcagtgagcttaaaaattttcaagagcttatcaatcagttagcccttgttcatccccaagcagatgtgtggtggtattgtggtggacctttactggacactctgccaaataactggagtggcacttgcgctttagtccaattggctatccctttcaccctggcatttcaacaaccagaggaaggaaaaataagacattgtaaagcaagagaagccccttataggtctttcgactctcaagtctatttaaacgcaactggagtcccacagggaatatcagatcagtttaaagcctaaaatcaaatagctgcagaatttgagtcaatattttggtgggcgaccattaataaaaatgtagattggataaactatatctactacaaccaacagcgatttattaactacactaaagatgctgttaaaggaatagctgagcaattagggccactagccagatggcttaggaaaatagaatagccttagacatgatattagcagaaagaggagtttgcgtcatgattaaaactcaatgttgtatcttcatcccaaacaacactgcccccaatagaagtataacaaaggcattgcaaggtctgactgctctatcaaatgagttagccggtaactcaggggtaaatgacccctttacaagatggctaaaacagtagttcagtaaatggaaaggaataatagcctcgattcttatttccctcgcagccgtaataggtgtacttattcttgtcaagtgctgtgtcataccatacatccgtaagtagatgcagaggctcataaaaacggcacttactaaaacctcccttaactatcctccaccttatccagagaaacttcttttgaaaaatcaagcaaaacagctaagccatgttaaaaaaaaaagaaaaaaaggtttgaaaagaaaactataaagaatacaaggggaaggattgttagatatgggttctaaatttcttttcaaagaattaatatgtcagtatgttcaattctttgccttttacttgtaaacttcctcgtgaagcaacctttttcgtttccctgactcatctgattacctactccaccctgactcattctgatcacctactccaccctaactcattccgatcacctgctccaccctaacacattctgatcacctgctccaccctaactcattccaattacctgctatctgctctgccctgactcccaacaaagcactcaccctgtcattctctttaaattagccaatcggaattagtttaacctgtgtggtctaaccctagccaataggggaacaacacagcagcaggggccacatgtgtcagggataagaaccccttcccctcccttgtccaagtgtgtgctcaccattgttccatctgtaagtgcgcacctttctatatagaagtaacttgccttgctgagaattgaaaagaaaattaaaaaaaataataattagacatgggcattgttactctaaagagcacctcgtttaacttttatgaatcaaagttttatcctatgttggtcctcaataaatcctatcatacttcccatattaatttctgtaagttaattagagtgacatcttgtgccactctcagtgttttgtttgtttatttttttttgtttgtttggcttttcacttctcactagtttcctaccctccagaatttcccatttttggagaagcgctaaaggcttagttctaggactgattctatgtcacaggggcaatgaagaaaataaatgaaaccagcatggcataaaatatagaagagtaagaggagaatataatgataagagatagatcctaggagtagaggcaaataatagtgtcataaaggaaagatttaaaaaatgaaaattaaaaatatgaattgtctcatccaaaatgggttagaaaattaatttaaaacattattattaaattgataattttaaaatctgcaatgttagatttatagcactggatctacatactatgtataatgtgaggatctttataatatcaggtagtcttgagttatattgggtaatgctgttaattagtatgttgatactataaatggtgttttatagttggtactataaatgatactataaatgagactataaatggttttactgaagcataaatgaataggataattgcattaccattcttgttgcattttctgaatgtatgttttctagagaaaatgctatgctatttcatagaagttcatgtgtgtcataaaaactaatcctaagtgttcattcatttctaatagtatccataagattaagtattatttaaatttttttgaagtatcaggttgctgaaatattagtctgaggataacaaaatccagtaatagtttttcttcctacaaaggtcatagttttatatgtgtgcatatgtgtctatgtgtgtgtatatctacaaattaattaaaattgttgagcatctcatcatgtgctagacattgtataggttatactttacatatgtttccaatttaaaactgtcatatgaaatttaagaactttcttataactattgagaggactacatatattattcaaatattatttatattttaaatatgtttttaaaagatattacgagccaagcacttgtagcacagactagtgcataattaaggtttctgatagatttggtgaattaacaaaaaattgttaagttggtagtgagctaaaaagatggcagggtaaattaacaaaaatggaaatacgtgatactccatatctcatcccttggaattatggatctgactacatcatcattatgtctggccatgacagcacaaaccaacaatttaacttcttttcgatctaatagtgtttggtacatgccataatcatattgttagttttttgggatatttcacagtgcaaacaaagttatgacagattgatcagaagccctgggtctggtaaaatagaatagccctggtctgtttttatccaggtgtcactaatcttcatgtttaactttgtacctgaaaatataaaataatagctaattgtgctttcccatttcatttatgtttcttcaaagaaccacaggatttttatgtttaataattcattttaaccactcttttccaatgtagacagtaggaaacactaaatgcaaaaatatgtgcagtaggtagtctccaaacatagacccctcaattaactacacctcctgctattcagttcctagtgtagttcctgctacagtgggtctgagctaatggatctatgagctttcttttagcattaattacttggaaacaattttcagtttcttaaaaattcagtttatttaagcatgttaatctgaaaatttctttattattttaagattagttccttaattaattagacattttttactgtagaatatttataaatctctgttctttattaaaaaacctgaaaattttaaattttagtttaatttatagcttgaatctagatttcaatttgtttattcttattttagattatgacttttgagttttcaaattctcattttcaaacaggaaaatgaatataaaaatgtagtgttgagggactgtttttccctctaagtctggactgtcacatgattaatgtaacataaaagtgattttatatcacaaaagtgataaattcccattcttgtgacatactgctaatgcaaaactttaatcactgtgccttcaataggaagccaaaatagtctgacttaaatttaatgtaaaataagtaataaccgctgataaactatttgacctagagtcttataaatgataaatgaggacttaaagctctaatttgtcccttcttaatggactatatatgtatataagtaactgatgtcattgcttcattcttggtagaatgtgctgtctgttctttgtgacatagtcacatggatggcagcaggcaaagagagaatgaggaagatgccaaaatggaaacccatgataaaaccatcccatgtcatgagacttattcactaccagaagaacaatatgggaaaaccgcccccatgattcaattatctcccaccaggtccctcccacaacacgtgggaattacgggagtacaattcaagatgagatttgactgggaacacagagccaaaccatatcaggcagccaagctaaagcttgatgggtaggcaggaggaagctaggtaagagaacaaggagaggctgtgccagcacatgcaaagatctagaggtcagccccaagcttttcagaggggccagggaagcatgcaaggagcatgcagtgttgacagctgacctgggccaggccatggagttcctttgaagccatgcttaggaatttaggtcattatctgaaggtacttcctcaaattccaactctctgaagcggcttagaaactttgtgcctggaaatatcattttttcagcacatgaaaaaacaattgaagtggaacaaaactggactcaatgatgccaagttgggaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctatataacacttgatgttttaggcagcattacttgacttgttttttctttttttgttacaccacagcacttgggtaaaatatttatatgattcactgagataaatgaacaaggcatttcattgaggagaccagccattgggctctggcagtcgtaggtctttcctggctatcccggggtgggggctaaagaggagcgttttgtattcttatatgagatggtcagttggatccagccacaagaggagacagaagagaggatcaggaaaacaaagttcattatactcatgatcttaaagacagggggcacagtaaaccatgctaactgggaaaaacaccaatgtggtcaggaggcaaaacataggagcaagggaaaaggattaggccagagcctttactgaggtttccacaggaagggcaaggcaggacagacttaacagtttagaattggctagtttgaataatttcagcaggctctaagctgtaagtgtggctgctggttgcctggtacctaactctgggatgattaaagcagaggcacattgactcgtggggtgtatgggcctgttaaaggaggtaaagctctggattggttagtttgcttatcaaaggcatgatcttggctagactttcctgtctttaagaattggctagcctcaggaggtcagaggtcaagcatcatactatatagaaaagtacagacacacacacacacacaatacaaggaacaatattttgggtatagccataacctatttgaggcaaataaactggaaaactttgctttagggggatacatgaatgttatcagggcttttgcaaatgccaggacttctgacaactgtttagtgtttttgctttcacagcttcacaatatcttatatagagaaaatggtgtcatacttctaagaaattacttttgtacaacatgcagggaactagacctgtttttctcctttttcactatagagtactcagtggcacatggatttatgtaaatattaaatggctataacttgctttgttaaaaactgttatagaactattcctgctgatttcagtgtaaattaattttggtaaaccttaacagtttctctttgtaacttaaattttttaaatagaaaatactatattcacatggcaaaacattcagaaagtatattaaggcataacgaagaaactaaaaatctataatcctacattctgaaatggtaattatgcataatttagaaacttacctttttacttatctataaaaatatatttttatatgagtaaatgtatatgtaatcatgtcaatcaaaaatattttcctcctatttttcctccttttataaacaaagatcaaatttagaaatttattgtgtttcaattttttttttttttgagacagttttgctcttgttgcccaggttggagtgtgcagtggcacgatctcggctcgctgcaacatctgcttcccaggttcaagcaattctcctgcctcagccttccaagtagtggaaattacaggcatgctccatcacacccagctaattttgtatttttagtagacacgatgtttcaccatattggtcaggctggtcttgaactcctgaccttaggtgatccacctgcctcagcctcccaaagtgctgggattacaggcatgagccatgtgcccggcctacagcatatatactattaaacatgtatacacatatatgcatacatggtatttatagatatacatggatatttatatccatctacacacacacacatatatatatatgcacacatgtacacttctacccacaaacatacacacattactataacaagagcatccttctctgttaccaggatctggagctcctaaaggatgttcccaggtcattctaggagatttccagggcatggtctggaggatttccaggaagaggtttcacttataccttctatcatattttacattctcatttatactaaaaattttggtttgataatatgtttgattcaaagagctgtttgttattctctaattttttcatgacttcctatttttctctactggatcttgatgaatgcagtatattcttcaagggtaataattagatttattttgtatggtcttttgatcctggcactactcttttatgtggaatcttgcttttgttttttaaaatgtgttttattgtctcctgtaatgcttcaggattactgtaaaaggcttctggttattgattttatgtttacttttatgaatggctcaatgtaaaatctgagttgaatccctacatagattacatggatatgtcctctggaaagctttgtatagatgagtggataggcagctgatcattgctctgggtcttttaaaagccagaattctgggagcattgcttaggggcaccatcaactatacaaattactgattgatttatttcttactcttacccagtatttgatcaatttctttagaaaggaaccattttctcccaaggtctaaaagcctgtttcctaatgctgctatgctacaggagtagtatggtaggaatagagagagtgatgaggactgggaataaaaggggtaaactgtcctgtgtagatcaatgaatcctctactcttagctcctcttctcactgctgtgagaagcttacctgtttttttcctagtgctattttctgtgtggatatgcagatcaagtgagttgtctctgaacaataactccttcctgaaaattctagtctatggttcccccttgtattctcagtcaatatttttcaataactttcatttctcaggaccttatgttgttttctttgtatttgtacacattttaatttttctttacattaaatattttagccgttgccctttccacgctcctcattatgctgccttttttactccctaatatgctcatacagaaggtcatcttagtagcactaactgtggtcaaatgaataagggatgaagaagaaattatttatagaaaaggatcacatgctgagatttgtagtactcgtgtagcacttaacaccaggcaatacatatatgacatgaatgtctggcaggcattcaagatataatgatgtccaataacattgaaaaagaacacctttttaaaaaattaagattgtttttctcttgaaaataattttgcattaaaagcatgtgctacttttttttctttgaaaagaattcacattacatgtgtgctacttattgatatatggactacattgtggtttgccatattagattataggttttgaaccaaaagtatgatttaaaaggacatgttaaaaataaataatgaagagagtttaataatgtaagagatccgtatgaacaagtagtgctaagtatgtatctcacttcagctcctgcagtgggactttcacatgcaaatagatgcattatgggtaccagttatatgtagttatctcccttttcctcaagtagatgaacgtatgacaggttgcatttacaataatccctatggataatatttttttctaagtatatacaagatatttttttatacctttattttatcaaacattaagcaataactaaagcaataaacattggtttacaattttcatttatactgtatctcagttgcaatgttgcctagcatgtgacatatcttccactgacatttgtaatgcatgtcaaaataaaaatgatgtttattgctttcttggaacttactcttcacggagaataaaccctggataaatgatgcatttgatctgatgatgaaatataagaacagtgatatgtattgtttggaataatccatcaaaagacactgtcagtgtatccctaaagagtgtgcttatactttatatgttgcatttttcttcagaaactgactgatagtacctgtttttgagatgacaaaaagagaacagaagaaaatgggttgctacatgaagcaaaagttagtgcattattactcacaagtagtgttattgtaaactggaaggcacatatacacactttcactctgaaagtcaaaggccaagaaaatattttagaatttgcacagcagtgaaggacgtgaatatgtatggaaacatgcaagttgccttaatactcttgaaggaattaaataattgtcttaaggccatatattgtttaaccatggtttattctgtgttatgtaaaattcttatagttcttttaataacctaataccactatggagtttctagaagcaatacatatttgctatagaatggcttatgggttagttttagtaactttttgttagttttttaaattctttttaaaaaattaatcactcttttgcattccaaaaaaagaaagcaatacccatcatgcatgttcacatatacacatacagaatcactagtctgcttgtttggtatgtggatgggaaaaacagaaattatactgatggcagcagtggcccatctggagtggctgctgtgaagacaatggctgcagcaggggaggtgtggccagggctgcaggagagtcacagctggggctgcatcctcccagagccagcaggcctgaaacaggcgggagccttgcctcctaccaagtggtggagcaggagccccatgctctgggcacagctgcagccacccagctgcagctctggacctgggcatccatatactctcggggtcccaggaagccaccctgcccccacaggcttggaagtgcctgttcccactgtctggcctttccctgctcctggcacccactttggggcagagcaaagttgtggctgagcccaggtgctgttgcaacccagccaggtgtgcgtgtgcttggggtggtgccgactcaccagtcccccgccatttggccccctccagacattgggcaccaacaaacacaagagagaggccaaaggggtactgagggtggctcagctcaggtctgcaggtgccccttggcatgaacagcctgggtgctgtggatgacatgtagatggtggcaggaggcagacaggctcctgggcagaaaaatgtgggtccctggtgaagccccaccttcaagccaggcatggcctaaagcctgggggccaggctcccaattcccagtggagtccacaactgggagtgaggacttgtggtgatttttctgggcccacctatggccacccaaggaccaatcagcacgtatttcccctcttctgagcccataaaagccccagatggacccagccagactcacacagacattaaaactaccagctgtgggaaggagctacccaatttgggtctcctcaactcattcagacaacctgcctgcagataggagctacccactccagatctctgctgagagctggacactcatcaggacgacctgcccgcagaaaggagctacccactctgggtctcctctctgtggagggctggaaacgcattgggctgacgtgcctgcagaaatgagctacccactttgggtctcctgagagctgttctctgttctgtcacccagtaaagttcctctctgccttgcccatccacctaccagtttttcatgtacctcattcttcctggatgtggaatgaactcgggacccactaactggtaggggactaaaagagctgtaacccaaacagggctgaaatgaccccctgcttgccactttgcaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctaccaggccgagtgggcagaatgagcccagcaggcccaagcaaaacttgggcaaaggtaccaccagccacagaggtttctggctggaaaagtgacaccctagggatcctgtgacagtatcagagttccttccccttactctccttccctcccaccctctgtacacacaagaatgcaattctctaatttctgacccaagatggatgattcttgtaggctgtgtaatttactcctttgctgacatggaattaatggttcctctagatgaaggattagccctgttgctaccatttttcccatctttgtgtaacctgagaactagcatttgacatccaagccttagcctcaagatacagatataactcaactaacagcatccttagtctatgatgacagcttagacttctaagtacttttctcttccctgccctagcagggatttccatgacagcaaggctgtcttctctagtcttcctttccttaggctgttacttcaaacactagaagcttgtcttttattgacttattttctcacaagtcagacagaagtgtaagggtttggctactgttgatataaacttttatctcatttagggagatgaatcattcttctctctggattgtgttaaccaggaccaaatgatctcttattttatgatagattttgatccagtacattcttgctatctaaaacctgaatgttcatctacccttaacttctattttttcatcaagggtagaatataatatgaagaaggaaattcctattcctagactgaaacttgcttcactttctttgtgtgtagctcctaacattagatataaacaaatatgtaattaagaaatatttttaaatagggttaggttaccttaaaattaatgatacaggatagcagtgtgttgaaaattagaccctggagagagggatggtgcctgtactcagatgctaggttggtcacatactagctgtgtggccttattcagttacatagattctctgtgccttagtgtcttcatttgtaaaagggggataaaaattaaatctgctgcctttggttgttgtgaatcttactgtttcagacaattctgtttcaactattagctgttattaatcatgatgacaatactaacactattaacgaaagacagtttgtatatgtcatttcattttggttctttcaacaatgctgaaataagatatgttattctcattttttaggtaaaaatactaaagcccaggaagttttattaatttttgccaggtcattcagtccgtctgtgtctaaactaagctcaaatttaagattctccctcaaaagccttttttctcgtctgcaatagatagtctccctttatttactgacttttgttataatgaggatcctgggtgaaaactagtattatcagagatatcttatttttacagagcatttcagcagagtacatttcctacattcatagttggctgtacaggttattgaactttatgatatgatgcaggaactcaaagagcactttccatgacaaacttaatttcctcatatacttattctagtgatacagagagaaaggaagatgaaggaagggattctttcagggggaaataagtgtagtcaggatgttatagtgaacactttgatcctcaaagggtcagcatgagaaagaaagttgtgagaaggaatcaaatgttaggcagatatatgaggagggaaattttcaaagacactcagttccttcataaagtagtttagtcaaaataattgttattagaaggattagaagattaaatgactttaaaaaatgagttaatttatgtgcaagaatatgtctttttaccattatagagatttgaatatatatttaatcacatttattttttaaacccgactttatgaactaatatgaaaagatggacacattgttcttttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccattaagatctggctgttgttctgtttcatactgctgggaactcatgctagagatgctatagtccttacattttttaaagatacccttttacaatttgagctttgagaatccagaattttaggggtctttttcaggagtcttgttcttctcctaggctctgggcttaggaataaaacctctactgagctgggaacccagccactgagttatattcatttctttgccatggcctttggggagaccttatagtttggagagcctttgaaaagaagcaagatttgttgtattcactgtcaggagtgtgtctagtgtttttgtcaggaataagggatatactcaaagtaagagtatatatgaatgtgtggcaatatagccaggcacggtggctcatgcctgtaatcccagcactttaggaggctgaggtgggcggatcacgaggtcaggagattgagaccatcctggctaacatggtgaaacctcgtctctactaaaaatacaaaaaattagccaggcatggtggtgggcgcctgtagtcccagctactcgggaggctgaggcagaatggtgtgaacctgggaagcagagcttgcagtgagccaagatcacaccactgcactccaatctgggtgagagagtgagactccgtctccaaaaaaagaatgtgtggcaatactacattagtgcatataaatgtgtaggctgggtatggtggctcatgcctgtaatcccagcactttgggaggctgaggtgggtggattgcctgaggtcaggagtttgagatcagtatagccaacaaagtgaaaccccatctctactaaaaatacaaaaaaattaactgggtgtggtggcatgtgcctgtaatcccagctactcaagaggctgaggcaggggaattgcttgaaccaggaaggtagaggttgcagtgagccgagatggcgccactgcattccagcctgggtgacagagcaagactccatctcaaaaaaaaaaaaaaaaaaaggtgtgcaaattgttgcaggaaaagtcgtgtatttccatttctactatactatcagcattatatgaatattctattaacattttatgagatttctcagtatactaaatcatgccttttaacaattaaaaattttatttcacatgctgacatgacattttactgtgttaaaagtggtggcattcatgctccaataatagaaaacagggctccatggagtaatagctgatactaagcttgggccaggaaacatacaggttgagcctggagcatgttgtagtgccaggaagcattttctcattccatattcttaccaatatgtgttatcatatttgccaataggataggtgaaaaatatttgctattattattttaactagtatttcttcaattattaattaaacatttaaatatatttattggccactggcagttttcattttatgaaatgtctgcacaatattctgtacttattttcagcctatatgatttataaatgatctttattgaagaaggacactaattcttgtcttgtacattgcaaatatttttggcagttttctattattttaaatttgtttatgataatgttaaccatagaaactttttatttagccaaatttaccactcttcttactttttggatttttttgtatttttataagaaaacgattctcatttgagattattgaaatgagcacccaaattttcttctagtacttttatagttttatattttatatttatatctctaatttatctggaatttattattgcatatttggtgtgagcttgcaatctaatgattcttttttcctatggctaataaatggttcatttttcaacaatccaagtagattttagaaaatctacaacctacacagaccaaaaatattcttgatatttgtattatgtattatcactgctaactagtttttataatgatgatgttttaattcttatttttgcttctctggctagaaggtagatactataaccttctcttctcctatactaccatcatctctttaaaacctcattaactgttcttaaaagggtgaactgttctctaaaagcataaatctggtgtgtgtgtgtgtgtgtgtgtgtgtgtgtgtatgtttatatttaaaaggatgaactttttcaaaagattattctgatacatacacacacacacacacacacacacacacacacacacacacacacacagggctacactctataggatcctttatttgatattttgctccatgaataaataaccaaagtttttttcttatgtgaatggagttaactattaaatttcaaattatttttctttccttttaagattataggtttatttcgccttttgcctaaaaacaaaactagtgaaaattaaagtataaaaataaatacagtttacattaatggacattccattcaaagtaaaaataatgataataatacatcaaaagctcacagcattgtctggcacctgtatgagaaaaagttgtgaacataaaataatatgcaaaatacataggcttttacttttaaattatatcacactcaagttgctcatccttaatctaaagctaactttaactttctccaaaacatactatttgttttagataatttgcattagtatacccaaaacttttagcatctttcttactggacagacgcacagtgatatgagtaagctgaatccttagttttttgtttatcacatttagaagataatttcatatactttgcctgtaaatttaaaaattagtaactgggatttttttgactggcttctaatttgatacaccttgcctgtaaattttaaaatggtaacttggactgttttgactggcttctaattttctggttcactcattctatatgcaatacatctcaataagaaagtcgagtttacatgcagggtaaattatcattttctgtctataggtggatgtgaaagttaaattttaggtggaacagaaaaatcagagaaaatgatctttatctacatattctcatcctgaaagcaaagacagcaaggaccaagttgctattcttcagaaagagttgatatattaaattataaggatattttccatcatatctcaagtctggttgtcaaaactgagcatcttatctgctttataatgactttttaagaaagattgtttttctggaaagtggctatcagtaaaatattcagtgtagatttaattttctttgatggatatataattaatctaaaaattagtacattgtatttcctaattgtgatattgagggaaatagtactaaatagagaatctagccctggtctcttatgtagttaaacacatcatcaacagctaatatagaagatggcagagtagagggttttctagagtgcctcaccaactctgaagaagcaaaatagtgtgtagaattcacaatgtgaaactttatccaagaaggcacacaggaattcaacataaagtgaataagaactttagatattggggaagagaaggtaagtgggcagcctgtgtggtggtgtctgactgagagctgtgagtgaagtcccaatataggagagggagaaaaagtactcctctgcaatccacatttccactggggagccgtacaatccaggctgtgagagaataccttgcccttcccaagccctgaatctaaattggagagaggctaaaacactatgagaagggacatcactaggaagcaccccaagcattttccagtacttgggacctgatagaaaaatgtgattctcaatcctagctcatacaaagccaggtgggattctgtgatctagcagcagtggcagacttgggcattaaaggagcttggacaggggattgtaatgctgggtttggggcaacagaggggctcccacagccaaaactgagagatgagtgtggcatttgctccagctgtgggcattttaatagggctctctcccttcgtgggtggagcagaaggagatttgccagagaggcatggttttgtcccggtttcaagttatacagctcagtgtgactttgcagactaaaggtatactgcacatgactttactgagtgtctcaacttgctccctttattgggttggggagtgaaccctgccaggtctaaagaatgagaggagaaggctgggcatggtggctcatgcctgtaatcccagcactttgggaggctgaggtgggcaggtcacgaggtcagtagtttgagaccagcctggccaacatagtgaagccctgtctctactaaaaatacaaaaaaattagctgagcatggtggcaggctcctgtaatcccagctactcaggaggctaaggcaggagaattgcttgaacctgggaggcaggggttgcagtgagccaagatcacaacactgtatgccagcctgggtgacagtgtgagactccatctcaaaaaaaaaaaaaaagagtaaggagagaggtgggtcctatattcgtttgcctagattaaggactgggctgcctctgccttcctgtgccaacttgatacagcaataattgctctgtctcaggaataattgcttctccctcaggaatatctccaaggtgcctgcccgttgctcctgaattcccaccagagatggtgcttttacacaccattgcagggcctgagtgcagaatttccctgttgccctttccagttccacccaacttgacccccaccaccttcccacaatgctggaccacaggacccagatcattaagttgctccctggcctagctaattgcctgggacaatggattacttttctgattgaaaaagatcaagtataaaccctattgctatcaccacagagagatcttacctgcaagcaagaactattggcctgaagttcggcctacacaatccaatacaaaatttactggcagaagtgcatagcatttggaaacaagataagtttcacataacatttgctaccaccatcttccatgacacctcagcttctcaggaggacatgagtctgctcacccacctggtacaccactactacaaccaacatttgagaaagctaccaccctaaggctatttataaccaaggaaattccacagattctttgccgttgaacacacctagaagcaaagccaaatggctctactcagtatacatcatagacacattctcaagaaaaaaataaaagtcctgcccccaagaaaataaattcaaaaataagaagtgactgtttctccaaatgcaaataaattagtgtaataacataggaatatgaaaaagtaatgtgtaatgatacacataaagaaacacagtaattctctagcgacatgtcctaactaaaaagaaatactcaatattccagataaagagttcaaaatattgatttttaaagaagatcaatgagttgcaagagaaatctgaaaaccaatacaaagaaatcggagaatcaattcaggatataaatgagaaatttaccaaggagacagatatcttaaaaacaaacacacagaacttctggaaatgaaaagttcattgaaaggattacaaaatacaatggaaagtttcaacaatagatgagaccaaaaagaaaagagcattttggaacgtgaagacaggtcttttgaattaatcgagtcagacaaaagtgaaaaagaagaaaaagaaatgaagaaggcctttgagaagtacaggattacttctcaggttagcaagcttttctaacctgtggcccatgggctgcatgcggcccaggacagctttgaatgtggcccaacacaaattcgtaaactttctgaaaacattatgagattttttttcaattttttaaaactcatcagctattgttattgttaatgtattttatttatagctcctgacaattattcttcttccaatgtggcccagggaagccaaaagattggacacctctgacataaagtgactgaacttacatatcattggtattcacaagagagaagaaaaagcaaaaagtttagaaaacctatttaaggaagtaattgatgaaaacttcactaggctagcaatatatttagaaatctagatacaagaggaccaacaaacaccagaaaatatgcagcaagatggacttccaaactacatatactcattggaatgtctaaagtcaacacaaaggaaaaaaattctaaaatcagcaagagaaaagcatctagacacctataaaggaaactctatcagaccaagagcaactttccagcagaaaccttataaatcaaaaaagattggatcctattttcaaagtgcttaaagaaaaaactgccaaccccaaattttatatcttgccagaataagcttcataaatgaaaaagaaatagtttttctcagacaagcaaacactgaggaatttatcaccagctctactagaaatgctcaaatgagttctaaacatgggaaagaaaggttgatatttgccatcattaaaacacattaaaggataagattatcaggttttataacacaattacccaaaggaagaagagaaagaaatcaaatggtagcataacaggactccaccaaaccagaaagacaaacggaggggaaaaaaaagaatctacaaaacaactagataacaattaatattttgacagtcagaaaacctcacatacaaataataaccttgaatgtaaatggattaaattctccacttaaaagatatagattggcagaattgatattaataaaaccccaaaaccaactacatgctgcttactggtaaaaaaaaaagatattccatgcaaacagagagcagaggcaagcaggagtagctatacttatatcagataacacatacattaaatcagaaactgtaaaaaaaaagaaaaagtcattatataatgataaagggattaattcaataagagtatatatcagtcctaaatatatatgcaccaaacaccagaggacacagattcataaaacaaatattactagacctaaagaaagagatagcaacacaataagtgcaggatttcaacaccctacggacacactataaagattatagagacagaaaaacaacaaagaaacactggacttcaatgaaactttagaccaaatggacctaacatacatttatagaacattttactcaacaacctcaaaatatacatttttctcatcagcgcatgcagcattctccaagatagaccatatgttaggccacaaaacaagtctcaacaaattaaaaaaaatagtaactttatcaagtgtcttctctaactatagtaaaatgaaactagaagttaataccaagcagaactcttgaaactatagaaatacatagcaatttaaaaacatgctgctaaatgatctttgagtcaatgataaaattaaattaataatttttttgaaatgaaggaatatgaaaacacaacatatcaaaacctttgggatacagcaaaagcagtgctcagaggcaagttgatagggttaaatggctgcattaaaagaagaaagatcacaaaataacaacctcacatcacatttgaaggaactagaaaatcaagatcaaaccaaatccaaaggtggcagaagaaaggacaaagatcagatcagaaccaaatgcaattgagaccaagttaaaaaataacagaagatcaacaaaatggaaaatttgttttttgaaaagataaacaaaattgataaaccactagctagattaaccaagaaaagaagtgagaagatccaaataaatgtaatcagaaatgaaaacgaagacattacaactgttaccacagaaataaaaaagatcaccggagacaaccatgaacaaccacatgttcatgaattagaaaatctagagtaaatggctaaattcctgggaacatacaaatttccaagattgaactaggaataaataaaaatcctaaacagaccaataatgagtaatgagattgaatcagtaataaaaaataatctcccaacaaataaaagcccaggagaagatagtttgaaattctggttgctgaattttaccagttgtacaaagaaaaactgaaacccatcctccagaaactctttcaaaaaattgaggtggtgggaatctttcataattcattctattaggccagtatctccctgataccaaagaccagagaggacagcactaaaatagaaaagtatagacaaatatcccgagtgaacaaagatacaaaaatcctcaacaaaataatagctaatcatatccaagagcactccaaaaagataatacaccatgatcaagtggttcccccactgccagggataccaggattgttcagcatttgcaaatcaataaatatggttcatcacacaaacaaaattaaggacaaaaccatatgataatcttaataaatgcagaaagaagcatttgataatttccagcatcatttcgctataaacaccctcacaaactagtcatagaaggaacatatcttctataataataaagggcatatatgacaaatccatgaccaacatcgtactgatctgggaagagtttgaagcaatccctctaagaactagaacaagacaagaatgtgcactttggccaatcctattcaacttagaatggaagtcctagccagaacaatcagacgagaaagaattaaaaggcatccatgttggaaaaaaggaagtcaaattgtttctattcattgatgatcttatacttgattagaaaattctaaagattcctccaaaaactcttagaattgataaatgtatttagtaaagttttattatacaaaatcaatttacaaaaatctgtagcatttctctgcaccagtaatggttgagctaaaaatgaaatcaagaatgtaatctcatttacaatagctacagaagaaaaaatagttagtaatatatttaaccaaggagatgaaatatccctacaagggaaattacaaaatactgatgaaagaaattgtggatgacacaaacaaatggaaaaacatcccatgctcatggagtggaaaaattaatggtattaaaatgaccatatacccaaagcaatctacaggtttaatacaattcctatcaaaataccaatgtcattataaagaattataaagtataatcttaaaatttatatggaatcataaaagagcccaaatagctaaataaattctaagcaaaaagaataaaactggaggtactgcattacctaacctcacattttaccacaaggctatggcaacccaaacagcattgggaaaggacactcttcttttttcctttttctttgtcttttttttttttttttttttttgagacattgtctcgttcttgtcaccccggctagagtgcaatggccctattttggctcactgcaacctctgcttcccaggttcaagtgattctcctgccctagcctcctgagtagctgggattacaggcacccgccatgaccggttaatttttttgtatttttagtacagacaggatttcaccatgttggtcaggctggtctcgaactcctgacctcaggtgatccacctgcctcggcctcccaaagtgctgggattacagacatgagccacctcacccagccaggacactgttttcaataaatggtgctgggaaaattggatagccggatgcagaaggataaaactagactcctatctctcagcatatagaaaaatcaactcaagttggattaaagtcttaaatataagacctgatactattaaaatactagaaaaagacctaggaaaaatacttctggacattgatttacgcaaggaatttatgactaagacctcaatagcacaagtaataaaaacaaaaatagataagtgggacttaattaaactaaatagcttctgcccagcaaaggaaataattaacagagttaacagacaacttgcagaataggagaaagtatttgcaaactatgcatctgataggggactgatatccagaatttatagggaactcaaacaacaatcaaaagaaaaccattaaaaagtaggcaaataaatagatatttttcaaaagaagatatataaatggctaacaagcatagaaaagatgctcaacattactaatcatcagggaactgcaaattaaaaccacaatgatatgtcatctgacgtaagtcagaatatggccagttataaaatggaaaaaatataatagactttgtgaggatgcagagaatagtgaagaaacatttagacactgtttatgggaatgtaaattaatacaaccactatgaaaagctgtatggagacatctcaaagaactagaaatagaactaccattcaatccagcaatcccactactaggtatctacccaaaagaaaagaaattatcatataaaaaagacacctacacttgtatggttattgcagcactattcataataggacagatatgtaatcaacctaagtgtccatcagtgatgaataaataaagaaaataatgtacatattttctttatccaatggaatgctatggaatactattcagccataaagaatgaaattgtgtctcttgtagcaacatggatatgtaatactgtatacttatgataccatatcattaaaaggatatgatgtcattgtcttaagtgaattgcaggtcattatcttaggtgaaacaatgcagaaacagaaagtcaaatgctgtatggtctcacttataagtgagtgctaaaaaatgtatgcacacgtacatagtgtggaataatagacattggagcctgggaaaggtgggtgagtggaagcaggggtgagggacaagaaattacttaatgggtacaatgtacattattcaattactggttacgctgaaaggcccgacttcacctttacatgatatatccatgtaacaaaactgcacgtgtaactctttaatttatacaaataagaagagaaaatattgtaatcctgttagaaaaaaatgtaagaagttaatatttaaaaagcaaagggataaaagaatttaaagataccaattattctctttagttattgaacatttttcatccatatggagctcaatataatttagtttaatatttattaaatctaaaatgactgataaaagacacattgttcaggacagaaaacaatctgaactcactttactatagcaaattatcagttttaatgtgttccattaaataacgtagacataaaatatgtattaagggtcaacgttaatcatcttaatatatatgccaaggctgtctttataatcccggtactacttgctatctatataattttggacagttaacttaagcctggtctttggaactagttcatgtttcatttagttacaccatattccccagatattccttttattcttcatattacttagatgtcttttaattcctatatactcattaacttagatgactgagaactacactaagtaatgctcaaatttctagtcagatgtagccaaaagtacattgggcttgcagtcagaagccctgagtttcagtccaagctgttatttattaggtgtttaatgttaaatcatttaatcacatttttctacagcttcttcatccgtggtgtgtaggatgtaagtaggaataaattgggcaattaaaaacaatttctagcggttttcacatttaagagtgaggagaaatatgtgtggctaacggattgggtagagtgggatgatgcaaaagattagtcttgttttcctctgaaagcagttaaatttatttgttccccatatggcaagcaatggggatttgggggcagttagaaaaatgtgtaatactgtagacttatgatagcatgtcattatatctacacaattaacacaaataaaacttctgttaatataattgtatcattggattattttactcttatcattccattaaatttgtttcaatgtattgtccagtcaagtagctcatgagtttatttgagggttggaaatactgattttattgtattatattttatacttcatattacccacaccttataattgtatatatttaataaatcttgagaaattaaattatatgaattcactttctttaaaaatatgtagcttattaatagcaaatctttatcttaaataatgtttctttccaaataccatttaatttattttcaaataattctaaatttcttctcttttatgggaacatttgcattgggtgtcactagtggcactcctgtaataaatcttttagatatttttaatttccagtgttttaattctcagtatatgacatgtaatactacgcaaaaatgataaactcttttttttttttctttgagatggagtctcgctctgtcacccaggctggagtgcagtggcatgatctcggttcactgcaagctccgcctcctgggttcacgccattctcctgcctcagcctcccaagtagctgggattacaggcacccaccaccgcgcccggctaatgttttgtatttttagcagagacagggtttcaccgtggtctcgatttcctgacctcgtgatctgcccgtctcagccttccaaagtgctggcattacaggcatgagccactgtgcctggccaaaaatgagaaactcttagtctttaagcattgttatgaaaggtaagagatttagaatcacattgcccatgccttatctcttactaactttgggaccctgggaaaattaatttatctgaccttcaaggctcttatttataaaatcagcattataatatcccatttttgaaaataacttttaacgggttaaataatgaaacggcttcaaagcatttagtcaggtgcttagcacatggtaaacctttatgttgttactactaataaaatcctcctgcattttaaagtagtttcctaaaaaaatcttttgcctctaaattttgtaagctttttgttctcacttatttcaacacaaattcagccattataggggtgacttcaatgccctcacaaatgattcattaatacctcagtcttacagatgtttgacttattctgctacagtgacctttactttttaccccaatcccacaatcattcctcaatattatacttttttaaaaacatactcagagaaacatggatgtttgagctaaaaacaaaatgcaataaacttaatttactttggtatcaaagtgctctccctgcgtatttatattattcttcctgctctttctttcaatgagtaagcagaaagtataggtagttttcattagttaatacagtaaatagctctgtcgctcttaaactaggttcttttggttgcaagtggcagaaacccatctcaaaccaagtcaaaactcatttcagagtagcttagttttagctaaaagatggaaaattattgattaatgttacagagaggcccagtgctggttttggatttagggatggttgcatctgagaggttcaggcagtgttgcttactttgtctctctttagctctttatgtctccttttctgtctttgcctttcaatctaccttaacgttttggcttttttgcctgttatcttttatttttagacaagtactagaaggaagactcctggctatcttagccctatatttatagataccagaaaaagtggtaacctattattaatagctctgccaaatagtctagtaaaaactttgattggctctgcttaggtcatgtgccaatttttgaaatagacaacaatggccaggagtggggagtattctgataggccatgcctggttcatgtgttcaattcaaggcgtgaggatgtgagatttatttaaacctgtgatggcaagctagggcccactgcttatttttatataacaagttttatttgaacatagatatagccatttatttacatattgcctatggctgctttcacactaaaatggttacagtactgacaatgttacccacaaagcttaaaatatttgctgtctggttctttacagaagatgtttactactgttctaggtagagttcaaagatgatccccaataactcacgtccttatactgtgagcaaaaccttccccttgattgtgggcaaaacctgtaagtatgacgagatggtactcctgggattatgttactttatatgtaaaaggggatttttacagatgtaattagtacccccaatcaactgagttaatgaaaagaggctatcttgcataggtctaacctaatcagatgcatttttaaaaagagagtgtagaaattagaaatggaggcagtcagagagactgtctcctaatggcctgtaagaaggtaaacatttatattgttaactttctgtggcgccatgtgacaagggactgtgggtaactacagggagctgattgttccctggatgatagctggcaagaaaactggaacctcagtcatcacagctgcaagaaaattaatttggctaaccttggatgaagactcggagactcagatgagaattgcaacctggttaacaccttgatttcagcctggggagatcatgaatagagaatccagtcaattcctactcacactcctgacccatggtaactgtgagatgataaatttgtgttattttaaaccaataattttgtgataatttgttactcagtaacataaaattgacatagactgttgtacctgaagttggaatgcttctgtaaatatcttaaaaaggggagcggctttggaaccaggcagtctgtggaggctttggatttttaagaagtatgataaagaatatctaaattgccttaaacagaccattagtagagataaggatgttgagaatactcatggtcaggacttagaaagaagtaaggaaattgttatttaaaactggaagaaggggaactatcattatgttgtggcagaaagcttaatggaattatgtcctgcagttaagtggaaagcagaacttgtaaatgatgaacctggatgaaaggaaatttctaagtatactgttcaaggtgtggtctgttttcttcttcctgcttatggtaaaaatgaaagaggagtaagataattaagggaagaactgttcaacaaaaaggaatgaagtctgcatggttttgaaaatcctaagcctctccagatgatgaaagatgctaaaagttagaaatggctatgaaaattatgacattggttaaagaaattgtagataaactcagaattaataagtgaatttagcaaagttactggatactaaataaataaacaaaatccaattatacacttagatttatgccacagaaattaggaaacttgaaaaacaaaatgccatttacaattacaaaaaactctatgataatttatctaataaaaagtatacaatacctctttagaaaagtgtatacatttttgtttagaggacataaaattttataaataaatggagaaatccaccataatcaggagttggaaactctgatactgcgtagctgtcaattttgctaggctaatccatatatctatataatctgaactgaaattcctgcagttttgtgtgtgtgtgtgttgttagcaagcttgccctacaatttaattccatgggccatgaataagcaatatcaactcaaagaagcacaagttgggaggcattttctctatccgatatcacttattttaagaccagaataatacaggaaaatagacaatgtaggctgggtgcagtggctcatgcctgtaatcccagcactttgggaggctgaggcaggcagatcacgaggtcaggagattgagaccatcctggctaacacagtgaaacctagtctctactaaaaaaaaaatacaaaaaatttagctgggcgtggcggcgggcgcctgtagtcccagctactctggaggctgaggcaggagaatggtgtgaacccaggaggctgaacttgcagtgagccaagattgcgccactgtgctccagcttgggtgacagagcgagactccatctcaaaacaacaacaacaacaacaacaacaacaaatagtcaatgtaacagaataagaagatgagaaagagatccatgcatacatggtttattcatgagaagtgtggtactactgagtagtgataaaataacagtacttttaataaatgatttaaataaatatgcaatcatttggttatatgtaaaaaatgaaactttatccttaccttacaccatatacaaagaataattacaggtttattgcatatctaaacatgaaaggtatattaatatattcttgaataagaaaggatttcctaagcagataatcaaaagcattaaccaaagagcaaaggtaaatgaattaggttgcattataacttagaaattaattccatcaaatgacacaactaagagaaggaaaagttaagccccagcataggagaagctatttgcaacacatctaactggagctaaatttttatagaattttcatgtattataggtggatgaataaattggcataattagtttggaaaactgccttacctactaaatttggaaatatgcatacattataatacagcaattccacttctggatacctgcatacaagaaatatgggcccatgagtagcaaaaataaaacaaaactaagccatacatataagcacattcaacataagcaactttatttgaaatagatacacattggtaacaccccagatgtcctatcagtggtagaataatctattaatttacaatgatatgttatccatctatgaaaatgtagaaagcactgtaatatggagcaaaatgaatgtcttctatacgcatagtatggaatgaaggcagctagaaacaacatatctacatatgcagatctatatatttcaaaaatggaaaacaaaatctatggtttcgtatttaggattcccaaagacaagaggtaaaggggtagtgacaaaatggaatcaggagttggacttacaaagtatcagtaatgttctattttttgacctgggtggtaattaaacagatgtatttatttttgtaaaaatgaattgagctgcacacatagatttgtgcacttttttctgtttgttagaattcaataaaatgttgaatttacaaagcaaaagacattgggaagaaataaaattacttttgtttgaagacgacatgattacttatgtagaagatccaaaataatttgccaaaaacctcctggaattagtaagccattatagcaagttacagtacaaagttaatatacaaaagtcaaccactttcctatattccagcagtgaacaagtggaatttgaaattaaaaacacggccggggtggtggctctcatctgtaatcccagcactttgggaggctgagacaggtggatcacttcaagtcaagagctcaagaccagcctggccaacatggcaaaaccccatctctactaaaaatatttttaaaaagttagccgtagtggcacatgcctataatcccagctactcgggaggttgaggcaggagaatctcttgaacctgggaggcggatgttgcagtgagccgagatcgccccactgcactccagcttgggcgacaaagtgagactccgtctcaaaaaacaaacaaaccgaaaccactatatcatttagattggcacccccaaacatgaaatacttaggtctaaatctaataaaatatgcaccagatctgtatgagaaactctgatgaaagaaatcaaagaactaaataaatggagatttatttcgtgttcataattagcaagactcaatattgtcaagatgttagttctttccaacttgaccagtagattgattgcattgccaatcaaaatcccagcaagttattttgtggatatcaacaaactgattataaagtttatatgggtattcaaaagacagaacagccaacacagtatgaaggagaacaaagttgcaagactgtgacactacctgacttcaagacttactataaaattacagtaattaagacagtgtggtactggcaaaagaatagacaaatagatcactggaacagaatagagtggccaacaaatacagccacacaaatatagtcaattgatatttgacaaaggagaaaaagcaatagaaagtagaaaagatagtattttcaagaaaggctgctggaacaattggacactcgtaaaaaaataaatctagacacaaggcttatatctttataaaaatgagctcaaaatggatcacagacttaaatgaaattactaaactatgaaactcctagaatataacagaaaatctagattaccttggatttggtggatatagcaccaaagacaggatccatgaacgaaagaatcgataattaattttaattgattaaaattaaaatattcttctctgccaaagacattgtcaaaagaatgaaaagataagccaaagactgagataaaacatttgcaggagacatatctgataaaggaccattatacaaaaatatacaaatgacttcagaagttgtatatatttaaggtgtaaaacatactgttttgatatatattatgcatagtaaaatgattactacagtaaagaattttaatctgtccagcaccttccatagttacctttatattttgtggtgagagtacctaatatctactttcttagcaaatttttagtatgcaatattattgattatagtccttatgatttacattagatctgtagattaattcatcctatatgtttgagccctttgacctacttctgtccattttctttccctccttgtcactagtaaccaccattgtattctctgtttctgttttcaacttttctttagattctacatataagtgatatcatacttatgtatgatgttgtaattctgtgtctggcttatttcagttagtgtagtgtccttcaaattcatccatgttgtcataaatgactgatctttttttagggctgaataatattccattgtatatgtattccacaatttctttattcattaatctgtcagtagacacctatgttgtttccatatctttgttattgtgaataatgctgaaatgaatatgggagcacagatatctttatgaggtgctgatttcattacctttgggcatatacccagcagaaggattgctgggtcatatggtttgttctacttcacttgttttagtttatttatttttagataatagctatcatgagaagtgtgaagcaatgtctcagtgctttaggtgggagcatgaaagttgtggtgcttgatgcatgcacaagtgtttccagggagattttgcagacctggatttaccactggagcaagctggaggagaggtgtgggaagtactctcactccaattcaggctcctgtaggtcgattgtttatctgcctttttctattaggctatttaaaagcctaatagaaaaagtgtgcagatttccaaggagaaactgggaactggacacttcagcctattctctgcactgattgttggaggaggagtgtgaatagatccccctggaagtacacgtgcatccatttaaaatcacctctttgttctgtagcctagggagacacaaacgctgaatcattttctgttttcagagtcaggtgaattaagggctcaactctgtgggaggaactgtaaaccttggggctctgtaagtgtatttcacaaccttttcttgtcaaagagaagttgagagttagaggttctctcctgattataaaaaactggtcctggggtggagtttgtggcatatgtgtgtctcagcttttccttccttttttgatgcagatattttatcagtttcccagtttttaggggtttatcaactagttttgagatttgtcctagagggaattgacctataaataactgtttacttagtacatccataagaggagggaaagtcaagaatttcctattctgccatcttgctgatatttcaagaacatctttctgaagttcttaaaatacaacaataagaaaacaaacttttatattttgatagggattgcattaaattttgggtagtatgggcattttaacaatgttgattcatctaatccatggacatgagatatctttccattttttgttccctcttttatttctttcatcaatatgttagagtttttattgtagcaattttttaaaaaatagagaatatttttcataggaaaagaaaaaaaattctaaaatttatatgaaaccacaaaatacccagaatagacagaataatgctgatcaaaaagaacaaagctgtagtcatcatactacctggcttcaaaatatactacaacactatagtaacccaaacagtatggtactggcataaaaatagacatatagactaatattagaaacaaaagacaaaattcagaaataaatccactcatttacagtcaactcctttttgataaaggcaccaagaacatatattggagaagggaaatccttgtcaataaatgatgctgggaaaactgaatatccatatgcagaagaatgaaaccggacccctgtctctcaccatatataaaaatcaaattaaggacaggcacagtaatatcactaaaacacaggtgaccaaagcaaaaatggacaaatggaatcacaccaaactaaaaatcttctgcgcaacaatgagaacaaccaaacaaaatgaagagacaacctacagaacggaagaaaatacttgcaaacgattcaactgacaagagattaataaccagagtatataaggaattcaaaaagttcaatagaaaaaacctcaagtaatctgattagaaaatggacaaagatcaaaagaagacatatcaatgaccaacagatatagctgggcgtggcggctcatgcctgtgatcccagcactttgggatgctgaggcaagtggatcacctgaggtcaggagatcgagaccagcctggccaacatggtgaaactctctctactaaaaatacaaaaaaattagctgggcgtagtggtgggctcctgtaatcccagctactttggaggctgaggcaggagggagaatagcttgaacccgagaggtggaggttgcggtgagccaaaaacatgccattgcactccagcctgggcgacaagagtgaaactccgtctcaaaaaaaatgaccaacagatatgtgaaaaaatgctcaacatcactaatcatcagatgaatgcaaatctaaactacaataagataccatctcacctcagctaaaatggcttttatattatcaaaaagacaaaaataagtgctggcaaggaggcagagaaactggaatgcttgtacactgttggtggaatgtaaattaacacagctactatgtgaaacagtatagaggttcctcaaaaaaccctgagggaccagagaaccaagctgcagacctggttccagccccttagggttagaacacacagcccaggagtgctcagctgaggcttggaccgctgaaaccatccagaaatgaagccaatcaactaaatccaacttacaacatagtcaaaccctaaagagcatcaaagaatataaaagcagaaaggccgattccaaagacagagactccaaaggttaaaggaacatcagcccacacagatacataagaaacagtgcaagaactctggcaactcttaaagccagagtatattcttaccttgaaataactgcactagctcctcagcgatggttcataaccagactgaaatggctgaaatgacagacattggttcagaatctggttggcaaggaagctcatcaagataaagaagaaggttgaaacccaatccaagcaaaatagtaaaatgattgaagagtttaaagatggcatagccattttaagaaagagccaaactgaacttcaggaaatgaaaaagtcactacaggaattttggaatgcagttcaagcattaataacagaatagacaaagctgagaaagaatctcagagctctaatacggctcctttgaataaacataggcagacaaaataaagtaaaaagaattttaaaaatgaacaataggttttatttaataattctcctccttatactttctgtctcaccagtttcccctcaaactgatttacctactacacaaaattattcttatcgggcttatgtgccttttcctccacttatttgacctctcacctggatggatgctcctgcggaaatctatactaacgatagtgtgtggatgcctggagctacagatgactgttgccccgctcaaccaggagaggaaggcactgcatttaatgttactatgggttataaataccctctgtgcctcagacatgcacctggttgtatccatctagaaactcaagtctgggctgcttgccttccagagagatcagccacaggggaatggggacatttggtctccggcctctccctttctcctttaagacaaatgaaagggggagtaatgagagataccccatactttcaatataaacctgtaggaaaatcatgtcctaaaaattttgagggcccatctaaaactttaatttgggaagattgtgttaactcacatgtagtagtattaaaaaatgcctcatatggtttagtaatagactgggcaccaaagggctattttaaaaaacaattgctcctctggtggaagggaatgcctggaggctacttattttatttctcattgggaggacaaggatcatcatcctactttgcataggaggttcagctcattttttcccttaaaatgggaagataagggcattacccccacaaggcctcatatgatattccccattctgagcccagaacacccagaacttcggaaactggctatcgccatgtccagactgcaagtatgggaaggggaaacttttctgtctgttatccccagtactgcccctcacatccatgattctgaaccccatgataaatcccctttgagcccttttcctctttttgatgcctatcctcctttatgggactccaattggcattatgataattcttctcaatccaggtatgccccctacctcttcagcatccctaggcccctcggattgcttctttatggtggagaacatcgggcgttcccaccgccactcctctccctcagtatcaatgtagattcaaacattctgctttgtttacctccagcctgactattcctatacagagttgtgttaagcctcctttgtgctgttagtaggaaatagcaaactttggacgaataatcaaactgtccaatgcattaattgccatttatacacttgtgttaactcctgttttgcttcaggaaaagtataatgttggttcgagctcaagaaggaatctggataccagtaactttacccagaccttgggaatcttccccctcagtacatttaattaatgaagtgttaaaacaaattctcaaaagatctaagagatttgttgttactttaattgctgtgatcatgggcctaattacagtcacggcactggccaccactgccggagtggcattacaccaatctgttcaaatggcttattttgttaatgattgccaggccaattccacccaaatgtggaattctcaacagggaatttatcaaaaattagctaatcaaattaatgatttaagacagtctgttatttggcttggagatcggctaatgagtctcgaacatcgcatgcaaatgcagtgcaattggaatacttctgatttctctatcacaccatattcctacaacgagactaatcattcatgagaaatggtcaaaggacacttgctgggaagggaagataatttatccttggagataactaaattaaagaaacaaatttttgaagcctctcaagctcatttatccattgtgcctggagctgatgcattagatcaggtggaagaaagtctttctggactaaaccccacgatttggattaagtctattgggggccccactgtagtaaattttggaatcatgtttctctgtttaatcagcttgtttttagtgtgccgtaccagttaaagaatcctgcatcaaaactgagagaatgaacaagccttcatccccatggcatatttatataaaaagaaagggagaaatgttgcaggaagtcagggacccaaatggagggacgggctggagccatggcagaggaacataaattgtgaagatttcattttaatatggacatttatcagttcccaaataatacctttataatttcttatgcatgcctttaatttttaatcatgttatcttcataagctgaggatgtacatcacctcaggaccactgtaataattatgttaactgtacaaattgattgtaaaacatgtgagtttgaacaatatgaaatcagtgcaccttgaaaaagaacagaataacagagatttttatggaacaagggaagacaaccataaggtctgactgccagtggggtcgggcaaaaagggccatatttttcttcttgcagagagcctataaacagttgtgcaagtaggagagatatcatcaaattcttttcctagcaaggaataataatattaataccctgggaaacgaatgtgttcctggggggaggtctataaatggccgctctgggaatgtgtgtcttgtgcagttgagataaggactgaaatactccctggtctcctgcagaaccctcaggcttactagggtggggaaaaactctgccctggtaaatttgtggtcagaccggttctctgctcttgaaccctgttttctgttgtttaagatgtttatcaagacaatacatgcaccactgaatatagacccttatcaatggctctgctttttccctttgtcctgttccctcagaagcatgtgatctttgttagacccttattggtagttctgctttttgctctttgaagcatgtgatctttgtacctaccctctgttcttacaccccctccccttttgaaacccttaataaaaacttgctggtctgagactcaggcaggcatcatggtcctaccgatatgtgatgtcacccctcgcggcccagatgtaaaattcctctctttatactgtctctctttatttctcagctggctgacacttatggaaaatagaaagaacctaccttgaaatatcaggggtgagttcccccaatagataggagggtgaagattgaaaaactacctattaggtactaggtgcaatatctaggtaatgacatcatttgtacaccaaaccttagcaatgcacagtttactcatgggagatacctgcacatacaccctgtgaacctaaaataaggttgaaaaataaaaataaaatagataaaataaaatgtaaattaaaataaaatttgaatacagttttatttttagtagaatttctacatgtagtttccagagttaataatttataatgaatgtctacccatgtgattattttattttccaccaacatatatttttaaatatattctcttttatagccctttccatacttagtctttttatgattaaaaagaaactgtcaggccagacatggtggctcacacctgtaatcccagcactttggtaggccaaggcaggtggatcaccaggggtcaggagtttgagaccagcctgggcaacatggtgaaacactgtctgtactaaaaatacaaaattaggcaggcatggtggtgcatgcctgtaatcccagctacttggaaggctgaggcaggagaattgcttgaagctgggaggcagaggttgcagtgagccaagattgtgccactgcactccagcctgggcgacagagccagactctgtctcaaaacaacaaaaacgaaaaaaagaacaagaaaagaaactgtttattgacatttgcttctgttactcaattctagttgtaatcaatgcctaagctttgattatatcttcgtttaacttggctatattgcgtatcatttattttgggagacagtagcctcctatcttagctctttaggtgtgcacatattcatctttacatataaagggatttgagatatttctgtgatttcataaagtttttatgaagttatcttctttaaatttacttttactttacactaattgaatgtgcattattttggctgatctattttttggaagtataataaattgctttatgtatacttcagtggctttagattttttatttatgatttttagcattatgtgtttgccttagagtttatgtgcacaaaactattatatatttgttcacattaaatacaatttatgtatgttttaatcaatattcacctgcatgtagcttgctctgaaagaactagaatgctttcattttccatacatataatttttttctatatctctggagaataatgttctgcatatttttgaaatatataggtaggactatgctttgtgaaagagtctattaaagtttaccacatttgatgagttttgttttggaattaattaaaacctgaagcaaaattgatctgacatataattatgtgtataattattatggttactgtgtcatatagtaattaggcataatatgaattttatttggttttactgcttttatgtaacatatccatcattgttttagtcagctgggaaagaactataggtaaacaattatccacattgtgaagcactttcatgagtattatctcattatgtatataaataggttatgatatttatttcatttcaggatagtaaaggggcatttcaaaaacaaaaaacaacatttttttaaatgagaaaaagatcctttaattccaatagggttagaaacaagtacgttatcctcttttcctaggtaatttatcccatgcccacaggttcagttaccatctctatattaattctcaaatattcagaacagatctttcttttgaaatccaggtatgttcagccaacttcttaattgaacctccaccttggatgtctcaaaggcatctcagattcaacatattcatacatgaactcatagtatctcccatctctactaaaaggcctcattgcctggggtaaatgcccaggttttggtctcatggccaaggaaatcaaagactcagacgcacacacgcatagtgaaattggagcaaaagtttaataggcaaaagaaaagaacagctctctgtcacagagaggggtcccaaatgggttgctgagtggtagtaaaaatgtcagggtttatataaatgggctagtgaggagggtgtgtcttatctccgtggggcctgaagaactggttaggaccgggtgtgccgtatgttgagggcagagcctctagtagtccccaccccttgtgcaggccgactcttagtttgtgctgctctgcgctgcttatctgagcatgctaaaagggagggagagtttctgtgcctgttccaggcactttcttgcagctgcaggtgtccctgactcgccccataccccgacccccaccccatctcaccccactccctccctccactcccgcgcttccagctcagcttccctatctttgtgtgcttaaagaaagggagatgaatgtgcttattatggcacactgtttttactggggcctattgtttgtatgtgaagtttggtgattacccaggacacttccagctctgtgcccaagttgcttgtctgtgtttttcagcctgatcttccaggctgctctttgttagaagagaggtgatttctttgaactgcgtgaggttagaatgggagcaatttctgagctgctttttgttagaaagaaagttttctgccagggactctctttaccctaactacctaaatgatttctttctatctcctgtaacactaccttggtacgtatttcagtgattgtcatcatcacccatcctgttaggcaaaccagaaaactcaaagccatccttgttgctcctctacatccctcactctatatccaatttatcatcagattctttatttttcttttctcaactctctaatatattatatccatgctttgccatttctactgctggaactaaccctagtcaaatcacattcctcctttgttgggagtattacaataatattctctacaaggtatacccactcaggaaacagagtgatctaattaaaatataactatttttatgtcagatcttttagtgacttcccattgttgttgagatgaggacaataattattaacaaggtgaacagggactgggatgttctggcccctgccattgcttactgaatcttgcaacaaacccccttgtctctttttttcaggtgctgaaatgcatcatggcctctcctgaggctgggcctttgcatatgccctaacacaacttaaaatcacctgtctttgaaagatgggctattgtatcagctagactaataaaaattattctccacataatcatgtttcttattattaattaacaaacatgaaaaagataccatgtaaaatattagaattcagttttcttttgaagagatctttttgaattaacagcttttaaggctattagttcctatgcattcttcagatatcagttcaagcctcattttcttagggaagtttttcctctgttcactctaggccaggttatgttttattccctatctcatagaacctagactcttgtttccttttttcttagaacattgcctcagtttatggttcttgtattgtaataatacacttatcaatatcattcttgatcaatatttatttcttccatttcaagctctgagaggtctgatactctgtctctttttgtccattgttttttctctaacctctcatagtgtctggttcataatgataaataattttcaagtcaatgaatataaagtggtagtaagtgagagagctgggatttgaaatcagagctgactctaaaactactattctgcagtgacagtatatttttaacatgtgcattataacaataaattacactggatgttcagcacttgtcttggatatattcaaaagcaaaacatgagtcttagcttttccagtttaagcagtttaattatattttcataatttataacattaataaaatggggaattgtggtaaaagagattctgaggtgcatataaaaatgtttgcaggatgaaccacttaagtaagggagacccagtggacatctgccagtgggagctggctgtgaaaggcaacaaggtagaatgaagcccagtttctgtacttgagggacccaggcaccaggcagtgagtgtggcactgatggcccaccttggtctctcctggcccagcctcaaaatagagtagaaaaagggagtcgatgacaatgaattggttctatggaagaagacagcatatgaagggaaacttcattggaatcacataggtagatttttttatgttgttggctgttgtgtccaaaaacattgcagaggaaagattcaatattaaaaagcaaattggttcattgctgagagaatgtaaaatttattctcattctctttccatctattcctcttttcttcccttcctttatctattactctctttcttcctccccttctccatgactcgctataacctctgattcttcagtatgaaagtagtgtacatggacagaaatccctaatatacttgtttttaatagcaaacggggaacatgtaaccacaactctccagcgaaattgagatcatggccacataatctacagctttttctctcttctctatgtagattataatagttttatttaatagaaaacaaaaaaattatgtattaatttcaatttaaaaattttcttgatgttagcaaactatggatcatatcttaagaaagcagtgtatatttcttacccaaattctaacactaaaatattttaaaatattatttatttcctttggtttttaatccatatatttgtgtgttagtctataggataataacaagattatattttctctatatctctcttgccatttgtaactttgtgatttttacatatttaaaagacagttaataggattgaagttgaaactgtatttctattccagatgttgatgtcttcagaattgctttggaaattgtcagatttccaaattaatatcatagattgacttcttcatctctattcttaatcaaaattttccaagaagtaaagatatttggtcaccgggaagaaaattataatgcttagcagtgactttctaagcagcctgaggtgtcttattaaccagagtctgctcaggcctcaagatctgttgctgcccacatgtagggcagtttttctcataagcctaactaagggctgagctcttcttttacagtcattctataatgcacacccaaagctaaaaaaggagtggtcagtttacgttattgtcttattagaatgcatgaaattttgtaatacaagcacaaatgtatgtattctttccatctgttagacacacaccccttttagagttttaaactgtatctttttatattctatatcctatagttttgtttgattctgtgttataaacttccagagtcattctaaagatcttgaaataatctagagttcattctaatatagtggaaaaattattttaatgtcttatcttttgaaatacagatttcaaaactacctagttagcaaatgctggataatgaaatttgttcagagtttgactttttattcattttcttatcccactaacaagagcaccttgaagttctctcatcattaatgagatttcttaaaatatgtgattctgaagttttacctgaggaaaaagaaaaattcacatgtacttttgtgatggagtagcttaacttcaaaattcattttgaaacaatttttcctttcttggttttagccttgaaacatactttacaactctgtttacctccctccccaccaaacatccccttgtactggtagcttatctagttatatccttacttagaagttccaggggctaatcttgaaacaagccaggcatggacacccgaaattccagagattacctcaaggcggtttgtcaacaatctggctattgttgagatgatgtcagcctatgctccaggtcagcagtccccagacttttcggcaccagggactggtttcatggaagacaattttttcatggatgagggcaggggtttagtttggggccaaaactgttccacctcagatcatcaggcattagaatcttataaggagcttgcaacctagatccctcacatgcacagttcacaatagggtttgcgctcctgtgataatataatgcccctgctaatttgacaggagtcaaagctcaagtggtaatgctcccctgcccatggctcacctcctgttgtgtggcctggttccagtctgccactggagggttggcgacccctgctccaggtggaccatgactcaagatagtcaccagaacaggacacacagaccttgtatccagcaccactcctgcatgccttccattccaggttgcccttttaaaacccttctccccagtctaaagttttgaatggttttttaagggaataagcttgtccattccccaactgctagaatttgagtgaagttgcctgcctttcgccacaccttgcctctcatgttttctggctctcagcagtgagcagccagacttggcgtgtggttacacttttgtgcgtaaggtattttaaaatgttctatattatgttattatttatcatattgttattaagttttttcatgtctcccattgctagctgtgcttttagaagaatttgtatgctgtaattacatactttcttaattatgcttttcttgcatattcaaatgctcccaaaagtctttatctttcacttcatttttgatttacaaactgaggaatgcaaatacttccttgtatgtactttaatcccaaactctattaagaaaggcttattcagtgtgtgtggctagggaaacagtttcaatggctaacaagtgaatatagcagaaggaagaagcatatgtatgtctgacataattttttgatgttttgaaaagttatcattcccttggttgtttccccaccattcttcaatgttccttaatagattttcatttgagtttattttctcttaggtattttgtaatttattttttatttcttaaataattttgtcttttgctttcattttttttcctgagttgtcggctctttttatttcttttctctttcctcctcttctgcctttaatgttcaatttatcagtcaaggatctgtttctccaaattcttctttgagtgtatgtaactcagttttgaattgtgacttacagttttcttctgcttcatgaatattttgtgagggaatttttgtcagttcagatgtaattaattgttttattttaatttttggaacaactctctatggattaatattttttcttctgcttattttggttgatttggtattgtttctaacattcctaattaattaatgccttcttgtatcttataacaaagctggtttttttagtggatttttttgagttatgtgtccttcatttttttttttaaatgttgtgtaggatcctaaatgttcgcattgcattttttccctttcattattcatctgccaaagagcatagctacttttcttttggccttttctcccagaaatcatgccttatgaagtcctccacttaacgttgcatgtttttctaatttccttccctgcaatcctgtctaccaggaaattgtttccctatttgactatttaggatggacttactctttctgttgatggttatgctttgctagcattcctcttttccaagcatttttttctcaggttgctcttcctctatgaaggtttagagtagggtggagacatgagagattgtttactggaatttggcaatttctgtctatgtacttcagttacttgtaaatttgagcagactgttctgaagttctaattttcgtggtttcttgtacttcacactttgttcggtattatttttaaaggacatatattgagatgccattataggcatacttgttcttttaaacgtttgaggtttatagtttgaggcaacatgcaaaaacttttgaattgttatatctaccctgtggcttttaacatcatgggtgtcccttttcttttttttaaaacccttgtattaaaatctttgtgtattattcaagccagaccagatttatttttggtgtctgcatggcatatacttttcttcactttgctttcactatttttaatctacatattttacttttgtattttgaacacagcatatgcttaaattttacttttaatttctgtctgacagcatacttattttgattagaacatttagtatacttacattcaatgtaattagatgacatattgggataaattttactacatactttctttttattattccctcttcttttattttttttttccttccttggcctttttgactaatttattactttcttattctatttttcctctagttttaataataacttgttaatatttagtggacatattacagatgactgcttgagttttttactcatcacattctaatataaactagtacttttacttcttcccaggatctttgaactttatttattccctttccttttttgctattctactattgccacattttcatttgtatagattttttattctgtaagactccattattattgttaacacaattaattttcttttagatatactcacatatttacctatgccatttatcatcattacttcatatatccctgagcttgcatctgagatcatttgccttctaaatgatgaagattaaaaaaaaatccttggctgggtgcagtggctcatgcctgtagtcacaggactttggtaggtcgaggcaggcagatcaagaggtcaggagtttgagaccagcctggccaacatagtgaaaccccatctctactaaaaattaaaaaaaaaaaagtagctgggcgtggtggtgactgcctataatcccagctactagggaggctgaggcaggagaatcgcttgaatccaggaggcggacgtggcagtgagctgagatcgcgccgctgcactccagcgtgggcaacagagtaagactcagtctaaaaaaataaataaataaaaattcctaaatgtaagcctattcacaacacattatttcattttgtttaaaaatgcccttatcttcatttttgaaatatattttcactgtgtacacagttgtatattggtaaatattttctttcagcactttgaagatactgttccatcatcttctggctctccttattctattgagaagttgtctgtcatttttactgttctccctttgaatacaatatatctatatttccctctggctacatttaaaatttcccctttatctgtaataatcagtaattacgttttaatatacataaatatgtttttctttttatttatattacatgtagtttaccatgttttttgaatttatgtgttgatgtcatttatcagttgggaaaattctcagccattatctcctaaaatattgcttgcttcttcgtcattttctctcttttccaacctgggagtccaatttacatttttgaagaatttctcccctttttttactttgtaccttatattcttttctatatcttttagcttcttcctatgccagccagttgctttctttggattagtcttccagttcacaaattaaaggttgtgactgagttcttcattttctgcattcttgttggtgagtttctaatgtccatcatttctcctgggtttggtcatacagtcttacgtttcatatgcctattgttgttgttgttgtttggttttatttttttctttttgggtgcaagacattattttcctaagaaatagagggctaacttaaggctcaagagtgattttatcttcttccaaagaaatcttttactgacatcttgcaggcaactgtgctagaagcactattaattccatgtcaccttaatccaatgggtgattgagatgattcaaagtttcactttagtacctgtaggtcaagtctatttctaggaatgaggatcattcttattccttgtatgtagccctcagagtctcaatccaaaccatggggtgatcactggaacccatttcttggaaggtcttcagcttcagttgtagtccttgtttcaatttctttgctttctccatcagaattgtctggcagcagccaaagattcagaagaaaatgaactctaagtgcaaggctcatctgcatgcatgtcgctattctcttggattgtgaatctattattcttcattacattgttacattatccaatgctttcaaacacatttatttttgttcatattttgaccatatttgctacttgcttttaaatggagtgttattccacataaccttgttcatcattactgaaaatctccacagctttaaggaaaaatatttataagtttacatttctgtaattgtgtgtagattttacccccactgaataatttcaaacagtatattattgttgaaaaatcgaatatatgttctagaatcatattcttggccagagatttcagtccctccactgtatgtgaaagtcaagttgttttatctggtcttcctgtttcttcatggtcttctgccactcacctttgcagactttccattcctgtctacatctactatctgtttatttattttcacttgcatttacattttttttcttccatactctgtctgtaaagatacctgcagtaccaggatttgattttccccgagtccaaattattttttagattattgcatgttgtttgttaccatcttctccaaatataataccattctctgtgtgcaacactgtgaaccccttgagcttgtaattagttgatctatatccatagaacaagtgtaatgccactgtatcaagatatatccataccagggcctctacccctttctagttgtttccctctgctgaaaattacatggctgtaaataaatgtgctttacttcttttcatgtgcttgctaatgttgcagggaacctcaatcaggaataaaacagaatcacgtggcaaagagattaagctaattttgaccataagaaaaatgtttgcaataatttaaacaaggttatcttgaattgtcactctttaatctttgattttgttatgaatgcatagtaaatttgatatacatgtgcatggctagaagtcaaaagatagaacttaaatcagactctttgaaaggtattactaaaatataaatgtgttatggcttaaagtcatagttacataatgctacggttggtcatagtaaatcagtaaatgtattttttagagccactaaatctttcacactcattatcattctatagtgcaaaaatgaataatgttttcagcaagtctcttatagtacataccacctagtgactgaattagggaaataacattcctaagtaagttcctgtataaacatgaatatacatatttatacatgaatataaaaaatataaattataattttactttcatgccatttctacctcagaagaataggttgaatctgttccacgaatgaaacataaacaggacattcacttgtggtagagccatttgttcactaaatacacatttatacagtgactattatggataaggtattatgctagagagagaaaaatgaataatatgccatccttgtttgctagtagctcataggtgaatggaaggactatgcaatgacacaattgcaatgttctgtaataaatgcagttctacattattaacagaggcaacaaaaaggaagaggtaatatggcatggcttagtatagggtgttatatttattggagcagtataagataatgttagagagataggcttgagttatccctatggatgatcttatagagtaatcttaggaatttaaactttatccagtggatagcggagtgccattcgatggtaatacatagatgaatgatgtgcaagtatgtatgtcttttagtaatgttattttgtctgagaaatttgttaagcagggagacatattagaggctgcagcaacatcttgtgaaaacaatgaaacttataataagaaagaagtaagtgaatagagaatgagcaatggatttttaatatgtgatttgagaaagcttaaaataattagaataatggcacatttcaggttggcaagtgccattaatcaaaatcatgaaagcaagaagaggaactgacttaagtgaaagttaaaaaaaatgtttagtgttaggcagtggaacatccaggtagaattagatgaagccagcaaagatataataggataagccctaggcatggacaaaaatgctataggaatagatgaggaatgagaaaagatacagatggttatggactcaggagaagctcaatgtttcagggacatggatgtatgtgtatgtgtatgtgtgtgtgtatgtgtatgtgtatgtatgtgtagtattctgcttactaaactaaatacagtgacaatgcctggacaggccagggaaattgttggttaacattagattatcagtcataaatgagatgttgaaaaaaatgttaaaaacattgtattctgattatgacttaaagtgttgatggtgacacattaacagcaaataaataagaggcaaggcattgtgtagtacaatttttaagagattgacttgttatcttaccccatgctgtcaaagaccacttctacagaattgcttgacttttggagtgaaaatagggaattcctacagtcaaaggcaatattttacattaaacagagcccacataactatgcagacagtatatggagttaatttcagctggacactattatattcagtctttacaaattgatgcctcagccataaaagcacctcagtgcaatctctagaaattggatggcttcccattgtaagcctttttgaggtgttggacacaaaataagtttttgattgtatttggaggagatcacatgttagttgggggtttgatatgactagactgtgtccctacccaaatctcatcccgaattataaaccccataatccccacattttgagggtggatcaggtggagataattgaatagtgggggtggttttccccatgctgttctcttaatagtgagtctcacgagatctgatggtttaataagcatctgacatttcccctgcatgcattcagtgtgtcctgctgccctgtgaagaaggtgcctgtttctcctttgccttctgccatgattgtaagtttcctgaggcctgcctagtgatgtgaaactgtgagtcaattaaacctctttcctttataaataacccagtctcgggtatttcttcatagcaatgtgagaatggactaatggactaatacagtaaatcggtaccacagagagtgggtgctgctatcaagataccccaaaatgtggaagctactttggaactgggtaataggcaaaggttgaaacagtttggagggctcagaagaagacacaaagatttgggaaagtttggaacttgctagagatttattgaatggctttgaccaaaatgctgatagtaatgaagtccaggctgaggttgtctgagatggaaatgaggaacttgttgggaactggagtgaaggtcactcttgctatgctttagcaaagagactggcagtgttttgctcctgccctagagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtgccctgcatccaagctactccagctgtggctaaaaggggcctaggtacagctcaggctgtggcctcagacagtgcaagccccaagccttggcagctttcacatggtgtggagcctgcaggtgaacagaagtcaagaattgtagtttgtgaacctctgcctagatttcagaggatgtatggaaatgcctggatgtccaggcagaagtttgctgcaggggcggagccctcatggagaaactctgctaggggagtgcagaagggaaatgtggggttggagcccccatacagaggccccactggtgttgcagtttttttgcttctgtagttcagcaagtgcgagggagtggctcccagcagcttcttcactcccatagctcagtgaccatctgttccacagtggaatctatttcagtgaccttcactgccaaaggagtaaaaagaagtacagcgtatgatccctcccaatctgggcctagagagggagaaagaaaaggaagagtccttactagtactaagtcccctggttgaataaaggtggccttggttcatgggtttgggcctttgacatttgtttccgttcctgcaggaaatgggccaaagaacttacatggttaatcaaatcaaaggttacatggttaatcaaatcagaggtttcttggtctagaaggaaatcattggtgagaaaaggctgtccttacgtcatttcaaagggaattaaactcagcttcaaaggggtgtttctaaaacagtagtgccatgggcatgagagtaatccaggggagatgagtctcttaagaaagttttctgaagtgccttttgataatatcatgtttcttttctgcctttcccaaggaatgtggtctccaagcaccatgaagatggtactgtatacctagtgcctttgagtccccctgggtgacagcaaccttgaatgagaggctgttattgcctgaaggtacttagggagcccaaagtgaggaattatctaattaattagtacttctatcacctcagagactttctctgtcagacatgaaaatgcttctatccagttaatgaaggtatatacccataccaggaggtactggatgccccttatctttggaatatggatgaaatccatttgccagtcttctcccaggtagcctcccattctttgggctccagcggggagacaccattgactggggggattatttttaaggcaagcctcacaagcattaatgacctgtttgaccatttttacctgacaacaacctttgagccagttggtaggttttatcctttcctacgtggaaggcttggtgaaagattttaagaactttccattggctggaatttggtagatgaagtttgccatcctccagttgtagctgaaaggtatatccttgagaggaggcccattctatttctgcaggagagtactgagtttttgtttcttttatggagccctcccagattagaggggcctcaagtggatcagaaatctggggtactctaactgccaatttagctgcttgatctaccagtttatttccctcagcaatttcatctatctccttttggtggcctttacaatgtattatgccacttcccgtggaaggaaaaccaaggataatagtctgttaatttcccgatggtacttaatgagagacctattagctgtgaggaagtctgtctcttccagatcatggcatgggcatcgaggattgcaaaagcatacttagaatcagtataaatgttaactgctttccctttgcttaaatgcccccatgagggcatttaactcagctagttgagcacttgcacccgagaaaacaggtgcactcacaatagtgtcattcaggatgactactgtgtattctcctttatcccttgttctacaaaagaaattctgtctgtaaagagagtccattctgcatcctctaaggggtttttttgaggtcctctctggctgcataggtttgcactactatctgttcacagtcatgttcaggcttcccaagtttctctgggagggaggtggctgggtttaggagagccagattcttaactgaactgtagattcctccaatagcagagcttgatatttgaggaggcaattgtttgttagccagagactccccttagaagacagcagtcctgccaggttttgtggggtataaatggctaagttcttccccatgattaacttagtagcctctggcaccagctaagctaccgctgcaactgcccagaggcaggccagtcatcctttagccactaaatcaagttccttgctcaagtagcccatgggctgttggggtgggcctcagactgaggatagaactctgtgatgattaatattgagtgtcaacttgattgggttgaagtatgcaaagtattgttcctgggtgtgtgtttgatggtgttgctaaaggatattaacatttgagtcaatggactgggaaaggcagacccaccctcaatctgggtgggcacaatctaataagctgccagcatggctagaataaaagcagacagaagaatggaaaagactgactggcttagtctcacagcctaaatctttctcctgtgctggatgcttcctacccttgaacattggactccaagttcttcaactctgggactcagggactcagactggcttcctttcttctcagcttgcagacagcctactgtgggacctcactttgtgattgtgtgagccaatactccttaataaagtcccctttatatatacatctatcctattagttctgtccctctagagaaccctgactaatacaccttcctcactgatacataaagatttaacatcttccctatgggaagactaagggcttgtgcctcaagcaaggcttgtttcaattggtgaaaggcccttttaatatttggttccccaattatggagtgagtcttagctgcctgagtttctttcattaggtgatataagggatgagctatctcactgtgcccaggtgtccataatctgcagaatcatgtaatgcccaagaaccccctcagttgtttgagggtttgaggaggggaaagtaggagatgggcttaatcctttattcacctgttgccctggtctcctctgacaagagtagacctagatacttcactgaagtctgacagagctgagtcttagattttgagatcttatgtcctctgttaccctgaaagttaagaagaggcttactgccttcctgagtgatttcctcagttagggcacaacagataatgtcatctacatattgtaaaattttaacctgaggataaaggaactcagagagaccccttgacaacactttaccaaacaggtgggggctgtctcagaatccctgaagtacaccatccaggttagctgggtggtctggttggagggatcctcaaatgcaaacaaatattgagaggcagggtatagtggtatgtagaaaaaggcattctttagttccaggactgtgagccctttagttccctcaggtatttgagttagcaaagtatagggattgagaaccaccagatatatcggaaccacagcctcatttatgaggtggaggtcctggagcagtctgcattcccatttggatttctgtgctcccaatattggggtattacaagggctgttgcagggtttgaggaggcctgcctcttcaagttatcaatgatggcttctagccctttcctagcttctggttttagggctcactaaactagcttctggttagtgaagcaggtgggatcctaaaggtggagttggaccagtatggtggttgtggcttgatcaattttcccttgagctgccaaaacttctggattagtattagtctgcaccagtgggagacaaagagcctgccttggagccataaggatggtagttcccttatgaggtaaaatatccctatgtagcagaggagttggcctcctggcatgatttaaaaggcacgagtaagcaagaggtttccccaactgcaagtgagtggttgggaaaaatatcaggttaaagtttttcttgagatgcccctcataggcatgctaagggaggaggggaggcctggactggagaggagaacagaaatggctgtgctggtatccaagaggaggttcactttcctctcttcaactttcagagtcacttggggctcctgaatggcaatgacattttgagttattggagccagggagagaagcccaaggactcctcagtcctgctggaccatttgtgagtctggctctggactcagtgacctgcatctctggggacagtccaccctccaatggttccctccagagattggacagggtcaaggtggcttcctcatgctgcctgggcagttgttaaggtgccctggcttgccacatttgtaggagttatcaggtgcatctcagggattctgggtttttaagcctgcaaggcagctattagagactgtaccttttttcttgtgtctcctctctctctcttcagtctcctcctgatccctgttgtaaaagaccaaagtagccactttcaggaggttctctaaagtgctatcttgtcccatggcctgcttctgcagcttcctcctgataccaggggctgcctcctaaacttactctttaggattagttgtccctcaaatgaattaggggatagagaggtgtaccaaggcttctcttagcctctccagaaaggaaatgggtcatctgatccctggtctatcatggatagtttggagtaattgagaggcttagttttagtccttcataagcaaccaatatgcacatctgaaagtgtttcctcctctattctcccatgttgtattagtcagggctctctagagggacagaactaataggagatatatatatatatctctctctatatatatagatatatatatatatatctatgtatttatgtacagatatatatatatctatgtatttatatatagatatatatatctctatgtatttatatatagatatatatatgtatttatatatagatatatatatatctatgtatttatatatagatatatatatatgtatttatatatagagatatatatatctatgtatttatatatagagatatatatatctatgtatttatatatagagatatatataaaataatatctcctatatctcctattgtgtgtgtgtgtgtatatatatgtgtgtgtatatgtgtgtatatatatatctgtgtatatatatgtgtatatatatatctcctacatatatatcatatatatatatgggaatttattaagtattaacttacaaaatcacaaggtctcacaacaggccatctgcaagctgtggagcaaggagagccagttcaagtcccaaaactgaaaaatttggagtctgatgttccagagcaggaagcattcagcataggagaaagatgtaggctgggaggctaggccatctggtcttttcacaattttctgtctgctttatattatagccacactggcagctgattagattgtgcccacccagatcaagggtggatctgtcttttccagcccactgattcaaatgttaatgttctttggcaacaccctcacagacacacccaggatcaatactttgcatccctcaatccaatcaagttgacagtcattattaaccatcacaagtcaaccccttgtcaacttgaacccatacacatgtcctgagattatacataatcaaataaagacaacaataaggtaataattacacctaacataataaaactatcctttgtacatcaggaaacgcaccaatccccaacccaaatactattacataaagttaataatacttaaatgctgaggtgaagtcaataaatcttatgtcacatgatagaggggaaaggaaataaaatgaagatgttttcttagtacaggtgtatacatgcacaaacatgtttttaatgaaagaaggaggaaatacttatgacaattacagtcctcatttctgcagctggtcatgtggtcatagctggtattgatgactaccttcttcaactacccattctgtattccctttgccttcagcaagcacctcagcaggttttttttttttttttttttttttttcctggtggaatgacccaagccttcattcctgaagggtctgggtcatttgtagtcccacctgggttggggtgttgcagtttcccattgacattaatcacagggcatggtaatactgtgagatgccctaatggatctcctatattccacgtatactgttccttacctttgttgtggagtagtagactgatttcatcttgatagtccaggtcaatcacatcagccaacgctgtaactcccttcttaacctgttgtcttaaaggtaggaggagcccaaagtgtccaggtggcaatcttaacatccagtttaatgaatcattgttgtgtctcctggtggaagcattcccctctctagaactaagacttctagactagtagaatgtaatgccatgggaacaggaagcaagaattttgctagtgtatcactagaagtgatggtgagtggtgccacttccacttccaccccttgattcctggacctgtgaatcctgtctatgggagaaacagtaccatatattggatgctgattcagaacatgcatggccttctggagaactttgcctcatccaagcgaagtattatcacctagttggcattgtaattgtgacttcaaaaggccattgcacagtttttatcagtccagctgcttcaggatgatggggaacatgataagaccagtgaattccataagcatgatcccactgccccacttttttagctgtaaagtgagtgccttggtcagaggcaatgctgtgtggaataacatgatgatggataaggcattctgtgagtccatggatggtagtcttggcaggagcattgtgggcaggatacacaaacccatatccggagtaagtgtgtattccactgggcacaaatctctgccccttccttgatggaagaggttcagtataatcaacctgctaccaggtagctggttgatcaccctgaggaatggtgccatattgtgggctcagtgttggtctctgctgctggcaaattgggcactcagcagtgcccatagccaggtcagccttggtgagtgaaaatccatgttgctgagcccatgcataacctccaatcctcccatcatggccacttttctcatgggcccattgggccatgacaggcttggctggggaaagaggctgagtggtgtccacagaacgggtcatcctatccacttgattattaaaatcctcctgtgctgaggttacccataggtgagcactcacatgggatacaaatatcttcacagttttgaccacttagagaggtccatccacatatctctgccccaaatttctttgtcaccaattttccaatcatgctgcttccacatccctgatcatcaagccaaaccattggctacagttcacgaatcagcatataatcacacatctggccatttctctatccatgcaaagtgcacaaccaggtgcactgctcaaagttctgcctactgggaagaattccctttaccactgtccttcagggatgtcctaaaaaggggctgtactgctgcagctgtctacttttgggtggtacctgtatattgtgcagaaccatctgtgaaccaggacttaatcttctcttcctctttcaactgatcataggtaactccccatgaagccatcagtgcaggctggggaagagaaggtacggaggcaggaggggagcatttgagccacttcctcaagtaacttacttttgccttcagaacctgcttgagcccaatcacgtatataccacttccatttgatgatggaatgctgctgtgcgtgccccactttatgactagatgggtcagaaagcacccagttcatgataggcagttcaggtcacatggtgacttgatgacccatagtcaaacgttcagtttccaccaaagcccagtaacagaccaacatctgtctctcaaaaggagagtagttatctgcagaagatggcagggcctgctccaaaattttagaggcctctgctgtgattcacctatgggggcctgccagaggctctgatcagcatccctatctgccgctgtcacctcaagcactattgaatttgctgggtcatatggcccaagtggcagagcagcttgcacagcatccttgatctgttgcagagccttctcctgttctggagcccactcaaaactggcagccttttgggtaactcgatgaataggccacagtaacacacccatatgaggaatgtcttgcctgcaaaatccaaataggcccactaggcattgtgcctctttcttggttgtaggtggggtcaaattcagcaacttatccttcaccttagaaggaatgtcttgaaagatcccacacaactggacccctagaaagtttactgaggcagaagttccctaaattttagtcagatttattttccatcttctggcatgcaaatatatcaccaataagccctgtgtgtttgctacttcttgctcactggatttcatcagtataagacatgaatgtaatgaacgagtgtgacatcttgtagaagtaaaaagcgatcaaggtgtctccgaaaaagattatgacacaaagctggagagttgatatacccctgaggtaggacagtaaaggtatattgctggccttgccagttgaaagcaaattgcttctagtgggccttatggacaggaatggagaaaaaggcatttgccaactcaatggctgcataccagataccaggagatgtgttaattttctcaagcaataaaaccacatgtggtacagcagctgcaaatggagtcaccacttggttaagcttttgataatcgacgatcattctccaagatctatctgtcttctgcataggccttatgggagagttgaacaggaatgtggtgggaatcaccacccctgtgtcttttgagtccttgatggtggcactaatctccgcagtccctccagggatatggtattgttttcaatttactatttttctaggtagaggcagctctaatgacttccatttggcctttcccaccataatagccctcaccttacctgtcagagagccaatgtgagagttctgccagcctgctaagtatgtctatgccaattatgtgttctagcactggaggaataatcacaggatgcaccacaattcagacctgagctaaaactccattagttacctgacctccataaccccctactttaactggaggaccacagtgacattttgggtccctaagaatcaatgtcagctcagaggcagtgaccattagtccccgaattatctgatcttttcccttcctccaatgcacagttaccctagtaaaatgctggaggtttccttggggaagaatgggagaaagattaacagcataaattgtcagtagtgtagtggtgtccttcctcaagaggtcttggctcccccttcattcaaagggttctgtgtctgtaaactggctcaagtctggaatttcactgaggggccatgattctctgtttttataattcaaattcatcttttgtcccttctacgtagaagttttctgcttatataaattaagtagaaatacagtaggcttcctatcaatttcacttccaggaactccgtgattaattagccaatgctagagctctacttgagtcagactattctgattgcttctttgtctctgctatccattacggtacctatgctcaccttgcttttgatggttgagtgtcgccacttggtccctgccatctcaggatccaattattccaattgtgtttaaattttgtagatgagaactgcggttcctactattagatctgacatacagagaagagcaattacagggctcttcaaagatgcgggtgctatcctcacaaatctattttgcaaggcattggtcaagttatatcttctggaccctctcagctaggatgattaggtctgaagtgactaatccactccagcatcccaatctccctaagcctttggatcctttcctctatattaaaccaagggagatcaggcacagtaggccatcttttaatccatatttcagctaaccaagcaaataaactactagaaccttttttactccccaagctgcaatattaaattcagagtccctacttagtgggcccaaatcaataaatttagcctgatccaactctatgtttcttccactattatcccacacccttaatatccattcccatgcctgttctccagatttctgtttatataaattagaaaactcaagcagttattttcgagtgtagtacacctcctcgtggtcacactctcaacctcatctctaggggcctgccgggactttagtctagttatagatctagaagcaaacaggtgttgggtgtggctcctgagaagaatcaacattatctttcctggcaactgcctcaggggaagtcatcactgttgcttcaggcagcacagggtttatctcctcagacaaaggtggaaaggctgatggcagcatgggttggggaggggctgttgccactactgggcatggggatgcttttccttctggcaaaaaagtttcatcagagtttacaaactcagtgtccccatcttcatcagcatccttccacatgttcccattccaagttgcagggtcccattcttttccaatcaatgccctcactttaatggtagacacctggaaaggctgcacatgcactttttgttgtaggttagccactcacatgataagagcttctgtctttttttccacaatttcagctcgttctctacaggagataggtctctcagggaaaccttggcagatttgaggctcagtatctgcttctgaagttgggagatagaatccctgggttcctcattttctttcatcactttgtctactgaacttaggagcaaccaaccagctttattacattccccacatatggtcaaaggtattatatatatagtcacttaactccttgcctctcatgtttggtgactcaggagtgtcaaatgcatttattttgtgtatctctataagcagttcacaccaaggactgtcagtgttctccatactattagaagtagagtccttagcatttttgagtctaatcatattaagcagccaactccagaaaccctaaaaccaatgaaagaactctatccttaatattctgttcctctagaaccactcctggtaccaaaatctgtattagccagggttctctagagggacagaactaataggagatatactggcagctgattagttggtgcccacccagattaagagttggtctgattttcccagcccactgactcaaatgttaatctcctttggcaataccctcacagacacaccccagattaatactttgcctccttcaattcactgaagttgacactcagtattaaccatcacacatgtcatcattggggtcccatttagggtcctccaatggtactgctgtttttccaattgtataaagctcttccccttgcttggcactatatgaggtacaaagctcatccccaaatttctctgccacttgcagggctgtctgcttctcagcggtagtcaggattcgattccaaagtaacattacatccttccaggagagttcaaatacttgggttaaattctggaaagcctctatataactgtccgggtcatctgaaaacctgccaagatccccctaaatttgtcttaagtcctgtagagttcaggagacctgtatcttaatgggttatattcacaaggcattttctataggggcatgagcaaggcttggacctgcctaaaatgatttttaggatgggggcaaaataatataagaagttttttcttcaaagtctgaggggtcacaggagtcccagtgattcaggatacacttgaggggagtgcaggctgcaggtggtttgttacccacctgaaaagagagaggggagaaaaggcatgccttagtctctcccttgctaatcttgaatttgaagcatccctcaaatctcagtaactggtactggcaccatggatgggctcttgctgcttatgccatggttgtgagtatgaccttcccccatgaagcagaaaggactagttggcagggatagtcatgcttacctgcactctgtcctagccttctgttgttgacttcctctggttcctcagatctagttttctttttagggctccaaactgaagcatgaaaaatacactggagtaatggtaaggtgaagctatggaaatagatccttctcaaacaaaggaaagaaaaggaaccctgagaactggggacctggcctaataagatgtcttccaaaaggaaaaaatcagtccttcacatagaaaagctccttgtattttcaggattatgttgattcctgacatggtgggaaaagaaacaacttaaatgcagaggagggaaggtccctgggggaagtggtctcttgcactatgctaatgggtttcttcaacaggggaaagaaaactctcttaatttttacatccccctgtttctaagaatagacagaaacaacatggttcaggtttacactcccgataactaagccaagtattcattctacccactaatattatctttttggcttgcaaaaacacttgtaacattgtatataaagaagggatagaagccacaagagtcttgaaagaaagaaaatgtgataggaaagactggaagttttggtgcaacacctgaacaggctgtcgggaattggagccaatccaggagtcttccagtaatgtcgaggcatggccttggccagataccttcaattgccccaggaccttattctgatcccacatgacagctagaattctggaagagaagctggattggaataaagtgaacatttccaacacccgagggtgaagggggattgacaaaatcctcccctgcaagcctgttctctgaatcttatagaccagcagctgcactatccactcttaactggctgacaaaggcccagtgttctatctgtttttgtaaaaaatctgaggacaagaagcctcggaatgaaagtaaagagtcataggtccactcttactcaaactttaattgatcctggatgaacccccagaaatgttgtggcatttttgctcgcatagtttggtgagtgggaaggagtggcacccagtggcttcttcactcccatagctcagtgagcaggagggagcggggcccagtggcattttctctctcttagctcaggtagtggaaggggatgttacagctcttttactctcgctgcccacagcttggtgagcaggagtgttacagctctttcattcaagcagttcagagatttctacattcttgtcctgtgaccaaaaggaataaggtatgtggacactggagagtgagtaaggcagagtagaattttattgagcaacagaaagaaagctctcagaagcaagaggggacccaaaagcttgttgccatctgtgaagctgagtcgggtttttatgggcttagaatgggggaatgaatgctgattggtccatgggtgggctcgaaaaaggcatcatttgatgggttaaaaggcatcattcagaagaaatcaactgagagagagtagataagatggggatggcagttttcactctggtcctagactctatctggaactggaagctcagttttcaggctttaggctatccttggcttgaaggtcaagtttcaccagggacccatccctgtccacctatgaatttgtctgtctcctgtatctatcaatggggcactgcctaataaagctgtgagaagagggccaccatcctccagacctcagaatggtagatccactgacagcttgcaccatgcacctgaaaaagccacagacacttaacaccaagctatggaagcagctgggaggggagttataccctgcaaagccagaggaatggagctgcccaaggccatgggagcccatctcatgcatcagcatgacctggatgtgagacatggagacaaaggagatgattttggaactttaaggtttaatgactgccctgttggagatcagacttgcatggggcctgtagcccctttgttttcacgatttctcccatttggaatgggagcatttattcaatgtctgtactcccattgtacctaggaaataactaacttgcttttgattttacaggatcataggtggaagggacttgccttgtctcagatgagactttggacttggactcttgagttaatgctgaaatgaattaagactttgggggactgtgggaaggtatcattggttttgaaatataagaacatgagatttgggaggggccaggggcagaatgatatggttagtttctgtggccccaccaaaatctcatcttgaattgtaatccccataattcccacattttgagggtaaaagaggtggagataattgactcataggagtggtttcccccatgctgtgcttgtgatagtgagtgggtctcacaagatctgatggttttagaagtgtctggcatttccccttcttgcactcactctgtcctgctgccctgtgaagaaggtgcctatttctccttttctgtctgccatgatagtaagttttctgaggtctccccagcgatctggagctgagtcaattaaagctcttttctttataaattgcccagtcttgggtatttcttcatagcagtgtgagaatggactaatacagggttgtatatcagaagtcatataaagatagaagaatattaaacaggtacatttaaattttgtcatgaggttatgacaagttactctgacttcactaagcaaaccacctgagctgtttagatatcttaagtctagctagcaaaataaaacactgtctatatcaatgtagcagtatatgtgaaagggatttgtaaattctgtaatgtcataaataggagtactatttttgtactaatagaaaatttttaagtgtggcttgttcttgtggcctgttaacatgaatgtgatggtagctactattacaaaattaccacctcttctctactctcgaggatggtgattcactagcaacagtttctctttaggaactttgatatcagggaatgcctttcatagttccgtatcccaggcatttagcctgctatttgcacattaatacattaatacattaattcatttttttgaatgaattaataaaaactatgtgactgttctggaagattctgccatattcctactctgtgagtggtgggagggggaagctaaaatcaaggaggcttcacttaattattcttatccattcatcttctgaatactcttaagaatcttcaatttaaccaatagtcttaaataatcttactaagggtttttaatacatttaatgagttataaatcaaggataaggatagaaaattggcagtccatagatgcattttgtttggtcctcccaatgttgacatttctcagggttaaataattataataaaaatttactgtcagcattaaaaatttattctagttcacctaaacatgtattcttttctctttttcttctccaggcacactggcttccttttttttttttttttttttttttgtaaaatgccacatttactcttaaattctggactttgaactggctttttcctatgccaggaatgttcttcttctaaatatcatcatggtcaactctatcactgtcttagtctttaatcgaatgtcaccttctccatgaggcctcgccagattgccgcatgtataatttcatacatcatgccccaaaaaattctccccatgtacttccagtctctcttacactgctttttctttctactgcatttttaatctaacattttatgtgatatacttgtatatgtttattatttattttctgtctcctcaatatattataagctacatgaggattgagatctttttgtttgtgtgtgtgtgtgtgtttactagtgtatttcaggcaattggaataatgcttgataaattaggactatcaataaatatttgttgaatgattcaacgaaaaccccaaatatatggctccttttgaaaaaaaagcactatctgttaacattgggcttacattcctacatcctccaccatttgttggaactgagaggcaacaggtgctttaggcaagacatgcatgcattcctcggtcctctacagccatcaccaccacacttgtcttcccagtgctgagccttatctgcattggcatttatcttcatatttattcttttttttacaataaagaggaaaactatgtctagtactcatatctatatcaaaagggggtaacatgggataaagaaagatcaagaaagttatatgtttattgaaacaagggggacagcatgtttccatgttgaggtgatctacgtgttaaacatgtagaatatatctcttcatatgtccacctagttcattcatttgaattatttttctgatgcctggcttttgaatttctgacctctgctctaaatagacataactgcaactttacttaaaattcaaagataagaagtatggaagcatgcattatcagaaagaagataaaattatggaagcttacaataagatcaagtatcttgagtagctaatagtagaagttagttattttactgtggaattttattacattttaagttgccaacccacacaaagataatccttgtggacatctatagagaattaaattttcagttagctaagatgctataactttgggcataaacttgcatttatagctgggcatgtaaagcaaacagatgccaattggttgggacagtactattaggcatatccccttagccaataatgcaaataagttagccttgctacagcaaagttttgccttgcctttgaggaatggaagcagattaaagcagggaagagatgtcaatatcatccatactttctatccacaaaactaatcagaaaatctttgacatttactcagagtaataccatacctgaaataggtgaatctatgaattcttaatttagtaaatctgttagaaacaggtcaccattttcaaaagctgttacattaattcactttggtgtaaagcattgtctagcactatttcagcacccagtattgacagaagtgatcacttgtgtcatcatatggcacacacttttccgaacctccatatgcttttggctacctgtctttctattttgtacactttccctttgaatatttttaggtttgcaacacttttatgtgattatcatagtgttaaacagaagttataatttactgtccaggattattttacatataacatgtaactgaccctttcagatgttttttattattacataacaagcttatcaaaaagaaaaattgaataacttagaaataatatttattaaattgtaattattaacctgttagcattaaagtcaggataagatagctgagctgtattgcaatttcaattacaaaaatgcgtgcttattcttcattttggaagcccgccaactaaagaatatattaggcagtgaacgcaacatgacaagccattcaattcagcaatttctagttggtcagatacatcttcaggcaaatttaacctttataaggcttattcttggtctctgttttgtagagattacagaattgtttattttaaataaaaattatgttgagagaggtataatctaaaagtcattgaaatttccacttctatcaattttaggttacatgctgctaggtaagaggaattaataaaagtttagaaagtcttcattcattttcaaagtaaactgctagtagagaaactgccttactttctaaaccttaatagaatacgtttttattgataaatgtccaattcattgacttttgtcatctttcaattaattgcttacattttttgtttttaataaggttttaaaagttgttataaccatttatcacaactgtgaactgacttgacttgaaaccattagcaaaataaacacctgtattttagtagctacccataagcaataactacatactatgtaagtgccccctgacctcctgaatcctgcttcaattttgtttagcctctgtttaagctcctggggattatgggggcaaccagtatggcttccaaagaaacagagggataagtaacccaggtgtgtcctctttgtgccagtagtaggaactatgccagctggctgccctctggcactgtgcatagtgaacagaatatttcttgcattccccaaagggaaattttagtaaaaggaacacaaatgaattggatcattattcccatttctcagaaaaggtctgtgcaagagaagggcacagacttcattctttgctttatgacacaagtttattaaggttgccattgcagtgatttttgtaaatgaaggaagcatcagaacatcactgaaatacatactataattgggaattacagacagtaataggatatcctgacttggtaatgagaagagaaaatgagacttccctaaactttttctcagtatgtatgatcttatctaaaacttgaaattttggtgtctgcacaaaaacccaactcaaatatctcagtggattaaaacagcaaaatatatctctcttgtactacattgtgcaagggagcttcgctcatcataatcactgaggaccacaggctggatgggagttcctgccccatactttcatattatcaaatgaagggcacaaaggggtggccaaacacatgctggcacttcaggcttgcccccatgttgcttttgctcacatttcattcatcaggtaaatcacatggccacacctaggtacaagagggcacagaactgacatttgtaaataactctaaaactactaaacatcccgatgctgaatttgtctcagtttaaggaaatgtcagcagcaaaaattagtgccatgtgctgggttttgacagtagtaagattataagcattttcttatttagtaggaaggaggaggtttataaaatcaaatggtataatgattcttctaattttttatttagaatttttattttatttatttatttaaaaatgttcatttttattaactaataaactgagatttaggtttaggtataattatgttcttcttaggtaattataaaccatcagtggaacatgcaatttgaaatatctgattactccctgacacagagtctggtaatagatgagaaaaaggctttgtgaatcacggttctgattagagtgtagaattatgtatctaggaaccagattgttaataaggtggcaaagcccatttatgctagaggaaaaagaatattaaatagataagccattaagttaatttgcttatattcttttaaatatggtatttatagattacatacatatttaattccatgattttctgtgttaaaagtaacattaattccttatagaaaaatttgaatatgcagaaatgaatgaatacaaaatattataaagtaaaaagcatatgaagttagttgctattaatatttggacacactttattttagttgcacacatatatgtgtaaatatacatatatcatttatattaagtggacactttcctatgtccgtattcttcatgaatattattattaataactaaataatgtttcatcatctggatgcatggcattctatggttcaatcaaattaaacaccctttatttgaaatttaggtgtttctagtccttcactataataaataacgatgcatagaaaactttatatgtagatcttagcaaattggtctgaatattttctcagagtacgtttttagaaatggacttaattatggaaggtgtttggtcattatttaacataattgatacatattgccaaatttctttctagaaagtttgcattattaccagcagtgtatgagagcacctgtacaaatttacatggtatatatattgaacctgttatattaatgcttacagataggctttataaatcttttaactgtttgctaaatttcgaaagatgggttgttgagcagatggattctcaaacttaagcaagcctcagaatcacctagaaagctcactgaaaacagattgttgggccccattcacagagactctgatttagtaagtttgggaaggggtttgagaatttgctttgcaagtaagtccccagataatgttgatgcccttgtcagaggcttgcttttgggagaactgttgaaattgactaacgggagtttgttttaaagtaatagtcattattcttcaacatagtaaaaataggcacttacttaactttagaagctaaatattttctaagcatatcaatttttgtgggttagcctttaattgtattctaaaagtgtttcttaaaataattccttctatgcaaaatactgtgcatactaagaaaacataaatctaaccatttcctatgtttttaaatcaagcagatcttttatctctgttcgttagtttatgacacaaataagaagtttagtcaagaaatataatgttaaaataatgatgctgtgaagtttctaagtgaatgtttatggttgtacatcttttttttcattttatggcttcagccttatcttatatgagtcaaagttaaaaaagtttcagggataaatttaaaatacaataaaactattttgttttatataaacatctagaatagaaactttaaagactaattagatacttgaggagtactaaattaaaaatatttaagtacatttgggaaacatcattttgcaaatatcatccttctccctacagtctaaagcccaagaaatgaagacaaacataaaggtcaagtaattgaatagatatatgagtaagaaagacttttcctgacccattcgtattttcatacttagattgtgaatgtcaattagctcaatcaagccttgctgataatgtcagctgtcagtcactcctaggtagtgatgtgtgaagtttgtcagcgggtaatgggccatttgagtgatgaatgaaataatgagggcacagaagcctaagcaaaacgtctccatttttggtaaattcctctccacatgggaaattaagacaaggaaagaaaagccatataaaatctcttttaatacggtgtttattttaaaaatatatatcttaaaatatcttttaactttttatttttaaaaattaatttaaatggtcagtgattaattatcatttcccaatagtattgatcagtgtaagcaacattaggtactgcaagagataagcttgctcccagattcacgttgatattttgacttgaattgaatatttaaatcgaacttcttcagaagtttatcagcagactttctgagtccatggactatctatactaataagaccttgctttatatctctgaataaagtgtagtttctttctttaggcttaacacatttcttgttagtgttctagtaggtatttttatctgattgctgttagagttagagttagtggaatatttttcttttcttttttttttttgagacagcgtctcattctgtccattcaggctggagtgcagtggcacaatcctggctcactgcaaccttcgcctcctgggctcaagcgatcctcctgcctcagccccccaagtagctgggagtacaggtgggagccaccatgcctggctaatttttgtattttttgtagagatgggtttcactacattgcccaggctggtctcgaactcctgagctcaagcgatccacctgctttggcctaccaaaatgttaggattacaggcataagccactgcacccagacaatatttttcttttatatcttctgttaattcattgcatactagcgaaacttactaattttataatttgtcagatgtaatcagccatcataatatggtccctttagtttctttttccttttggcttatctatctaaacatctatcagtgtaatcatatctgtaattaatgatcattttatctcctcttttccaatagttttattgcttctttatttgcttattatcttttgcatatttctactctagctttttccagtgatgcatttttttttttcatttatgctgtgtccttcacaggactgtgaatccttggagtggaagcaatgtattctacttatatttgtgacctagtaattaacatagtgcctgaaatagagtagatactcaaatgttgacagaatgcctgattgaataatttttcacttccacttaaaaattgtttggggcaattcctgtgaatgttagttcaatgaacagcaaataacaagatagggaagcagacctctgttgagtggcacagatctagggtctgggggaaacctgggtactcaagggactcatggggaaagaggcctaatagatagcttggcttcccgtgggatgcctaactgatgtattactcaagttaagaaagaggtacccattgggtctttgaaattgaaaatattttattatttttaattgttttcagggtacatgtgaaaactcatataatttgtaaagttcacatcagtataattgaggtacccatcaccttaaatgtttgtctttatgttataaatgtttgaattattctcttctagctattttgaaatgtacaatagattattgtaaactagagtcaccctactgatctacagaacactaggtcttatttcttctatgaaactatgtatttgtacccattattcaacctctccatccttccttctccactgatcttttcagccttcagtaaccaccaatcaattctctgtcttcttagatccacttttttagcttccacatatgagtgagaacatgcagtatttttatttctgtgcttggcgtatttcacttaatataatgaagagatggctgcattctcatgtttattgcagcactattcataatagctgaaatatggaatcaacctaagtgcccatgaaggggtgagtgaaaaaagaaaatgtggtatatatacaatggaatattattcggccataaaaaagaatgaaatcctgtcatttgcagcaacatggatggaactgaaagttattatgttaagtgaaacaggccaagcacaggttttccattttttaaaatgtaagactatatttaattccaactggcccataaagcaataacttcttttattattggtactgagacatatatagatagccagctattaactggttatgaaactgggattcagtaagattatgtcaaaatcaagtctgcttcaatcaatatcccaggagaatattaaacttataatttgattaatatagaattatttcataataaataagtggagtatgaaacaattcatgatgaatttgctatccagctgaaattaacatgccactagttgcagaaataataaaaatagcaatataaatagataatgtttattaagaatttaatgaacatgttaggtgactaacgtgatgaatgctttgcagagattatctcatcttcatgcagcgtttaagacaggtatgattggggttgcattttacagagagaaatatatatatatattttgaaagcttgttaaatagcttgcctaagttcacacttatatgtggtggagctgagttgctaaggaaagccattattttaaccctgacttttatttcacatagaaagctttaaaataaacatgagtgccagagccttactctcaaattattatttaatttatttggggtgtgactcagtgatactggtatttttttaaaaagctgcctagtgagttcaatgtgcactttgagttaagaccagtgaactattaaagcacactgctgagagcttagctttgccttccaattgtatcttgtcaatacaaaaaaaggttatgttttttttgcttggaagaataattttaagatttattttacctcttctatcctgcacacattgtccttatttatgtatctcacatttacctcactgatcctgcctacccatgtattggccattgtctcctgaaatatttcagcacataggctgggtgatataagaaatctaatgtttacctctgcaagtgaatctatgcttagattggattgtttttactagggttttgccgctctcgatgtaaatctttttttaaatagttgttcagttatcattatattttactattttattagctctactaagtaggcagcaggacctagttgattaggtcgtattaaatacctctttctatgattattggtttaacaatgcttataaaaattgctgtgtttatggtttcagatattttcatgaagttcaaacaactatataagactggatttggatccatcttgctatattttctaacatagtaatttacccttcccctatttccaacccaagcatcatcattaaaataaaataccagcaaaacaatagaaaaataggcaatcagcataaatatgcaattcagaaaaaatgaagtaaagcaaataaataacaaatataaaaatgtttaacttaattatatatgaattggcaataattttttccataggctttttattttacagatataaaatagtatatatgttcattatttatattgacctaggtgttacttcttttagaatgtaagctccataagggagagaattttgtctattttgtttagtgatatattaaaagaactgaaactggtgcctgtcataaaattgacactcaataataaatattattcaaaggaaataactattgaaagaatggatttttttaagtgcatgtgtgtatgcacgtgtgtgtatacgccattaacaaagatatggtaaattgcacacagtactacatgactggcagcagtataattggtacagcttttctaaaaagcagtctgtgaaaaggtatcatgtttttctcaaatatttattctatttgaattatttacacttctagtactatgctttaaggaaatacttagtgaagtgcagatttatagaccaaaaactctgttcataacattgataaccataagagagacaaaaatcactgaataagtaaaatgtggcattcatcattccttcaaaacagactaaatgatgtgaaaatgcagcaatgataaatgaaaaacgagagaagacaatagagcgtgcttccaattttgtaaaaattgagagagaaagatggaaaaaaattaagtaattaaaccacagtgttaatagtatttatatctgggtggtgagactaagcgagcttttaagtttttgcagaattatgaaatgcagaaaatttctatacgaatatgtactactttgttaattagaaatatattatttcacgccagaggcggtgctcacgtctgtaatcccaccactttgggaggccaaggcgggaggatcacctgaggtagggagtttgagaccagcctggccaatatggtgaaaaccgtctactaaaaatacaaaaaattacccgggcgtggtggcacgcgcctgtagtcccagctacgcaggaggctgaggcacgggaatcgcctgaatccggaaggcggaggttgcagtgagccaagatcccgccactgcaatccatcctgggcaacaaagcgagactccatctcaaaaacgaaaaaaaaaaaaaaaagatttttcatgcctaaaataatgtttgagataaataatttttgaataagtaaatgggtgcaaaaattcatgatatgagccttctctcagagcaattttaaagaattagctgtaaggggattcataacttctttttttgagtacagttaagcaattactctatccttcattatgtgttgagtgcttatttgtagcatgtcttttttccactgaggaaggactactttctcatggactgaaaatgctctttgatctgtagctatggtttgcttggtggagcgggcggtgaccaagaaatgacagatgtggattctaatatgtgtgatttgacaggattaatagaaatggtttactttcagtaagtgtttttaaattagtactgtgtccttagatttaaaaagaaaatcataatcaatcaattagcaaatgttaactttgttacccaatgaaagtgtttttagtcggccatttataggggacaaaaggggcataagaattgtagactttcgactgctgacactacggttgggcctggaaagcttatttaaaaaaagacaattaaccaataatatatgacaatgctatattgtgcttcattggaattcaaatagggagtattttcaagtaatttttaacatgtaacatgaggcttagaattgaaattggttatataaattgatatttgccttatttaaaattttatctttttaaatattttctcaaaactaaaattggaaatgaaggacttcatgtaaattctgggcaaatataatgtttatgttgtaatttaatattaaatcagagtatcaacctgtgcagtgattttgatatttaacacagagctcttgtttaatttttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatattcatacacatttattttaaatcttataaaatggagagtatttttattcaaaattcaaaaaatctgtagaaaatatgcatatataaaccttataattccatggtacatttacatttcattaagtggccagcttttgttgataatcatggatacatcattttaattatggtttagtttatataagtaacattattttcttgcatttggtcatagagtcccaaatttatgtaattgttcttcaagaaatctaagacttatacaaaaatatatggcatttgttttgtaattgctcctattatacttaaggaggactaatgactcagaagagacattaaccactctttaacacatatattttacctatagtgagtatttttttttcatttgcaaagcttcctctgctcttgatgaccatatggcatgtgcaatctacttcctaaaccccatttgtttgattatttcctcatagcaagaatattgtctatggtatatgtcgtgagaacatagcacatatgaatacttctgtcataaccaaaagcagtaggtgaatgaattgaaaaggtctgttagtaaagggaaccataaaaatgatacatttataccttagtgttctatttcaatgtaaaacaagtgcctgtacattcatatgctagtcttttgatgtaaggtcgtgactttttcttatatgtctatcgtttggaattctacacaatatttcttacctaagccatgccaataatgcatcttctacaatttcaatttgtcatttcttttatctaaaataagaacttcagacaacttcagatgatctccccacctttttgtaacattaattttcattgacagtaattctgtttatccttctcatatttcatcaccataactaatgtttatactacaataacaaacacaactggcttataaacaggtttaggaccaaactcttgggactctttacaatcatgaaccttggctgatgggagtggccaatgctggtctacttgtgtgattagagagctctgagcagttggggttcagtgagtgcagcttgtgtgttttgtggagataatggaacgtgttagtcaatacagcaattaagtggaggttaagggaaaagcttctattaaatgaaaatgtggagaagaaacagagggaaacatttagctctcagtcaaaggcaaaatatggatttcagcttaatttatttccagcctttggaaagacagctgtcctgattactactactgcaactcaaggaataatggttttgtaacaatcttcactagttagcctattaggagggaaggctgtcacattattagtttattagtagaaaaataaatcggtaaaggaaaaataatcactagtctcttagagtaacataccgcagtggaagattaagttgtgactttgggacaacttacttacatgggacactttttgcctgtctacttcatttccaattggtctcattttctgcttccttatactactatttctttttttgctgtgtgtgtttgtcagtctcccaaacacatggcaaaagtagtagtttattctgcgacttctttctctgtactctcattctatactaccagtccttaactagacataatataaaactcaatttaaaattgttagtgtttctcaaatagtttcataatctgtgttcttaattttaaaaccagtggccgggtgtggtggctcacgcctgtaatcccagcactttgggaggctgaggtgggcagatcactaggtcagattgagaccatcctggctaacacagtgaaaccctctctctactaaaaatacaaaaaattagctgggtgtggtggtgggcgcctgtagtcccagctactcgggaggctgaggcaggagaatggcatgaacccgggaggtggagcttgcagtgagccaagatcgtgccactgccctccagcctaggcgacagagcgagactctgtctcaaaaaacaaaaaaaaacaaccaaaagaaaacagataccaccccctctacagacatacacatacagaatcttagtaagtctacaatacagtgtttattgacccaattatatacttttttaaggaaaaaagaaagttgttttttttttttttgtgcttggggactatgtatttttaaaatttatttttgtttttcatttgccatcagtggaaggaaagttcttcagctatggtgtgtaggtttcttaacttcaaaaatatagcagtaaaagtaatgacaatgataatggaaataatatcaataacaatgctttgctaagcctctataagtgccaggattcagctgctgtatacacacactatgtctgacctttgtatttctataaggcagttattatttttctctctctctctcgtttctccttctctgtcacatacatatacgagactcagacaccttgcgaatcacaaagaaagaatttgtgtcagatctggttaacccaaaggcaaactacaaaatagtgaataagccatgcattattttaaataaacaaaatgaaaaaaatctctgcttttatagttgggcatacaattttgccagtaatacacaactatatgacctatgatttgggcaaaatgcatgacaagcacgacctaggataattgctataaacttaaatattaaaataagtagttagattgtgtttaagtgcagaataattatgtttttttcccctctggagaaacagatttatcaaaatgtgtttttataatgtttttctaacaaggtcataataaaataaatgcatattaaaatccaggtaatttaaaaatcattgatgtattactagtttgcattttcatagagtatggtttcataggccaaagaaccagacagattttaaattaaattagtttagagagtttttgagctctgatttaggtagatgtctttcttctactcttacacgatgcttcccatcagcctagaacatgtctttcagtgactgccactagttgtttgtttgtttgtttgttttgttttttgagatggagtctcgctctcttgcccagactggagcgcagtggtgtgatctcggctcactgcagactccgattcccaggttcaagggattctcctgcctcagcctcctgagtagctgggaccacaggtgcctgccaccacacttggctaatttttgtatttttagaagagacagggtttcaccattgtggccaagttgtttaaaaatttttttttcttatccggagaactccccatcaaacctatgctgtttcctcatatcctgctcattgtctctaaggaggctgacaaaagtgcggactgaattaatagcctccacttgtccttgccattctcctctgccatcgggttctcttcctttcctctcctgaaactgctcttgccggtcattagccactccccgtgtccaccaccagtcatcactcactcattctcattttcttcacctctgaccactcctgcttttcctctcctgactcctattatttgcatgattctagttttcctgctgactcccaggctcatatccttctcagcatcttcagtgagctgctcctctctggccagatttctggttgataggttggccctagactcaactttatagcttcatcttttcactctcatttgcaggtggcctcttccattctctggctttaaatactttccatatggtggtgtctccaccatgatgtctctcctgagcttgaatatctaataggtttctccaaattttcatctgtccaaaaaataactttggttttcccccaaaagacctaatcttctccttatctccctcatttttgcaaacgtaccaaatctgtgtgaacttactcaagctaaaagcctaggagtcattttaattcctcattccctcaccctgcaattcccaccattaaatctaccagaaagtctgataggtctttcctccagaatatattaattttttccccacttctttctacctgtattactgtggtcatttctcatactcttgcaaaagcctcctaatttaccctgtcttaccccacaataattcactggtgtcacaatagccaaacatattttgaaaatgtaaatcagatcatcagatttcctgctttaaatacaatgatgtcttccccttgttgaaaaaataaaacccaaacttactactgtgtggcctttgcaagatgagactcttgcctacctccttggctgcatgctctcccactctcccttgccctatctcctcaatgacaccagtcttctcactattctgcaaacatgccacacttattcctactccaaggtctttccactaccttctccacagactcccagtattacttctccagtttttacatgtctagctcattctaacctctcttagctcaaatgttacctcctcagagaggcagtgcctgaaaaatgtagctaatatttttattcctcactcccttagtcactttcagtcctttcattctactttatttcattcatggttctcagtaggcatgcagtgttttcctagtttatgtgtggcagagatgggtagatgctcaccaatccagtttcctcttctctgagcccattgggagattatatcttcagtttggaattgaacttgggaatttggccatgtgcctaaaaatgaccaaaggcagtgcatatcacttccagacctaacccctaagacttccagtgggattcactgttgactttgaaagttctaagccatgtgatagaagaagcacggttccctgaaacatttgttggttgtagagttctccaaactttatcaagctttaatcttccagactaatgagctatctctttgtgaaattagatgttaggccacatatgataaatgaattttaaaaataaaaatattgaagagattttcacattcactcattcacacaaaaaaatgttattgaacacgtgtcaggcactactctgggcagttaactaactagacagaaatctgttctgagggagattacattgattgaaggaagaggtaataagccaatagtgaacacatgctgtatttgatggccataaatgctgtagaaaaacataaagtgagacagagggaaactgagtgtaggatgaattcagttttaaagagagtgaccgggacttttcttgagaaagtgatatgtaagggaaacctgaagcaggtgatgaagtgagacatgtggagcactaggaagaaaattagagtcagagagaacagcaaatgcaaagcccttgaggtgggagcatatccaaaatattgtgggaacagcaaggggtccggcatggacagaataagtgaccctggagaataggagggggaatataaagttatgtacttggggatcaaagagcctgtgacttagggccttataaatcatggtaaagaggactttgaattttaatctgagaatgtcaggaaggtattagaggattttgaacagaagaattacacagttttacatacataaaaacaaggtgtctgtaactgctgtgaggaaattatactgttataggggtcaagaatagaagctggtagactagttagcaactatttcagtaatccaagaaaagtataaggtttcctggagtaagttgacagtgatatagaggctaatgaatagtcagattttcattatttttttgataggagagtcgacaggattttctgttgggctggttgtggagtgaaagaaagaatttaagaatgattccaaggtttttggcctgagaacaggaagaatagagtgaccattaatttatatggggaagactgagggaggaacaggtttgaacaggtttgacatgttaaatgattgatggtaattaaacttctaagtgaacttagatatacataggacaccttggactgtgctgtgaacaaagttcataactgtgtatgctgcctagcgaacaggttcatgtcagtactattccttgtattttaattgaaacagacaccagaaataaagttactaagtagcttttactgtgaaaatatgggcattatagaaatgtaacttttggaaaacatataatttaattattatatatggatatgtataatataagctttaagtataaagcttaagtacttaattatacatatccatatatacatatccatatatataatgcttaagtacttaattatatatatccatatataaactatattaattaaattatatgttttcaagagagtatgttatattttaaaatgtgagttttgaaattaaatattttgaaaataattatagatatgtatttttccaatggatatttagaataagcttaaattatgttgtaatttttatgtttacatcccatcaaaacaaacaaacaatatattagagccaagtctatatttaaattttgcatttctaagagaaagaacttatactccatttagcttcaagaaaattccccttaggaaggtgataattacatacaattgaaacacttgtgatcattacttataagtattttacagaataatttaaaatattttctataatataaagatacagtctgctagttttacagtttattatcaaagtactaaggtattcagctatcttctattaaataataatatttatgccattaaattttaagaagaaaggtgtacaatatgcagcaaatataaacattcattttaatgagctatttatctttttggggtgtgttctatgaataaatacattatctaattagtagattcaattttcgatttatttcagattgtctttagagccattgcatgtgtttgtcttcaactttaaagtaagtttgtttagacattgggttttaaaacctgagcaactatcatcttccagaaggtgttctaccttgtttttttttttttttatggtcaactcacagccaaaattatggaaaggctttatcgttggtcacagatgatgcacagagcattttcaattccagtgtttcatagactcggtgatagaccgacagttgccctcctgggactgtaaacatttttcattctcttttaattatctagatctatattaataaccacagtgacctataagaaggcattgttggccatactataattatatatagcaattatgtgtagtgccaacaatacataaaaatcccaccctttaactacggttggtaagaaatgaaactatgcttttctgccttaggatatagtttcagtttttgaaaaattaagacattccatttttacataaaactttttctggagtatattattatggtaaggcaggtctatttccatggactgacaatacattaagaatattccaataaatatagaaagcatctctcactccagcttcctccttagctacatactggtatttcctattacatactgtataacagaaagggaaatgcaagttcaaagcaaaggttaatctttgtaatgcagaatgtcagagaagatggtttagaacaagtaccaatatatctcttgttctctttgaaaatttatttagtatttcaaactatattatattcacacatgtattcattattctgtttaaataattaaaggtggcaagacatggtgaagtatgagcaatcagtagttttgatttaggtgaagcacccatcaagtaatggcagtagtaattgccatttgccaatgtcttggcaagttgaggtgaaaccaatgtctttagtccgtgttaaagtcaatgcatgtggaatggtatcccataattgacttacttattttttttatgatgaatgggttgtaaacatcagtgcctgtgtcatagatctaaatcttaaaccaattttggcaatttcttatagggccatgactagagaatgatattgtcatattggtttatatcattaaatttttcatattaaaagtgcttttatagtctaatagaaagtaataaaacttttattagatttatacaccaaacatataaaacaatattgatgctctgatttcaatttttaaactcctgacattatcccaagctgcaatgactgttaattcagagtacctcatgaaataggacatttcaacttgcatgtcttgtgagcacctcaaatttagcaggtctcaataccagctctcctttttcatcattttcctcatcttcatgctcaccaactttctcccattttatttaatgttattatcatccatatggtcatctaagatgacctgtgagtctttttaacatcctctttaccacttatttgtcacatgcaatccatcacttaagcctgtgtattttatgtccaaaatgagttgttcagtcattcacgtctgtcaaagaccatcatctgtcacttaggcttccccagcagtttcccatggtctgcctccagtcactcctccaacttgaatttatccttcctactgccatcatagtagtctttctaaaatagagatccaatatcttatttgtgctttaaaatctttatttttcaagcccttaagacacatttggctcttccctatgtagctctaaccaatttttttttctagttctattgtgtcctttgcttctgcaccccttatgctctatattcaatgaaatcccttcatgtgttcatgcattggctcatgttcctttgaccattatgtctgttacctcctttttccacttgcaaatattcaagcaacctaaagtatgtttctatactatactagagctcctttctgttctcttgatactaggtacataacatagaaaatgcataatacaggggtgcatagaacagatcctatggattctaatgatttatttttgtgtctgtgtctcccaacaccacagtaaggactcttgagagcacagatcatatcttgtcactatgaatagtccctgacagataggaagtgacttaatatgtgttgaaagaatgaatgcatgacttaagttattatgagtgcctatagttctatagccaggtttttcaacatactgtgtattatctacttataacctggctatcaccagctgtcaccctctcttttaaaatttatttagcttgaatgtcaagaaatttatatgaatgcctgtggtataattttcctactcattatcataaccataactggcattctctgtgcatatagggtagctataaacactactctcgtaataattagagttacttctgtcatatgctcatgaccaaattctcttgcccttttcagaaagcacaaaagaggatccctttttttcagcctgccttattctctcagaattctaggtttcttactcttgcttgtctgttttctcaacagtcatcccccaattctcatacggactttcttgtccctgtttccagacactggtttctttagtattcctaagactttcactggattcttgaatcttctgctttttcctcatctatttggccttctcgattctaaattttgacagccagttaacctttaaacttgagcttgctaaactgacacctgggttttcactccataatctcccagttctattctttaactgtccaatcagattcttttggcacctgtatttcatatcattctccatttggggaatgaggatacacctgacaaacccacagaatgctttcatggggaaactcagtaacaaatataaatttagagtatattgtgtattctggattgaatccatgggcttaggacttttcaattgatgaagagtatatgaaaggaaaactaggcatttcaggtacatttgatatatgaatgtcacagatatggagtaaaatgtagtcaaaatctcctccctttttcaataagaccaccaataggaggaagataattgatttggtcaaggccaagaatataattgggtcatatcgctaaaacttgcaactttatgtgagaggagaaaagtggtcttgaatcgagaaaaacccagttatttccccttggttttcttcacgcattcaatggttgtatactcaattcctaccttgtgttctaaacattaggaattaaatggtaagtgagagagagagacagagatttatttctgtgcttctttttatcattacactagtacaacctagagatccaattattgactatgggcctagaagaaaaggacagagaacgaccaatgttattttaggccttagagtggggtggtaggtaataggttgaaggagtccagctgtcatatttgagagcggagataaactagtttgcatttacccagagttctttttgcatattttcttcagaaggaattaaaaggtgcccgagcaaggacttgggcctcctagtgtccaaacagctctagcccctaatcacggcaaagcaatatcaggaaagggataagaaagttgaaactgtgtaggtcatgagtaatgagataatatgttttatggtatacaaacacatgggtaattcttggtgagggtagagaccgttcccagaggggaaaaagtacctgtatatttctaatctcctatccaagtactcaccaggtctaaccctggttagcttccaagttttgacaagttagggcatgttgagtgtggaatggccatggactgcacattcctgatctcaatagggaattctagactaaatcttttaaggtaacttgtttctgcaataattcttgcagatgccattgacaagttttataactttcattttgttatgttaaattgggctaataacaacttctcaagaagcctaacaaattgttgatattaggtatcattttccttgctttagtaataatattgaacatttattaagctgataatattaactgcctgagaaattgtgatctaggaatagaaagaatttacctgcatttgttttacatttatgcttaaggaaactgaaataacagcacttggtgaaaaaaatatacgtctatgtccaaattttctagcttttcttcctaatattttcttatgcaaaacactatcagggaactgacatgataatgccagaaattctcttcagaggaagctgaattagtatgtcttaagacctgctctgtgtatttaaacagaatgattgggaaataactaccgtaatttcttagtgataattttgagactttttctccttttgtgcaaaatgttgtagtacatttaagtctagttgtttattacatgacaatagagtatacttttcctttttgtgcttggcagagaatgtacatttatttgtgatgtttatgtagatattaaaaatagatattggacttactatatactaaagcttagttgttctagaaaagtaattttatcgattttaatctttactgctagtcatattgctatttacttatttttctttttaaaaaacaagccaacaaaaaattcctgaaaattgttaattaacagatttagatactgaattagcccaatcaaatgatgtcttaggctattaaccaaagtggtttaagaattacatacatttatttttatttagctatttccaaagtgattttttaatttaaatagtggcttttattctggaataggacatagtaagtaaaacctttaaaaaaaattcaaacgttgtatctttgttgttgttgctgttcttttttgagacagaatctcatcctgtcactcaggctggagagcagtggcatgaagagggctcagtgcagcctggacccccagggatcaagcagtcctcctgtctcagcctcccccgtagctgagaccactggcatgcaccagctatttaaaaaattttttttttctgtagagatggggtcttgccatgtttcccaggctgatcttaaattcctgggctcaagcgattcttctgcctcagcctcccaaattgctaggattacaggcatgagccactgcacctgtctcaaaatttcctttttatacaaggaaccacatttataaataaaaatattttattttttatttgttcaccctactataaagtcatttagatgaaagtagaaactttgaaataataggctaaataaaaatgtgatttatgaattagtttatgaatttctattaagagatcagcaaacagttatgcttaaatcttggatgatgttaccacaatgatgatcacaatgaacattttttgaaaagttgaaccaatcacgttaaaggcttttcacataatttctcatttaatcctatgaacagttctttaatatggtactattattcatccattttacagaggagtatatagcagttgcccactttcccatctgaatatctgaatctcctactggctatcaacttctttgggaaagaactggctcttctttacatattctagcatagtagagcttatgacaacatagttggcacttaaaacacagtgacttgatgaatgaatgagttcctagaaaacagtgagtctgaattttctagtcaagtcatatgtacaacagaagggtcaaatataggtgagttttaaagactcttcttaataagtatgagttagccagtttctcaaccttagacatttacccttgattcccatctatatatcatgaaaatttaatagtaccgattactatgtatctgtttatgtatcttggacttttggaagtccacaaaacattctaatatctaatattgtttcacctcccccatgaatcaattttttgcctctgttggggcagctttgctctgattgagaatatatgagttaagcaatgggtgaagacattgaaatgttgatttcctcagaaaggagggatgtagggttttgctctttgcctaccttctttatgtgcctcaccatcttgttttcacagtgcttccttttagatatctttatgacattgccataaaaggtcatgttggcatattaccttaaaatactgaaaaggtaccattttagaagaacatttgatgatgaagtgaagcaacagccccattgctcctcaccacccctcatgcccttcaggtctgatttaacctgtaatgtgacttcaatattttaaggtgagatcaaccttttctttttggagaggtattcataaaaaggctaatgacccacttgtgctcataaggaatgacacagggaaacctgggggacaaagctaccaacttttcttctttggaggaaattttcccttagcttagcactatccttaaaaataaatcattaaacaagaacaattttgtgacaaggaataaagggaaattggtaaatgaaagtgaaatggtaaaatacagaggtttaagagtttaaaattaaataaattaaaatgtggaaatgtaaccggacccaggttcagctcctcaccacttgaaagccaaacacagaaggtgagggttagtgggaggaaaagcaggttttaattggaaagccagcaaactgagaacatagtgaactagtactctaaaataccatcttaaattttacagtttaccataggattttttaaggggaactttgtatggcagacatgtgggagtggtgcagggtgcagggtctgcgtgtcttgttctcgtggctatcttgtgagttattgctggtctggaagtctgattggcattatcttcactctccccaatagtggtggaatgattgtttgtgactcttgctaagcggaaggactatgcaggggctccatgcctggtttgtagcaagattagattttggaatttcttaagcaagaacataattagattagcatgcattgccagagggcagtgtgtagagagggaaggaatgaagaagtgaaagtggagggaaggaagaaaaagaaagagggtgatatttaaaacctgggtccctggttatggtaataaaacaaaacatctttaaattttaatcagggacacactttaagaaataaagattaaaggtattaaaataaaagaaattgagaggttaaaaacctgaaagtagaaggcagcaaataaaaaagttgaacttgagggcaaaaaaattatttttagtttaaaaataaagacaactagggatttctttatatgcctagtaaacaaaaatatattagaagataaagaaggcttgttggaaatagggagactaaagataaaagaagtaaggatccacttgaagtttgaaaagggggcaatttaaaacaactagcaagaattaaagcaattggaaaccataaaataatggcaagctgctaggctataaaactgtatgttctatgaagatgtaagaaagaaaatatggtggaaaatggggaaaaaaggggaagtttataaaagctccaagctataatcaagtgaggttgaattctggctaaatgtccctgtggagatgtgcaaaatgcatacatttataggagcccatttactttcacctgatcttaggccctgcctgtcagtgtgccacagacttgcccagattggcaaaaaattcatgcccttcggaattttccaaggcaatgtgctctgtgtctcacagtctttccccctcagacttgctccacagcatagataaacacttattttggttcgaggaagagcatttaagtactggcattcattcaaaatatcatttgtatcagtgacattttggtatttattatcatttataacagcaactgttttgtataaatataagtagacctttctacttgacaactgtgacctttaatttcacctggactgcacatattatatataatggagatttaaagagtattatagaaatggatagggggtatcaatttcaaatgtacaatgtcaaaactactagctgcagttgaaatgaaatttatatgtggacacaatttttttttaccttttttggttttgtttttcttttttaaattatttggagataatgagtaaaattctactatattctggtagcatcactctgcaagatttactctaccatacaaatgtatgttttttggtattctattttgaaaggttgtgttgttataatattggtattgaaaatattgatgagttaatattttaaaacataagttagtatttatttggttaggatgaagcagttgatgataatgacaacttttaactgcaggtaaaattgctaaataatacataattacgtacaacttgtggcagctttgtatttagagataatgatgtttaattgggtgtttttcttttaaaatgaaaatgagtttattctttttttaatagagtaatgcatgctcccctttacttcacttttcaaataccaaaacagataaaccctattaacaatttggataaccattatccttttagaaatccctacaagccccatccctccacacccagtcaggatcatataaagactattctgaaacttgctttatgcagttaagaccttgtgactatccttctgtgttagccattccatccttgtttatatatctgattaatattaataaatcatatataataatatatcatcatttttataaataacagctctgattatattttaatatagctctttatgtacttgtctgcttcatttggatttctttgtaatttatgagatttttgtacttttcctatttgtattagatatttatggatacaatatatttctggggttaagttaccttctagaattaaactacgtctatctaagttaccttctagaattaaactaagtctattaaactaaatctatttaagtgcttaatttaaggaaataaggacaatagatgagaagatagttcttgatgcaataatatttttatttctatgtattatatagaaacatgttaattattttagctattgacttgtagtgaatttattttcttctactagagtatatgtgagggtaaacaggaatattccattaatcattgtaaaaatgtatatacattataaatttcataatgccaggatataatgtgataggtataaatgctttcacttaataaattttatcccaagtgtgtcaagttatattttttttacattaaagtaaaaagaatttctgtctgcctaatttccttctacacctttttcatttatggaccactttaactcatggtgattagaaatccttcctcatcttatctcgaaccctcatctcagctcctcgtggactgaggtttattaaatgatttcctgacggccattttgaagactatttatcacctgaaccatgctgccatcccatctgctaccaatataaattgggatgccttatgttgcgagtgactgaaaatgcaacaaaatttgatttaaagatgaaatgaaattattggattaattaattaaaaagatcagaagtaggaatagctgcaggttaagcttgatttgctgccttaaagatattaccaaatacctgatcttaactgttttctgtcttttgtatcagcattatcctcagttcttctttcatggtagcaaaatggctgaagcaattttagacatcatatgctttcacaatgctctctaggaaaagagactctctttccattatctttcaaagaaacaaaatgtaagttctctttcctgcaagcttaggcaaatgcctccctgtgttgcattgactaatcaaattaagtgctaccccagagttgaaaactgttaccagggagaatgaccactgtatcaagaaagctatcaaaacttaccctaaaggtggggataagtttgaactgataatgaaaggagagggttgggggaagattcctttaaaaaatgcctgggtattattaccagaaagaaagggaatgatgctaaataattatacattgtactgctcaagtttccatcactggtgtctctgagttttggcaccgttgttttaaagaccctgttcttgtactatttagtattgcatagtacaaataaaattaccactgatatcaggcattcagccttttatttggcaatattcatcaaatatactcagaacgttgttctatgtcctggacagaccaaacaaaagaaaacacatctcatgatagtttaagtattagattaaatgacctacataatagtaggtgatacgatttctggagcatggtatgtcctcagtagatgatagtctttcattttgcctatttagaataggcagccctccttttcagcaatgtagtgacctgagacagggccttatcaactatgaatatatctttaagacattctttacctactcacctggacctctaagtgttacttatacctattgaaactcacctttgatttctggtgctgtttgacttgagatggggctaatttgttgacaggatgattcgatctccccactgaatctctgctgccatctcttttctgtcttcttaggtgctcacctgtgtgattctagaaggcgggtctgcttcagctctgatcactctctattatcccttcattttcctctaagtaaacaatcattaatcaatagtgtatggtaagagacagcagttttatgtagagaagtagattactcatttgactggggcaagagcttcaggtaaaataaatgattgatactttaagctcactaaattgaaacaatagccatcacattgtatgctttgctgtggtgattcctcagggatctagaactagaaataccatttgacccagccatcccatcactgggtatatacccaaaggattataaatcatgctgctataaatacacatgcacacgtatgtttattgcagcactattcacaatagcaaagacttggatccaagccaaatgtccaacaatgatagactggattaagaaaatgtggcacatatacaccatggaataccatgcagccataaaaaatgatgagttcggctgggcgcggtggctcacgcctgtaatcccagcactttgggaggccgaggcgggtggatcatgaggtcaggagatcgagaccatcctgactaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtctgcagtccggcctgggcgacagagtgagactccgtctcaaaagaaaaaaaaaaatgatgagttcatgtcctttgtagggacatggatgaagctggaaaccatcattcacagcaaactgtcgcaaggacaaaaaaccgaacaccacgtgttctcactcataggtgggaattgaacaatgagaacacatggacacaggaaggggaacatcacataccggggcctgttgtggggttgggggagtggggagggatagcatttggagatatacctaatgttaaatgacgagttactgggtgcagcgcaccaacatggcacatgtatacatatgtaactaacctgcacattgtgcacatgtaccctaaaacttaaagtataattaaaaaaaaaaaagtcccacagcctttaactccttttactgactgtgttgttattttctatacaatattttcttttcttttcttttcttttttttttgagatggagtctcactctttcacccaggctggagtgcagtgatgcaatctcggctcactgcagtctccgccttccaagttcaagtgattcttctgcctcagcctcccgagtagctgggattaaaggcacctgccaccacacccagctaattttttatatttttagaagagacggggtttcaccatcttggtcaggctggtcttgaattcctgatctcgtgatccacccgcctcggcctccaaaagtgctgggatttctatacaatattttctatattttctatttccagatagagtagaccaaagtaattgatgacctcataagcatgtttcataaatgtctctgagagattcactatgtcttattaaacctttgcctgaaatcttcttgcattattagagagaattaaggtcaaaaacaaggaaggaaaagaaataagcagttttatttatctacccatccattcacccttctacactttcatccatctgtccatctaacctctatttactcatctattgatagactagaaagataaataccaaaatgtacgggatataatctcctggtatgccgttggaataaagatgttctttgaaaccaacgagaacaaagacacaacataccagaatctctgggacacattcaaagcagtgtgtagagggaaatttatagcactaaatgcccacaagagaaagcatgaaagatctaaaattgacaccctaacatcacaattaaaagaactagaaaagcaagagcgaacacattcaaaaactagcagaaggcaagaaataactaaaatcagagcagaactgaaggaaattgagacacaaaaaacccttcaaaaattaatgaatccagcagctggttttttgaaaggatcaacaaaattgatagactgctagcaagactaataaagaagaaaagagagaagaatcaaatagacgcaatacaaaatgataaaggggatatcaccaccgatcctacagaaatacaaactaccatcagagaataccataaacacctctacacaaataaactagaaaatctagaagaaatggataaattccttgagatttatcctggataaatgatttttactaggccctggaaaatttagacatccctcatatagcactttttgaaatctgaaatcctagttattttcatatcacttcaaacccttcctggagatattgggtccatccataataggacaaagtttctagtgtagtttatgggttttagtcctcaaccatagcaaaaggacatagctgcagtttggtatgattttaatataagtacttggatagattgggatacatttaataaatttagtgagataactaatcacattctttaactatttaacattttttttattattttatttttttacagatgatagtcatgtacattagtataacatgctgtcaccattggtgaggcattcaatgaactttcaattgtgaatctttaatgtccttgcaagatataaattcatattaaatttcaacgtaatatggaatatatttgactcggatatatgtaactggaaacaactttaacttggatatttgttaaagctcagggaccagcaatgtgggttttcgcgttacactgcctacactatcacttgttgactgtgcaacctttgtattgataactggacttagtacaggcataattttttaatctgacaagtgtacttgaccatgaaacatcaactttactgaactgtgagtggattaagtgagaaacatgtgtcatatagtaaatacttaatggaatatacctatgtttacctagttataattaatatgttacttgtatttctaaatatatttccaatcctggaaccaatttatagttcatcttattgaaaccaaagtttaaaacacttgctttttcattttgtgatgtttaaactgccatataagtaattctggtttataaaagcatctcagttatgataataatagcattttaattttgaaagccctttggaaaagttattttgaatattaaaatattaaaaatgctaaatggcatttgggtatatgaatatgtaagtaaaatattaatataaagttcttgacttatttttaataattatctctttcatacaacgctatcctgttggtattcagattttacacattgactgacattcagactgacttggcagaatatttttatatgacgttattagctttttatgacaactaagcaaagagagcaccagtaagtaactagattctttgagctaggatgattctcaaatcccatcacttttaaaatatcagtgaaaaaactaacatgatttgaaggctagtttaaaataaaataccatcgtttcgagatttggaaaaaatgtatagttaaataaatcacttagtgtcttcttgaactataattctgcatttttgttaggggtaattttaaataaattggttctaaaggcaaaattcaatttaagaaaataaatgttagatttttctatagcataattattatttcctttttttaaaaaaatcttatttcaccctcaagcacatcaaaaagaatagttgccacctagaaagggcctttgtgctttgtatgtgtatcatgctttgtttttctctggtatttcttatcttcatataacaatagcttttagcattgtattttaaattaaaaatgttctactatcaaacttattctagtgagatttcttgcctttcaaaattacagtattttatttcctttaagtgtctcatattcattctgttttcacccttgatagatgtaaagtcatattatagagctatataaaacagggtggccaatctactaaaaataaaatacaaaagcatattttttttcaaaatctcattttttagtaaaacatttgcactcacaatactttagttttgagctttgttttctttatgaagtccagaaaaacattatagatgtctaatttttctcctctggagaaaaataaaataaaatatattacaccccttttatagagaagcacagattatattttagcttaattagctaaaatcacaacagtcatggttatcaatgaataacagtcatacttacagtatgttattgcaatggtgaaacaaattttcagtggcactgaaaaggcaataagaggtagaattcagttaaaattcaatgatgagggaaagaagcatataaaggggaaagaagataaacaaactagacttttgaacaaggtggagtatacatttactgatttttctgtagtatgataaagttagagagacagacaaaatggacttgaaacaaggtatacatcagttgtcatatcgtattgcaagaaaaaattattttttgcactcaagctacagagccctaaacctatcaggccatgtaagggaagtgcttcctgtattaattactaaagaccatgtgagggaactgcttcctatataattactggaaaaaatgatgaaagattgagaactattgattcacatcacatagcataaactttgtgtgaactggcactttaatttatagccctaaaaattcggctaggagactggagctgtcactggacctttgtacaagagaagggtgtggctgctaaaccaagagattaagagcccagcactgtgcaggtcagattgactccatctggcccctagcagtttcaccaaacactgccaggattttccaaaataagtatcccccatcacatatcattactttctgctgaacagattataaagtactatctccaggcatttcctgcgtttattgggaactggaagttttgaatcctcattgacttgaaagagactgccaacaatcaaacctagtcattatggcactcccaccaagactggaaatagccccaaactgctgctggtaattcctgatatcctcagctttcttatcttccatacatattaattttgtcagcagggtagttctttagggccctcagagtgcttctggaacctgtggagattcattaatggagtctggttgtaatgcattcagctaactccttttaaagctatacctgatgtcatgctgtctgttctatgatcctcttttccactgtcacgtgtgtatgtatgttttgttttgtctgtttcttgttttatcacctaattgcttgtctttttatccttgacttgctgttttgtaaagaacttagcatttatatcttctatgcttctctatgccctatattttcaaaggctcattccaaacctaacgtggtcatacactgtggctgaaccatattctaccttcaatgaatgcaccactttgaggatggggacctacaatttttgaagtctcttctgtatctgtgcttccaatattccatttctatgcatgttctcaggcaatttggggttcacacagttataaaataagtttatttctcattcaaacctgggcaatggagatgttcctatttcgatagcttttctgagcatcttttttttttgcaagtggtgacccatggaatctcagggatttaggatctttctaattttgtaatactggtgtcttcgacacatgaccttcaagattttgagaagggtgaaaacagaatgggatgggagttttatggccagccctgggagtgttatacattttcagagctagatgcaaggaagactggacaatgtgtgctaaagttaaagcacatagcggaatctctgtcacatcgtctttctgctttatacttaagctggtccccttcatatttatgaggtggctgcttgctgtataattttatacttaagctggtccccttcatatttatgagttggctgcttcctgtgtaattactaacaggccatttgcagcagcaaatgttatatccagtgggagagaggaagaaaacttctctctcaatcatagattgcaaatcttttcttatagctttggtcagaaagtatggaggaggattgagcaaccagacaaaattaggattttgtaaggagaggaaggagcggtaaatagataccagacagttaatctatcgtgagtatgacaaagaatcaagacagaatggtatcacagaacaaagagagtagagagttttgaaaagatggagtgcccaaacaggattataatgatgctaattttagaaattagatggtccttggaagctccgtataaatagtcccaaagaagtcatgagattatttctcacattatggtttatggagaagtgcatgaaagctgaggaaatgggcccttggtatttattcataatgctgtgctccatgcagttgactttacttcctaaataaatgttgcattcttgatgaaagtttaggctaaatacagtgagccctcaactttgaagataatataagaatattatcataattagagtttacatcatttaaaaatataatttgcttcattaaaaattactattagaaatttataattttgtcggcatatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtatatttttaacttttaaaattctcagaaatctaaagtaaattataattttaacactgaaattatttgctagtgaagatacaaatctatgctaattgctctaataacctagataattaattattatgcattcctaaaatggaatcctattaagttattttactatgatggatgtaatcattttgataataagtaacctacacatttttctagattaatcacagatgctcttctaaagttgtcttaatgtgatgaattataattgttcacttataagcatcaagggtttttaaactctcttgataaccatattcaaattttatcacctagaggtagatttatatttttattcaaaataacatgtcaggtgttatgcgtcttattttctgcaaaatagctaacttgtatgtaattctgaaataaactaaataaatattcaaactattagataagtagtacgtatgtatatatatatataaacccattctatctgaatcaatttaaaggttacttaaattaggtctttcttggactcagtagcccctactgatatcttcaaactgcactttatcctccaaagtcactcaattctttcaaaacaagaaagcccattatttaacagcctcacattgttagatgcgaggaagtcacattgatgacttccttttacctaaggataaaaaccaaagtcctctatacttcatcctctacctccctagctagtctattgccctgttgctctcaactggagtatttcctaagccatatttgtacacctgctgtgtccctgatgcgagcataaagtatgtgagtaaaaaatgtttttgaaatattatctgctttttaaaatgatgtaattcctttttttccatttcctttatcccatttgaaacagtttggttctatacttatgcctgggggaaaaatatgacagaaaaaggagatgggggagtttaaaaatatctttcttaccttggcgctttaaagtgcttaggagcagaaaaggctcactgcatagctacagcacatcagaacaaatataatgagttaagactcatccaccccttttccctttaccttcagataattttatgggagccaggaatgcaagagatctgttcttcatttcctgacaagaccccagaaaagaaattgttgcattgtgtgtctagacagataccatcacagagtttcagccctccggtgtgaagtaggaattgctcaatgattcctgtactcccaagaatgaaaatgaagtggcagaaagagagctattgaaacaaaataggccatagggagaggagggaaccagaagtttccactgagacttgtgtgatatattgataaattatttaagtgatgcctataaagccggatgatatttaggcttttatggtgttacccccagtgttggcataaaatgggaaaccctaagaaattatgctcaaaggaaaaattcagctaatgcagagaaagattaagaacctacatttcttgcattcttgaaattacactctagaattcacatcagctgtggaaatttatacttacttctttgtgtgtatttaagtaatggcataataaaaataatcaattcaccactgaggtccaatcatttcttcccttcaataagtgcccatacgttactaacatctgataacaaaatgaagcccaagttcttttgtaacattttatctttttcttaaaaaaatgaacttatcttagtgcttctttatttttaaagagaataatctacatttcttacttcctctggaaggtctgactccagagaaaggttaaaggttgcgctatatacccctaagtcttttcttatttttattttctccttcattccagaatatctatttagctattgatatgtgccaggcactattttaggtggtagaattccagaagtaaagacagtctctgtcctcaaagaactcaaaatctaactgtatggcatacttagaaaaataatgcaataaccacataagggggcctcctaaagcaaactgtgatgtggaaatgaatgtcaaaaaatctccctatcataggtagcctttgagtatagcattgagaaatgtgtatatttgatgagaaatacttttttggaaaaataattatgttgtttttcattaaatggaaaaaatagaaaaaagtttcaagatgataattgattttcatattaatgaatttatttaattcactgtgatctaccatcaccgtttgcattaaaacatttctgaggaagtcctagccaatgcaatcaagtaagagaaaaaaaatgaaaggcattgaaataggaaaataagtcaaactgtctcttcactgatgatatgattctatatctagaaaattctagagtctcttctaaatggctgataaaactgataagtaattttaggaagatttcaggacccaaaatcatacaaaaattggtagtatttctatataccagtaatgcccacgctgagagtcaaatcaagagcatgataacatttacaacagcggcaaagaaaacaaaatacttaggaatacagctaaccaaagaggtgaaagatctctaccaggagaattgcaaaacactgctgaaataaattagagatgacacaaataaagagaaaatcattccatgttcatggcttggaagaatcagcattgttaaaatgaccatactgcccaaagcaatttacagattcagcactactcttatcaaactaccaatgtcatttttcacagaagtagaaaaagctatcctaaaattcatatggaaccaaagaagagcctgaatattcaaagcaatcctgagcaaaaggagcaaagctgaacacttcatactacccaatttcaaactatattataaggctacaggaaccaaaacatcattgcacttgtataaaaacagacacatagaccagtggaacagaatagaatagaaaactcagaaataaagccacacacatctgatctttggcaaggatgacaaaaacaaatggagaaagggctccctgttcaataaatagtgctgggacaatcggcccgttatatggagaataatgaaactggacccttaccttttaccatatacaaaaattaactcaagatggattaaagatttaaatgtaagacctaaaactatgaaaattctagaagaaaaccctaggaagttcccttcttgagatgggccttggcaaagatttttggactaaggcaccaaaaggaacttcaacaaaaacaaaaattgacaagtaggacctaattaaatagaagagtttctgtacaacaaaagaaattatcaataaactagatagacaccctacagaatgggagcaaatattcacaaactatgcatctggcaaaggcctagtatctagaatctgtaagaaacttaacaagcaaaaaacaaataaccccactgataaatgggcaaaggacctgaatagacacttttcaaaacaacacatacaagtggccaacagacatatgaaaacatgctcatcatctgccatcatcagagaattgcagatcaaaaccatgatgcaaaaccatcgtacaccaggcagaatggctattattatttgaggcatgttctcactctgttacccatgctggagtgcaggtagcatgatcatcgcttactgcaaccgcaaagtcctgggctcaagggatcctcttgcctcagcctcctacaggaagctgggactacatgctgaggcaggtttttttttcctgtagagacaaggttttgctttgttgcctaatctggccctgaacttctgggctaaagcattcctcccacctcaacctcctgaagtgctgggattacaggcatgagctaccatggctggcctgattggctattattaaaaagtcaaaaaacaacagatgctggtgaggctatggagaaaagggagcatgtacagtggtggtgggaatgtaaattagttcagccactgtggaaaacagtttggagatttctgaaagaacttaaaacgagctatcatttaacccaacaatcctgttactaggtatatactcaaaggaaaaccaaaaagacacatgcatttgcatgttaattgctgcactattcacaatagcaaagacatagaatagacataggtggctatccatggtggactggataaagcaaatattatacatatacactgtggaatactatgcagccataaaaagaacgaaatcatgtcctttgtggcaacatggttggagctggaggctataatcctaagcaaattaatgcaggaatttaaaagcaaatagcacatgttcttacttataaatgagaactaaacattgagcacacatagacgtaaacttgggaataacagacactgtggactaccggtggggggttaggtcaaaaaactgcctattgcatactatgctcactacccgagtgcaatatacccaagtaacaaacttgtacttgtgccctctgtatctaaaaaaaggtagctataaaaccaaaaaatcatttctgaaatgctgaatagaaaccttaaaattttctactgattcatacccttacttttaaaaaagttagctttaacattttatccttcacctgttgatatgatttggcttggtgtccccacccaaatctcatcttgaattgtactcccataattcctatgtgttgtgggagggatgcagtgggagataattgaatcatgggggcaggtctttcctttgctgttctcatgataatgaataagtctcatgagatctaatggttttataaggaggagttttcctgcaaaagctctttgcctgccgccatccacataagatgtgacttgcttcttcttgccttctgccatgattgtgagtcttccccagccatatggaactgtaagtcaaattaaagctctgtcttttgtaaattgccagtctcaggtatgtctttatcagtagcatgaaaatgaactaatatgcctttgattaaaattatgcctaagaatgttaacatttactcctagaaacaaactctcttcagcaatatatagtgcctttgtatgtaattcttctgtagcaatcatacaaaaaaaaaatgaaagcacacatgttttcatagtatactctttgttttgagttgaattgtgtctcccaaaacaatatgttgaagttctaatcccctgtacctgtgaatgtgattacatttggaaataacatttttgtaggtgtaaacaagttgaggacattttggattagcatgagccctaatgcagtatgactgatgtccttattagaaaagaagagacacaaacatacgcacaaacacatacacatatgcatgtgcgtgcacacacacacacacgagagagagagagaaatagagaggagagagagagagcaagagcaagagagagagagagagagagagaatgctaagtgatgacagaggcagagattggagttatgctaccacaagccaaggaatgaccaggactattggcaaccaccagaagttaggagaaagtcatgggatggtttctctttcacagcctccagaaggaatatgctgtgctcgtaccttgatttcagacttatggcctccagaactgtaaaagataaatcttggccaagcgtggtggctcacgcctgtaatcccagcactttgggaggctgaggcgggaagatcacgaggtcaggagattgagaccatcctggctaacacggtgaaaccccgtctctactaaaaatacaaaaaaaaaaaaaattcgctgggcgtggtggtgggcacctgtagtcccagctactctggaggctgaggcaggagaatggtgtgaacctgggaggcggagcttgcagtgagccgagatcacaccactgcactccagcctgagtgacagagcaagactccatctcaaaaaagacaagataaatctctggtgttttaatccatccaacttgtattactctgttacaacagccctaggagactactactgtgttctaattgctctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaagagttcacaatagtcatgtttggaaatgtgtcattttacatttatagtactcccatgctgtaatgtgttgtttaaaatttatgtgttaccattacaaatggtaaagttagcatgactacaaagtaaattattgtttatgcttttctgcgtgccctgggaagacttgcatttgtggtcaacatcaatgaagcatagcaatatcttttgggagtatcattggaaaccaatattcatgatggatgatgcagccttataagcaatagtgtgagcatcaaataaatggaattagggaactgcagagccaagaacatctatattgttcaatataaagaggttctaaagatctatagcattgctatctttttcctgtggctggctgtaagaaattagccaggaatggcatatttgacagaaaagaacaaagaaattgttccaggtcctgaataggaggagatgggggcctggccactataaggaatctttaagtttgttgattggataataaacacagatgtaaacacttttcactctccattattcgaaagctttattgacaaatcaaggtatttcacatgagacaatatattttaagtaaaattgttcatgtagacaggaacctaacaaaaaatatttgcttgggctacctaatttctagaggcaatcctgtcaacagctatttaaaaaggggggtgggaagagagaactgggcagagggaaaagtggacaaagcctcaggcaatccagtggggttatgccccacatctgactgaaatggtttggcctttacacccctgcctctctcagttactggtccctggaggaatatgaccttatacaagttggctctctgtggctgagacagagaaggtgaagaagctgacagctggagaccatctgctgtttgcacaccccaacactgggcagcaaatcctttcttgaaatgggggtctgggcagcacatctttgtgtctaccacaaatataatttcaggacttagtttgagagagatctgtaaatgaaatttaaatatattctaaaatgcccaaaacttacatgccaaatatatatatatatataacaaacttatatatatataacaaacatatatataaaaaaactaatatatatatgttttaggcattttagaatatatttaaattacatatataaatgtatgtatttatatttgttcaaaattatggagaggcagaggcaactaattattgttaatttaataactattaatagcccttgtcttattaaatttaaaacactttgtctaaaatacttgatttcccaattactaattgatatggtttggctgtgtcacctcccagatctcatcttgaattgtagttcccataatcctcacatgtcatgggagggacccagtgggaggtaattgaatcatggaggcagtaaccctgatgctgctgttctcgtgatagtgagggatttcttacaggatctgattgtttataaagggcttttcccccttttgcttggcaatcctcctttctgccgccatgtgaagaaggatgtgtttgcttccgcttccaccatgattgtaagtttcctgaggccttcccagcgatgtggaactgtgagttaatcaaacctcattcttttataaattacccggactcaggtatgtcttcattagaagcatgagaatagactaatacagtaaattggtaccagtagagtggggtactgctataaagatacccaaaaatgtggaagtgactctgaagctgggtaacaggcagaagttggaacagtttggagggctcagaagaagatagaaaaatgtaggaaagtttggaacttcttagagacttggagggcttagaaaactggaagatgtgggaaagtttggaacttcctagagacttgttgaatggctttgaccaaaatgctgatagtgatacaaacaatgaagtccaggctgaggtggtctcaggtagagataaggaacttgggaactgaagcaaaggtgattcttgttatgctttagcaaagagactggcagtatattgcccctgccctaaagatctgtggaactttgaacttgagatagatgacttacagtgtctagcagaagaaatttcaaagtggcaaagtgttcaaaggaagcagagcataaaaatttggaaaatttgcagcctgacaatgcaatagaaaagaaaaccccattttctggggagaaatttgcataagtagcaagagactgaatgttaatctccaagataatgggaatgtctccagggcatgtcagagactttcttagcagcccctctcatctcaggcccagagacttaggatgaaaaaattgttttgtgggctgggaccagggcccccttgctgtgtgcagcctagggacttggtgccttgtgtcccagctgctctagccatggctacaagaacccaaggtaaagctcaggctgtggcttcagaggattcaagcccaagccttggcagcttccatgtagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgacctggatgcgagacatggagtcaaaggagatcattttgaagctttaagatttgacttcctgactggatttcggacttgcatggggcatgtagccccttcattttggtcaatttctcccattttgaatgggtgtatttacctaatgcctgtactcccattgtatctaaaaagtaactatcttgctttcaattttacaggctcatggttggaagagacttgccttgtctaagaagagactttggacttggaattttgagttaatgttggaattagttaagacttttggggactgttggaggggcatgattgtgttttgaaatgtgggacctgtgatttgggaagggtcaggggcagaatgatatggtttggctgtttccccacccaaatctcatcttgaattgcagttcccataatccccacatttcttgggaggtagcttgtgggaggtaattgaatcatgagagcagctacctccatgctgctgttctcatgatagtgagtgtgttcttacaacatctgatgtttgtataaggggcttttcctccttttgcttggcacttctccttgctgttgccatgtgaaaaaggacatatttgctttccttttgaccaggtatgtaagtttcctgaggcctccccagccctgtggaactgtaaatcaattaaacctcttttccttttcttttttttttttttttttttttgagacagagtctcgcttgttcacccaggctggagtgcagtggcgcgatcttggctcactgcaacctctgcctcccaggttcaagctattcttctgcctcagcctcccaagtagctgggactacaggtgcccaccaccatgcccagctaatttttgtatttttagtagagatggggtttcaccatattagcaaggctggtctcaaactcctgaccttgtgatctacccgcctcggcctcccaaagtgctgggattacaggtgtgaaccactgcacctggccaattaaacctctttctttataaattacccagtctcaggcatgtatttattagcagtgtgagaatggactaatacactaataaatctgataatgttacaatttttaaataactaattttctacatcacttcttctccacacttgggttttaaagtgctttcttaaatatatccatgtctatgtatatctacatctgtatctacctaggtagagcaataatagatttataatagatctaccagggtagatacagatgtagatatacatatctatatattcttaagtttttatttgctacaaattttataattatctaggttgtacatgtgtttcataaaaaataatagtgtaattataaaattaataaaatagcattctgttcttatcctcatcaacttgcttctccagaattaaacacttttacctatttgtctgttacttatctccacatttctaaatagcctccttttaaaatggatttttctggtttaaagtttgtatctctatttcttaatatcggtatcttaacatagaaaacctatattgcttaaatcatcacacacttcttttctctttattcaccctcctatgcactttctttctctccagtctcccaatttgtaattatatcataatgtatcactaattcaatttttagtgttcatataatactcaatatttagtatttacacaatatgactatggaagtactattttcagttgaatcaagttatgataatattttatttttgtacaaccttttttcctggggttattttcattattttctcttgtttaattctatacacctactacgaattcatcctcaaactttttgaaagatgtgtaaaacttattttaatcaaattggtttcatcttctttcccccttggagatagagatctttccagcacccctttggctctgatctggaccacatgctgtctaggttggctgcacagatgtcaacttggagcctccttttggcagcaccttaagaaactttttggcatctctttgttgaatcccactttctggacaccatattttgttccctcttgaattatcttctcatattgatggagtgcattctccatcagctttaggagaaagaaggcaaagaacttgaacattttgagaacttctatttctgaaaatgtctttattattctgattcatacttggttgaacaaatttctaggttaattttttttccttcagaatgttgaagtattgctacaatgtcctaaacttgagaatgtgtgtggggttgtcaagaagacctcatcataagggtgaggaacagtatctatgtaaaggttagaatctacaggtgttctctctaggctggtttgtgttttccagagaagaaggatccagtgctctgctttggctgaaagagagaagatgactgtacagtctcactattcagaaatcaatttcagctaacctctgattctcacccttcctctcagctgtgcctggtatccttaaagctatctctgccatggatcaatgtctttagacagtgaatcttttgcctcctgccaaggaggatgtgtagtttagggaaggagattggagtctagatgctactgatgtaaagtttctaccagtctgcctgttttcagctttactcagtgcctcataatctcatatttttcagggttctgagagaaaaaactggtttgcttcttgtgagtgttacccctacaagctgcttggttttagctttctcaggacagctaaattggttaacattcatatgctttgcagcttctaaaatgttgttctctctctgcttctgttgctcttttatatttcctttaaccttgtgggatttttgtttattccttattgtcattttagctgagatttaaggagaggaatttagcatcttcatttaatgtattctttaaatcacaacttctgatcaataataatttctgcctttttgcctctccattataatgttcctctccctgaaatagtaaatgtcaggaatagcacaaaattctgatcaaatatggcagagtgaaggttttcattacattttctactccaaaagaaattgcgaaaaacaaaaattacactaaaaactcaacacacagaaaataagacaacaatttaagtgaaacggaatcagccacaactctgaaaagaatactttaaaaatagatcaggagatacatgaaatatacagaaaaacatgcaacaagctgtagaagaaagggtgccaagtgcacacccatctgtatatttcttgcagcacatagaagttttctaaaatacattcactatagaaataaaaattaaactagtagcagcaacatataagctctgctgaaaggtagttatagatatggatgagaggcttgaaaaaaatcaataaaaatataaaaacaaatgaagctgattagacaaggggaagaagaaatgaatcatgatgtaaatatcaaacaaggtggatattgatagaccatagactttgaaaatataacagaagagatgaagcttatatgggattttagttcaggacaaacctatgttttcaacgggcgcccatcagaacctcttccatggccaaagggtactaaatagagtcagtgggtaattttcaggataggtgaaactccaatattatgtttgcaatttagagaaaaataacatttattttctaagatactattataatacctagaaaaagtagtctttggcagggggtgggggtaagaattgagtaaagtttgatgttgtaaataaaactataaagtattttaaagtataatttaattttcagaatgggaaacctgttttggttttaccaaaatcgcatatattaacttttaaatttttatatatagtatgtaacagatgtgtgtgtgtgttctatctttcatacattctaatcttgaatgaatgatttattcatttaattgccttctcaatacagaataatttcaccaaaaattatacgtgtaaaaccagaagtgacttgttacttccctactgaagatattttaagtaaacttagcctcactcccctctttgacagcctgagcaagctggaaacctttcctgtaatcctttcttgtatctaaatcaggggtatccaatttttggcttccctgggccacactggaagaagaattgtcttgggctacagtaaaaaacactaactatagctgatcagacaaaaaaattgcaaaacaatttcataatgttttacaaaggtttacgaatttgtgttgagctgaattcaaagccatcctgggctgtatgttgcctgcaggccatgggttggacaagcttgatctaaatgaaagaagtattaactaatctgaaattatagattcttgaaaaatgtcctttctcagtagataagaattttatgtaacatgatacttggtattaaattctaatgagaataagttttacaacagatttaagttgagcttcagatactcaggctgataatatttctttgtaggatttaatttttattgacacattaatgaaactattctctactttagagcagtagggatgacataaatttcattattttaaggaataaattttattaaattttcattaagttactaaactgtaggatgtttaaaatgtttttaacatgatcaatgcagttaccatggatattgctctttattttaaaaccacctcagaataaattgtggtctgctggtcaaccaggcttcccttctactcctcaaaaaagccctgatttgtagaatttgctgatttctgtattaaaccctgcattatggctgattttgagctatcaatctgatgtcactgatggtgactttagggagaaaggtgaacaatgggctctccttggccatgtgagccagctctagcacactactgcattaacacacaggggtgcatcacttaacaagctgagtgtgttctgagaagtgtgtccttaggtgatttcttgtgtgaacatcatggagtgtacttacacaaacctagatgatgtagcctactatgcacctaagttatatagtataggctattgctcctaggctataatctgtacagtatgttactaaaataaatactctaggcaactgtaacacaatggtcagtatttgtataactaaacatagaaaatgtacattaaaaacatggtataaatgattttaaatggcgttacctgtgcagatcacttcccatgaatggagcatgcaaactggaagttgctcaaatattttctttctttatatccttattctttagacatttttttctatttttaaaatgctttataatttttagttttttgaaagtttttgttaaaaagtaagactcaaatacacacattagcaaaggcctactcagggtcaggatcatcagtcaatatcactttcttccacttccacattttgtcccactggacgatcttcagagattatcttcagagataataacaaggatggagctgtcatctcctgtgataataatgccatcttctagaatacctcctgaaggacctgccttaggctgttttagagttaactctggctttttaataagctagagtatactctaaaatgatagaaagtaaataataaatatataaaccagcaacagcattatcattaccgagtattatgttctgtacataatcatctatgttatacttttctgtgactggcagcacagtgggtttgtttacaccagcatcacaacaaacgtgagtattgcattgtgctgtgacattgtggtgtatgacatgactagggaataggattttttcagctcctttgtaatcttatgggaccaccatagtatatactgttcatcattgactgaaatgtcattatgtagcgcatgactgtaatcatctttgtaattttcttttttctcaaaatttatatacacctttaaaaagtcaagtaggaccagaagcatttataatgaaaaatgatccaaacctcattctaccaacatccttcccagacagaagttactctcttgaactgtttctgtttttagttctgccagttattatttcttcccaaatctaaataatttgctgtaaggctattttttgatttggcaataatatgaacacttccaagtctttcaattagaattattttctattatctagtaactttctcccctctattttctctgttctctacaattcctgttagttggatttaaggtcattataagtgatactcttgtcttttcttccatatattttattcatcttttctgctgtttcaacctttttttgattttatgtaccaatcatgtgtttgtatatttgtgctttttctcattttttcttagcattgtcttcttgcttaaataagaaaatattacttgaatttatgaatctaattaaagttatttataatcttttttaattcctgaaatatctgtttttcttttaagttccttttttcctcttgagctatatccttttattgctggttttcacatacttgttgaccttttgttgtctattcatatttagcaatgtgggatgagtatgatttgtctgctgaatgatttgagtgtcctctttacctatatatgaagttttcacactaggacattttaacaggtctttgagcacctttcatagatgtgcaatgtgctcaggcttcaatttgggatttttctggggaactcccaaatgccagaatggagaagccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgtagcttcatttttctgtttgatataatgaagacttcagtctgtcttcatttacccccaaatttttgaaatctctcattcatcaaaaaggtccttcttttttactaatttttctgtaattttattccatttttttcctacacaatcatatgaatatgaattggaagtcatgatctattgcacagtgaatccatttggaatcttacaatcagtgaaccatccctgtacctctttgggagctatgtacattgtatcttgtatatgtacagagttacgttttttagattttgatacaaacacccaaaaaaacactgagcaatcccattagggtttttgtttgcttttaaaaaatactggcatcaagaaattcttttattctaaaagtatacctatttgaaaaactcatatccaaaattctggtttgtaaaattatgagcattatatatgaagtttagaggacatttatggagattccttcatatagaacaaaacaaaatcttataaattattataatgtcatgttactggatatgatttcttttttaaaaaccacagtcaaaatataaatctgcattctttaatgcttcctttgacaaaacaatctttagaaaacatttattgtcacactactttggcctgaactatgaattctaatttaatttttatatactctgtgttaaaaataatttgatttggggagaaatttggaggcgcttcaaggcaattgacattatgaagacaaattctgtttatttcttgaaagtttctcttcatatgagtttaattgaatttttttttttttttttgagatggagtcttgctctgttgccaatgctagagttaagtgttgccatctcggctcaccacaacctccacctcccaggttcaagcgattctcctgcctcagcctcctgagtagctgggactacggctacacatcaccatgtccagctaattttttttatttttagtagagatgtggtttcactatgttgtccaggctgatctcgaactcctgacctcaggatccgcccgcctcggcctcccaaagtgctgggattacaggcatgagccatcgcactcagctgtgtttaactgaatttctaaaacttgaatatgattttataataagctataagtttattctctcagtatttcaaaccatataatacaattcttatgcttctatcttataaccatttaaagttatttagttggttagctatttaaaggttaatcctatgttttaacaatattaaatactttatataagaaatgtgttcatattttatagtaaattatcaaaggaatacagccattcaaaaaataaacattatttgccacatttatttctgtgtatactgctatgaatgcaactcattattcttagaatatagtttctctgtattgtagaatatatacttctatgtgtatatgtagcttttatgtatatatgtgatattaaatgaaaattagcacatatatgcatgaatggatgtcaaatgtcccctatttttcatatatacacaacactaattcatatatgtgtgtatgtgatatgcacatactatctttttttgtatatatgtatatatgctttcaaggccagattaagcagaaggatgctcaaatttctcctccctcctcctatgcctgattattctgcaccagaccttcacttttattgagtagctagggttgggctgacacttttcaggctgaaaggcagaaacatttatcttcactgacaaacaatttgtgaataccttccttgggttgtgagacacttgctctaacacaattctcatctgttttattatggagtccctgcaacatttgacatcctcttactgaatttgcgtgttgtgaaccgaatggtaccataggttgattgtaatatatttttttaaagttcatgccaatttttctgtctttgaaatttagaaattaatgtgggattatttcacctgtattttttaggaaggaactctattaatttttcctctgaatataaatgtaatctgtgtttctattagaaaactatgagaatatgagaaaataccaggaagaaataatatctatataatatctatgatcctactaatcaatgataattgctattagtattttatatatattctttaatcatgtatttatgcataaacatgcatgatattaacttaatgctagaatcatgcagtttatgtttgcagacttttgtttgcttaattttgaatgacattaaaggcttggtttttaattgatgcatgatatttcatcttatgtactttctgacatgtgatcacctcctattgttgcatatttacgttatttttatttttgatattctgacttaaaccatgataaaattcatatgtaagggtttatgcacatctacagtagtttttagccattttttaaggttttgtatgtaacctgatcattcctttagcacatttaaaaaataatatccatttgtgttttcttattgatttataagtcattttttctacaatggtgttaatctttgggctatcttatatgttgcaaatgatttctacttttttggttgttttacattatgtgtattttttatatatatactgtaatttaaaatgtccactttagtacagcctctatggaaaactggttggcaatttctcgaaaggttaaacacacatctactttattatctagcaactttatgcataagtatataccccaataattgaaaacatatgcccacaaaagacttatacaaaaatgttaattacgtctttcttcaaaataacaaactattggaaataatctaaatttacgtcaaaaagaatagtttaaaatttgtgatatatttataaaatggactacaactcaggattaaaaggaataaactatgaatttacacaaaaacacagacgaatcccaaaaacatactcattgaaagaagcaagacccaaaataatgtatattgtatgattctcttgctgtgaagttcaacaactggtgtaaatgatttatagtgtatggagtcaggagaatagttgcctccatgaaggggaaagggaatgaaaggaaagagacacatttatttgtcacaaatcaacaaacgctactattatggggctgaattttgttcccccaaaattcatatgttgacattctaacttcctgcacattagaatgtgaccgaatttggagacagagctttaagacataattaagagtaaattgagttcattttggttgccctaatccagtatgactggtgttcttaaaagaagagtagattaggacataaagacacacaaagcaggaccgtgtaaagacacagaaagaagacagctatctataaaccaaccctgctaacatttgatcttgaatttctactttccagattgtgagaaaataaatttatgttattttattacctggtctatggcaaaaatcaaaaatgtttataaaaatgtttaaatatccagaacccaacaatgtaaaatcataatgtttggcatccaaacaaaaattacctggcataccaagaagcagaaaaacatgactccaaatgagtacaaaaacatcaatcatctataaatgatctggaaataacaatgatgatagaattagcatacaagtatattaaaacatttaaataactacatatcatatgttcaagaacctaaaagaaagcttaagcaagtgtagtagacacaatgggaaatataaaaaagacacaaattcaacttctagagacggaaatcatgtctgagttgaataatgtcacttatgtctgttttcctttgcatttatgctaagtgcatacaccatcctgagataaaaatattaaaacaaacttttttgtaatttctttgcaattttcatttcttattgaaatcataccttaaatgtattttgtatataatctatttttctgtattattaaacaatattcagaactctaattgttttgttacccatcactttctcattgatttgaaatgccagtttttaacatttatgagtgcaggtatgtgtaaatgagtatacgaatttaaaagtctctatcataagaagaaatgttctttagcaattaagagtgcaggctaacaaatgactacattctaactgtaaccttgaccacattttttttcatgagtcttgacagtaatctacttgtatgtaataaatgtcatgtggatagttgaacatattttacagggttgctgtgagatttagtaaggtaatgcaagtacagtcttgccttgaattataatagggacattttaagaaattttaaaggaaatttacaattaaatgttaaaggaaatttaaagcatattttatctattctttcatccagaggtatgtgagtgtgtgtgcacgtttgtatgtttaaggtttgtgtattggattttattttaaatgtttctattttgcctcttaaattttgacttagtcttttgtatagttcacattctttcaagaggatgttgatttttttcttcttgtttttactcaaatttgaataaagaaattgctatttggatcaagcattaggttgaactatatgaaatttcgtttttactgtgtaaaaatcctatatagtgggatttcatatggatcaacttaaaattgcttaaaaatcactgagggtagatacataaagaatctccagtaatgcaatggctgggtcaaatggtatttctaattttagatccctgaggaatcgccacactgacttccacaagggttgaagtagtttactgtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctacataaatgtcttcttttgagaagtgtctgtttatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagacccattactgggtatatacccaaaggactataaatcatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaagatgagttcatgtcctttgtaggtacatggatgaaattggaaatcatcattctcagtaaactatcgcaacaacaaaaaatcaaacaccacatattctcactcataggtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattaggtaacaattacaaaacaaatggaagcaatacataattccaagctatgatagtgaaaatgttctaacaaatttaaacccactttttcagagatcgatattgaaaatgactctgttttctttcaatatggtcccaacttctgtacatgtagcaaaaaatttgatgaaatgtttggatgatacatttttctaattaccagagtgattcagttttccctattttaaattcctttggtcatttcaatcaggattaggtaggatgtgatgttacagcctgtgtttaaattgacatcctatgtcaaatttattatatatgtccttaagaaattaggatttactttgattaaaatctttctgtgcctcaggaatgagtagtatattttatgattttctaaggataactttctctgtaatttaaaagaacaataaagtgtttatttccttttcttaaaaaaataaaattcactgattcagttaacctagagaaaacaaccattgtgcatagttactgagggagtatgttaataatcactttttaaaacaatgtggagaatgtctgcatcaaaggattctgccatcaccctaagtattttctccctatcttatctttttttctcctttgactaatagctttaacattgatttagttgaataaaacatttgacatttttaaggttcagtgcacaaaaaatactatttaccattcacagggttaggattattttgtattaaccaaaaaagtatgtatgtacatatgtacgtatctatttatctatttatctatctattatctatctatcatctatatatccacatacatacagacacacacataatcatcattgatatttaggatatttgtagttttctttgattagatatactctgtaaacactttgccagtagaaatgtactgtataatgtgacagtgatctataaaaatgcattttatttcattcaaacttaaaactatgcacataatctggttatcttctaaaacaggtgatatgcttctttagattaagatttgccttcttgtgctttcgggaagggtttgaacaatgagtgatatgtgattgaatttatggtgaagaggcagaaatgctcttaaatattataaattccgtagattcatagtacaacattctcttcagctgtgccaaaattatccctgtagaatgtttttatctagtaatagcagcgatgagtagttgatctcatggcaatgtgataccgcccctcatggacacctgctaaatcaccagtatctgttttatctgaagtcatagcttgtggtgacaatgtttaaatgctcattaagcacattaaacatagctaagttcaaagtgaaatttagctggccaaaaacttattactcgagtcttgtaatatgttttgtacaagtctttttcaacttgtacaactatcactgggtgtttatgaaaaagtccaaacaagttttcactatagaatgtttgtgtctttgtacccatcagacctatttggtgtttggcaaacaaagcaagcaatcatgatttttctgacttaaaaaaatgcatgattgagtgatttcttgctacaagaatttagtgcttcactgtgttacaaccgaacaaaaagtgaacactacagttgtccttgttaataaaccatactattaagcatattaatttttgctaaaagcgtggttaaacaaataataatacaagtacataattaatgaaaattattttcaggttgttactgatatttaaaaaataaaaacgttgtaattttaaacaacttaccaaaggacagaaatctaaatactaagtttggtataatgagtcttttaatttcatctttgtacaccactattttaatgtactgacatattttgtgtgttgtaatcgccttggtcagcacaatttttagataaaggaagtgaaataaatcgagtttcttattagcacaatgataccattatatttcttaatttttttttttttttttttttttgagacggagtctcgctctgtcacccaggctggagtgcagtggcccgatcttggctcactgcaagctctgcctcccgggttcacgccattctcctgcctcagcctcctgagtagctgggactacaggcgcctgccaccacgcccagctaatttttatttttttattttttttgtatttttagtagagacggggtttcactgtgttagccaggatggtctccatctcctgaccttgtgatccacacgccttggcctcccaaagtgctgggattacaggcatgagccaccatgcccggcccaaaaacaatcattgtatttctaactgaatctttatattacacaaagtctgaagttccctaaacttggaacttgggaatatcagtgtggatatacatttattacataattatcatttattttcataaatgtaaatacctttatataaatcaatgaaaatttaatattacatttcattttctgtcattatttcttttcatctttaattaacaaaagtttctcagcctttagttaattgctttgttaatgatttttcaaacagaattagaagactttaatatttaaaggaatatttccatattatgaaaaataatactttaaagaatgtttcatttgtagttcttcacaatttggagaagttggagaatgttcagtgaaatagcatataattatgcattttaattaaagtagccaatgctgtgacttaaaaaatggaatattatgcttcagactttacttttcaccgtaaataaaacaaccacagaaatgccagacagaacaggaacattatggtacctgcagtacactcgggttacatacacacaccaaaagagagaatgtgaaaatctagggagagggatggaagctatttgtgtgtgtatgtgcgcgtgcatgtgtgtgtgcgtgtgcacgcaggtgcactcgtagagttacaagtaaagactagaggggctttcctctgcatggttaatatttacatatgtgctaattctgccattgattaggtcagtactattgttaccatggtttttccttttttgacacttctgtcattgtttcatttacggtgaaaacgaaaggctgagaatgggggccatgaggaaacggaggtctgagtagtgagagcagtaggctgtttgaggatggatttggggagaaaacctgtagtctctagaggaaaatccctcaaaagccttaccattaggatgcagaaattaggacgcatagagtgaaaactgctgacagagtatgctcttgaaacatcttgggccatgcacggtggctcacacctgtaatcctagcactttgggaggctgaggcaagtggatcacctgaggtcaggagtttgagaccagcctggccaacatggtgaaatctcttctctactaaaaataacaaaaattagcctggcgtggtggcacacacctgtagtccaagctccttgggaggctgaggcaagaggatagctcgaacccaagaggtggaggttgcagtgagctgagaccatgccactgcactccagcctgggtgacacagacagactccatctcaaaaaagaaaaaaataatcttgaagattggaggaggttttggctagaatagaagagagaacccttccaagatgtataataaacataaagaacaagaatttcagacctctatcgacacacagctgaaaagaaagcaatagtggtttgtttctcttctgcaaaagcaggtggataattaacgtcttcccttgtctatagaaagaaatgtttttgacagttgagaaattgttttttccataatttaagtcctacccactgagttcttcctcactgggggttgacacgtagtaggcctggggagtggatggagataccaactttatggttaccatatgagtcccaggtgccatcgtctgtaagtaccacaaagtcagagttagtttaatccagcaaaaaaagtctattttcatagacaaattctcaatattaaacctgagctatacttgatgtattaaattagtttgatgagaatttttttctgtaattaaaaagaaacgtaacaagaacacagtttacatgggaaactgtctcatatataagtgaataagtaagaattgtaaaagtctttgctattatgtaatttaaattaagttagtgcatattaaattcttttgaagatggtacttgtggtcattcatccttttcatttttatttatttttacatgaaacctagctaatataattatttttacaaagctttactttcttcagtgttttcttattcattaagaagaaagcattatcttcacattacaatttatttttgggataaaaatttgtctagttcaagtttaaaataaagaaaaataagaaacaaaatattgttatgtattgctgctgtttttatttacttctttctttgtcagtaaaatcctcccagtaagccattgcattaccacaagtttttcaattacttaccctcactgatgtcactaattatgatgcattaaccatgagaatgttaatgcagaaaaataaaaacaacaaccagaaaaatcaaaacaacaaatactaagtataagaatattgcgaattaaaagatgcagaatatttccactgagattatgcaaatagaaagagaaaaaatgagttgatgcagctatgtatgtctctgatagttaatgttactgattatagttcttaaattgttgtttttttagtttgctcaatgctatatattttcttgttttacttgaattgtggaaacatttgtgtcacagaagaacaaattaatcccaatgtaagcagtagaaagtgaataataaaattaaaatgaatcaatggaataaaaaacagaaatgatagagacatcagtgaaatgaaaagctggttctttgagaagatttataaagttggtagatatccagccagactgatcagaaagaaagaagtttcaaattcaataacaaaaatgagtgatggttcattgctacaaattttccaaatgtttaaaagataatcagaaagtattaagaacaattttatggtcaataaacacactttgatgaaatgaacaaattccttgaaagacacaaactaccaaagcttactcaagaagaaatcgatgagctaaagagcccctaagaaattggttaggttgagcatctcattttatttcttttttatgaatggtcatttcatatcttttgcctatttctctattagactctcagtacttttttatttgttgggttttttaaattttatatattgatcccttgtcagttttagacgttgcaaggaacttctctattttttattggttaatttcaactatggtgtcctttattgaatggaaatgtttatttttaatgtacccaattttcctcttgtggattttaatttttgaattttattcagatctttccccattcctaggtaaagagatactctagtacatcgtaatttattttctttattgtttttctattcagatatacatatttaattcttctgcatcccaatttatttgagatttaatgtagcaatcctgttcatattggtaattttccgagatctctatcctgttccactggtcactttgttcttgaccaaacagctttattatggtagcttgtaagtatattttcatgttggtataatgagcctccccactttctttggtctttttaaaatcaaaattgacataaactcttcatgcacttttattctaccagatacaccttgattaatcatattgacttcctaaaaaacactgtatttggaattttcactggaattgtgttgaatttataagttaattttgggataattggaataattacattgctaaatggttttattgatgcatatggtaaaattttgttgatctctttcaagccttttaatagaagctttgcgtatttctcaatgaaagtcttgtgcatgctttgtttaatttctttgagtagcttcccatatttttcttgtcttctctttcaggaatgcatgctagtcaaatgttggacctattgtactggctttctgattttttttttatcactttctctcctagttagtccatccttttttcttctatatggtcccactctctgaataacttctttgactttatcttggaaatattaaattggcattttaattttaagtaacatatataattttcaaaaactgttattcctgcataatctttcttcataatattcctgcttatattctgtgagtacaataccttcttttatttgtaatagactattaatcatggaattttaaaaatatactttaattttaagagcagttttaggttcatggcaaaactgagcagaaggtacagagatttttcatatatcccatacccccacacgtacatagcctccttcttatcaacatcctcaaccagagaggtatattcgttttaatttataaacctacatgaatacatcattatcaccaaaagtcgtagtttacattagggttcattctcagtgtcatatattctatgggtttggacaaattcataatgacatgtatccaccattatagtatcaaacagggtactttcactgcattaaaattcttctgtgctctacctattcatatcgctcccccctcgtacccctggcaaacactgattttcttcactgtctccatacttttgttttttctaacatgtcatgtagctggaatcatatagtttgtagccttttcagactggcttatttcacttggtaaaatacattgaagttttctccgtttctttttgagacttgatagctcatttgtttttaatgttgaatgatattccattgtctagctgtaccacagttcattcattcacccactcaaggacagcttggttgcttccaagtgttgaaaattgtgaagaaagctgctataaacatccgtgtgcaggttttcagctcctttggataaatactaaggagagagattgctggattgtatggtaagaaattaccaaactgtcttccaaagtggctgtaccattttgcatctcaccagtaatgaagtagagtttctgttgatccacatccttaccagcattttgtggtttatggtcattctaacatgtgtttaatggtattcattgtggttttaatttgcatttttctgatgacatatgatgtagaacatcatttcatttgcttatttgccatttatatatctttggtgaatctgttaaggtctttggcccattttaaaatcaagttgtttattttcttattgttgagttgttgtaaatgccttttgtttattttagataatactcctttatcagttgtgtgttttgtaaatattttctcccagtctgtggcttctgtttttattctcttgacagtgtctttcatagagcagaaaatttaattttaaggaaatccagcttatcaatttattttgtgaactctgcctttggtattgtatcaaaatagtcatcaccaaaccctaggtcatctagattttctgttatgctatcttctaggagttttatagttttacttttacattgaaacgtgatcaattatggaatctttgcagttttttctgcttgtatcacttctgcttatcttgagttactttttatatgtttatctactttggttcctgtttttttatgtgggaggttttcctttattgtttggtgatcattgtctcaccattatgtctaagaatgaaacactttacgcttgggaggggtttgtgtgatgtgatggcccaaaacaaaccatcattttaactggagaatgccaaatgttgatgtccataggtcttttctctctgtagagaatcaccttccatatacgaacttccaggaatataagcctggtttctggtgacccaaagctgattagcagaggacttggggggaaggtcactactctttttttagaatgtcattttctctttttgtctttagttgggtgccttacctttgccttactttgaaatggggtccaagtgttgaatttttaaaaataatatatcttgcaatttttctatgaatgaggatgtgagaccaaggactctcaggcctaactgcttcttaaacagactagtcaatttctctacttttactttaatttacatgatttttttaaatcctcttttgtatccctctctgtaaacacttaggcttgctctcttctgttttgctaagtcattaccatttctccatctgtttcctgttcattatattgcagggtggaattacaggtgccccttttttttagcaagcatagcatgtgttattactctctttgttttttgttatatctttaccttgttgtgtttaaagcagaagttagatatgtattttttctacaatgcatttatttatagtgctcagattagtctctgaacacagaaagaatttcataatagtttcagattgaacattacaaacatgtaataatcacaatttaactcaacaaatattttactaaatctcggtaactgtgctaggcaatgggaactccattcttgtggataataaacaaataaaaactatatgagaattggagttagtggtaagtgctatgaagaaaaacataggagatatgacagagtggatgtatattttaaagagtttgttaaagcggcctcctccttgtttcttgatatttctttttaaaatattcttgtaacacaaggaccaaatgaatcactgaaaaattcactcagaaataagagtgagacttgtaacggttagtaggggttataatcaccgtacaagaagtatatctcttctcgttgctttgtctgcctttggcgaattggaaatataaacctgtttaatgaatgtgttcttaaaataccctttggaagtttaaattactattgaaaaagctgtataatgcagttatattcctttgtttatgtagctagaagagagaaggaaaagaacctgaggctaatagaaatagattacatttcactatggagcatagattaaaataatgtattttattgtggatctcccttcagaattcaaactaaatatcatttactttttctatttaagtaataacctcagggctctttaaaaaatcattatcagaagataacctaatatatcattgatatagtttcttcctatcattgacaaatatcatattagaaataccacctttttatagtcttgaaataatataatagaaaagggctccaaaaatgcaattgttccagtaaaaatagtcatggtgtattctttattttatcgaaagagaaataatattaaatccttcccttgcatttctttgaaagtgaatacttatttggtctactcgaattaataatttattttcttttgaatgttttgcagatgtttatatatcagtagtttcatttaaaagagctcttaaatgtcagtacttttctactaaaattagtaaacataaacatttaaagtattctaatatcattttaacctattttttaaagaacagtgtaattgatttttaaatcatgacattttaaatcatggtatacagaaagagtgtgattttagagtaaagagtatttttaatttgagaattaaatcaaatggctataaaattgtatctataaaactaggtacacagtgaaattcccattgtcagcatggtcctgtctccacccaggtaccatactccacctgcaagtaaccatttaatatattttttcgtatccttcggaggattcatttatatgcaaacaagcttgaacatacattcttatttgcccttatgtacctaaaatttagcttattttaaggttgctttgaacattgtttttatcacttacgtctaaagttctttctaaattggcatagaaagaacttcatatctacattgtagtattacgttgtataatataccaagattcatttaatctgtttccaattggtacatatcagccttttgtccaatattctgctactgcaatcaatgacctatatttaaattgttttggacataaaactttacagggaaaagccccagaagaggaattactgaatgcaagggtcaagttcttgtaattttggtgaatattaatattgccagatttccactattgtatcatttttacatttttaattattttatattacccccaccaaaaaattgatagtttatttccttacagctttttttttcggggacggagtttcgctctgtcgccaggttggagtgcagtggcgcgatcttggcgcactacaacctctgcctcccaggttcacgccgttctcctgcctcagcctcgcgggtagctgggactacaggcgcccaccaccatgcccggctaatttttgtatttttagtagagacggggtttcaccatgttggccaggatagtctcagtatcttgacctcgtgatctgcccgcctcggccttccaaagtgctgggattataggcgtaagccactgcgcccgacccttacagcattttttcaagattttcggtttctatctatatgataggtgcgtaatcaaatactcacgacagtttttagtttcagttatcttattataaatgagattgagaatgattttaaaagctactatttgtgctttctgttctgtagattttctgttcatatgttttctccatttttcttttgatgtggttatttcagtttctatgagcccttttttgtatgagataatttatttttgtatggtataaactttaaatattttcccatttgtcattatctttcgagtttgcttatagtctataattcttaagttttgaataaaaaattataaaaactgttttcatgcaaacttttgaagggctactcccgtgtttgatagttttatgattgtatattttatattttaatataaatgcatttgtcctggcttgtcatataaagcgtgaatgccactttattttttttccagatgacactgttttgttccaataaaacttttataattattcttttctcgttatatttaagatgtcaccttcatgatatgccatatacttgaatgctttttctttctacctgtggtctatggaactcaaaatggaactcaattttaatatgaccaattttgtttgtaatcctatttatttcttttctgttttaaaatgttattcttcaaaaagacctataatataacattcaaataggaatttttacattatagattttaaataattttcctatgatctatttaaaaattttctcttatattattttctctaaaatattaaattacagattttatttgatgcattattaataaaagttcaaatttatgagtttctaaaggtattttaatagttaattttgacagctatctcatcaacatgtctaaaattttattattttctcttactcctattcctttgtcaaggctcaaatcaggagtcacctctgtttcttacttctcactctgcagtcctattgattctgactactaaaaatatcttagtttcttcacttctctccaacagcaacttggttgtctctatcttagacaaaattgccatcaccactcatttgtgttagtccaacattctccatgtggaagctaaacagatctcctaaagaaatgaaagtaatcttgccccatcccttactaccaacttcaaaaacttgaaaggcttcttaccttgcagtagtagtgtttgaagtactcatatctcaatatctgctaatatgcattaaaaacaaaatagaacaaaacctcatcagttaaatattttaaaaaggcattttaattgtatgtatatgtctgtatttgtgttcattttatttatagtaaggttaaaaaatttgtgctttacttggatatttgttatttgagggaggtgacatatctcttcatataatttgttcatattattttgtcttattttttgtaataatttaattaaaaattttaaaccttattatgccacttagggtctgaatatttttatagttgtatttgacaaaaagatgcttttaagtttttacatttattcacatctatcaatacctttatgagtttgggtgtgtatgtgggtgtgttcactggcaaatatttacttattttattctaacaccatatttatgttacttccttacttttacaattttatctgtaatttgtttttatataatttgaattaggaatatcacagacttttttttttcagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacagttttcttcatgttccaaaaattaagctactgaaagctttggtcgtttgagagactcctctgaagctccttctggctccaagtccagaaatcattcagaaggcttttctcccaacttttggaccaagtagtctggaccaagataaatgtgtttcattgcacaatatggcttatcttgtagtgatatgtgatttttcactggcattagggggcatttcccaagaaaagtactggcaggtggtcttcatttcaagaactctgcagtattttacttgttgagtgctatttgcatttatagtgtaaatgagattagtcaatgggatttttaaaatttactatcagtattatttttaggttttggtatcagagtatcagaaatgttctggcctgataaaatgaagttgggacacttctgtcatctcataattctgtcaaaatctgtgcaggtttctattcagatctttagatacttagaagtgggcaaagtttctatttcctatagtgttattctgttaagttgggtttcagatagccataggaatagagagagttccttagaaggcatctgagttgaagggacactcactttttgctgaccactttcttttctgtggttgtaaaagcagtctgaatttttcaacagtgacgtccccactccacttctatatttgacctgaataccattttgaagaactagctgaaataatgccagaaccttgcctatcatgtcaaatctgtcaggtaatagatgaagatgaatacagtttttagagtctcccttgactatgcccagtagcaattcccaagatctttataggcttgggaattctatgccatattttgcacttgtctaaatctgcctccattcatgctactccaagtttgggcatactcccttcacctttatttggtcttcatatcagttgtttgtaagaaataggaagtaggaaataaggaaggtgtgcagagatatttggtcctatcagaagcttatttttcctttgtctcctccttattttttgttttaggtcaaagctagtttagccattcttatctgcctttcttgaatttgctccctgctttagtatacagacactctgcgccccataaatcatggaaatgagcattaattttacattttgaattgtggactctgcaggtttctaaaattgcttgatttccctaccctccaccaaccaacaacaaatatctactttcttcccgagccctgcttcttcatgctatggacatttctgcagaaactgctagaattctatcactaaccttcctggtggggctctccttagcatatgctctggttttacatgattctttattttctcaactctagttttatatgattcttcattttctcaactcaactgtttctgtgttgaaatatttatatattgataagctgtgttttccagagctgatataatttattcatttcaaaaacatattctcaaacagtgatatcatcaagatagtggagtaggattgtgatgtttaatattgagtgtcaacttgattggaggatgcaaagtattattcctgggtgtgtctgtgagggtgttgtcaaagaagattaacatttgagtcagtggactaggagaggcagacccaccctcaatctgggtgggcaccatttaatcagctgctagcgtggctaggatgaaagcaggcagaggaacgtggaaggactagactggctaagtcttctggcctccatctttctcccatgctggatgcttcttgccctcaaatgtcaaacatcaaattctttggcttttggactcttggacctacaccagtggtttgccaggggctctcaggccttcagccacagactgaaggctgcactgtcagcttccctgcttttgaggttttgggacttggactggcttccttgctcctcagcttgaagacagcctattgtgggacttcaccttcaccttgtgatcgtgtgagtcaatacaccttaataaactccccttcatatatacatctatgctattagtcctgtccctccagagaaccttgactaatacaaggagacactagccttcatctgtccatacacaaaaaatatggacaactatttacaaaccaaaataccccagaagcagcccacagtcacattaaagaatctgcagcaacccagtggagcaaaaatatggagaatatccacatagaatcactggtaagaacagcatacccaagtacctgagatgccagaagaaagctaggagtaaagaagaatggtataggctatcagcatggttcattgacaggaaccgctgtggttaccagtatcctggtccacagagaacacaggcatctcttgccactgaggtaaccaatagcctcaaccactttaacaatcctctgttaaaagaggggctgcacgctcctccccttcaagaagtggccactgttgaaagtagaggtgctcctttctcaaaatgtatacccatctcttccaaccctgagtatatgcactgaccctggaactgtggctacttcacgagtgaccataccccagacctgggctctgtgactacaataggcgtgatcatgtttcatataccacagccattgccatagtgagctagattgtattgcaagacccagagccaagtcctctctgtggatgcccatcctctagacacaagctcagctactctataaagagctaggttctgctctaacctcagggccattttaactctgcatacacctgtgcactcctgcagactcctctgctgctttacaaacaccctttctttgaatactgttacagacttggcagtgggggagtcagtgccccaggtaccagttctattatcaccctgggttccagagccatagccccttcatgtttgcccatgcttcaggcctaacctcacctctctggcctctccatcagataccagtaccaccaccactacaaatgagtacacaagacagatacagttccaggacagattccccttagtaacaacttctctggtatgagaaaaggaggtcatgaggacattaaaaagtatcaccatcaaagactctaacaacacttgctgccactgtggacatatacagtgttggttgctgaggatcccctgaaatcttcatcaacactgacctcagttaccacagcagcacagagactacatttctggcattctcactggtaccagaaaagctgcactttatccagtaagttcccttgcaacaaccctagacaaaggtctttccacatggaaactaacttataaagtctgcaagaggtccaacaaatgtgcagacatcaatgtaaaagcaacaagaaacatagaaagccaataagatttagcattatgaaaagaacaccatgatcacccagtagctaatccctctaaaaatggagatacgagaacagcatgacaaagaattcaaaataattgttttatggaagttcggtgaacttcaataaaatacagataaataattcaattaaataagaaaaataataagcaacaaaaatgatagagaaatcaaaattataaaaaataacaaacaaaacttctagagctgaaaaaatacgatgcaatggaaagtgtcaaagcagaattagtcaagcagaaaaaaaaatctgtgaatttgaagacaggctattttaaaacacaaaggagaacaaagaaaaaaagaaaaaaaattaatgaagaaagcttatgggctttattggatagcatcaaatacaaatattcaagttataagagtttaagaaggtgaggaaagagaccagaggtagaaagctcatctaaagaaatgatagcacaaaactttccaaacccgagaaagataaaaattattcaggtacaagaaggtccaaaatctgtagtcagattaaatccaaaaaagactacaccaagacataatcaaattatcaaaaaacaaataaaaagaggggaccccaaaagcaccaagagaaaagaagcaaataaggtagttccaataagactagcagtgcacttctcagcagaaaccttatagtccatgactaaatggtatgatatattcaaaatgctgaagggaaaaacaacctgccaaccaaaaataagttttatccagtgatatggttgggctttgtgttcccactcaaatcttaaattgtaatccctataatcctcacacatcaagggcaggagtaggtggaggtaattggatcatgggggcagcttccgacacactgttctcatgatagtaagtgagtctcacaaggtgtcatggttgtataagtgtctggcatttcccctgcttgcactcagtccatcctgccaccctgtaaagaaggtgcctacttctcctttgccttccaccatgattgaaagtttcctgaaacttcctcagctatgaagaactgtgagtcaattaaacctcttccctttataaattacccagtctcaggtatttcttcatatcagtgtaagaacagacaaatacatccagcaaagctgtcttttacatatgagacaagatacatacattcccagatgaataaaacctgagggagttcatcatcaccagacttttccaagaaatgctaaagggagctgaaaggatactaatgagtcacacaaaaaccctgaaaatataaaacccactggtaaaagtaagtaaacaatcaaattcagaatactctaataatgtaataatactgtgtgaatcacttgtatctttagtataacggttgaaagacaaaactattaaaataataatagctaaaataatttttaaggggtaaaataaaaatatgtaaattgtgacatcaaaaacataaaatggggggtggaatgaaagcatagatttattttatgcaatcaaagtttttgtctgcttaaaatggcctgtaataactgtaaactgttttatgtaagaattttggtaagcaaaatgcaaaacctatagtagatactcaaaagattaaaagcaaggaaccaaaacatatcactggagaaaatcaccaaatcagtaaagaagacagctaaaaaatgaagaaaggaacaaaggacctaaaaaacaacagcaacaataacaaaatggcagtagtaagtccttacatattaataatgatcctcaatataaatgattacatcttccagtcaaaagatgtaagggggctgaatgggtcaaaaaaaaaaaaaccaaaaaaaaaaaaaaacaagatctaactatatgctgcctacaagagcctcactttacttctaaaaaccatgtataaaagtgaaaggttgggaaaacatattctatacaaacagaaaccaaaagatagcggggatagctaaacttatatcagatacagtagatcttaagtcaaaaactacaaaaagagaaaaagaatatcattatatgataaaggaataacttcattatgaagatacaaaaattataaatgtgcacctaacatcagaatacctaagcatataaaccaaatattaatagatctggagagaaagaggctgcaatacaataatggaaggggacttcaatatccaactttcaacaaagaatacatcatccagactagaaaaataataaggaaacactggacttgaactatactctttagaccaaatggacaaaacagacatatgcaaaccattccatccaacagcagaacaatacattttcttctcaagggaacatggaacattccccaggatagatcatatgctaggctacaaaataagtcttaacacatgtaagaagattaaaatgatcaagtatcttttttttgaagatgttctttcttcacttctctattcatgtatctgccagatttccaaaataatatcagtcatgatagttttatatcaaaagtcaagaaagtatttcactgacataaaatatttaagactaagcatcatgcttggaatatgctcaaattagtatagcataatataaaaattaagcatatgttatttgtgggtttttttctcagtaaataagttgtattttccagtcaggtgattgagtaatggaccatgtcagacaagcactgcctttagatctctgaaatctgccagctaatggctatctctataataatgagttacctatcacctttttaaatctcttaccagccctttccttgcttagtctttgttattgttttattgtaagcacatacacatgcacaacatatgctctgtttcctgcaattttatatacatgtaatattttgagacagctttgaaagttggaaaattgtaaacctttcaaatattttggcttattgactacattttcatgatggataattatatctaattataattatatgtgtatatataattatatgtataccattaagaatagagtattctgaaaacgttttaaattgctgagtctttccagggaatagtatatgaaaaaaattagaatgaaaagtaaaggcaagaaaagttataaatggtaaaataaaaagcagtagtttatactttttaaataagtttacattaaaaaaaattgagttgaagtctcactctgctgcctaggctggtctagaattcctgggctcaagcaatcctcccacctcatcttcctgagtagctgggattacaggcatgtgccatggtgcccagcttgagtttacattttgaaaatacttcttttttcagattcaacaaaatctgcctattgacttgtttaatcctatcaaattaattttcttctctatatttacatttaaaatgcattcttatgtgattatatatttgcagcataatcctattctttctaaagggattttttaaaaaacaaggaagtcatcagaactagagtaaaatgttcattataggcattttgtgagttttcatttctgaacgatatttattttttctacttggcatgtaagcaatttttttaaaaacagcatttcagaggaacagattagatagtgatccaatgaatgaatactttataaatcttgtttttgtacattttattagttccttataaacatattagtgcttgaatgaatgtaaacatattaggacctgataaagtaactatgtgaaaattagccccatagccacattcccctttcatcttccacagagcatcatactaacaggttctaaaaattttaaaaatgaaacagatgaactcattataatatatttaagcttaagatgtcttttgaaaatcactcaaaatttggtaagaaatcatatgtttctaagataaagagaacaagttggaagctttttattccataaatattattaaatgcttataataaaatatgaataaaatgttttaactacttctaattattgatttagccttatttattacatgagaattttttttttgtgttagtcatgtacagggactgtagagataaaatcaaagtaaaagataaagtctttatgtatctgctcaattttgttgtgaacctaaccacttaaaagataaagtatatttttaaaaaagaaactttatcctcaagaggtttataatctaattaagaatattcactatacaagatagttctgtcataaagatataaatcagatggtataatacttttggtcctaatttggctatttttggaaattcctttttagttaattttacctttttattatggaaaatttcaaacacccacaaaagtggaatggtacaatgagcctccatgtaccatactcagcttcaaaaatcattcgttttatattatttacttttttgctcttctctcctctctcatctttcctgagatgtttcaatgcatgtcgtgacatcatgtcatttcactcataattacttcaatatgtatctttaatagggaaaaactttataaagcacataatcataatggcataattacatgaaaaaatagatagtaatttcttgatattatctaatacctaggcctcattcaaattccttcagctgtatagaattcattttagccatacaagctctgaaggaaatatttaagatataaaattaattttattcttttgacgcaataagaagacaattatgagtgctagttttctatgcctgtctcttctaaagcaaaataacaactgtcatcctgaaccgtctctgaattatctacacattccaaacggagtggcagtgtttattctcattttaactgagagatgtcagcaggtgcatgagcttctaaccttgtgatggcaatgtgatgtcatgaagcttttcagcaaaagaatacaattattgtcacgagcatcaatgcactactggtaattgcaatcatttttaaggagaaacaagaggaaggagaaatcttaccgaatgaaaaaaattaacagctctagaccatttttacataaattgcataaaattatgcttgcttatctaacttacctacagatttaatcaaaccacaaattatgttttagactttgaatatttgttacattataaaacattttctcaatatacttgtaaaattatagtgcatatattttaattttagttactcttacaataagaaatgtataacatggctaaaaatgtacaaaaccttaagaaattttttactggctgtttttccctaaagatataatttcccagtggggtaatagtttaaggtttcatagagacaatcttattctagttaaaaatatataaatacatgttattatttcatagaacaaaaattgcctcattttcaacaaaggtacacttaataaattattctacattacttttaatgattgacaatcaatattttaaacacggcattctgataatatgcttttaatttatataggtattttcttgcatgtttatgctattaggccattaattttgcatacataaaaattttgagagattcaaagataaaaatgcaacctgttccctaccccacccagcctggatatggatacatatggctcatatattgtttatatattataaatattgaatgcattcactcaggaaatgcaaatgtttaaaactatatcaagtccattctgattatcctcttatttccaatttttcttttattaagaagcctccatagaagaaaaggaatgcttaataggtttgtggatctcagcaaaattctagggcataataaagtatttgggatatagaggattataaaaaatgtggaatatttcttatttgggaaaagataaagctagaaactatgtttagaaagtttgtaactccttgaactaacaaaagtcacaatgagtcatttttttccttcataggaaggaaatccacatgcatttcaagcaattctaacttgatgaagagaatccattcagatataaagtaatatcaatggaacaagttttagcaaacctccaaaatataattttataattttaatatagggacatggaaataaaagttcaaaatgcattgaagaagaaaaatgaataatgaaagattctctaaatttatattctcagatccctttcttacatatagctatttttgacaatctctgtttttagtttttctggtgatataagttgtatgttttcgtatttcttaatatgtcacctctaagaaaaatccattgtttctccacaatgtgagttaagaattacttttctttccttgttccacttcctactccttaagagtttattttctttttataaatttagttagtaaaagttcagctttatttcagtctccaactattttaaactactatctttcaactacacacaatgaatgacgaagttagcaaccattaactttttttgtgggggagatggagtcttgctctgtcgcctaggctggagtgcagtggcacgatctcggctcactgcaacctctgcattccaggttcaagagaatctcctgtctcagcctcccgagtaactgggattacaggcctctgcctctacatatagttaatttttgtatttttggtagagatgaggtttcaatatgttggcaaggctggtctcgaactcctgacctcaagtgatctgcctgccttggtctcccaaagtgttgggatcacaggcgtgagccactgtgccaggccagcaaccattagcttttgtccagtttcctccatcttcccaaattctatctgatatgctagtactttaataatttcagttattaaaatgtatattagttagaattacctttaattttttactatagattcattctgaaagttgatttcaatgaatagactttataatattatgattatttaactactattgactacatattctggttggatttgtgcataaaaatataatttcttacatttaaaataactaagagtatattggaatgtttacatcaccaagaaatagtaaatgcttgagtggatagatattctatttaccttgatataatcactcattgtatgcctgtaccaaaatatctcttgtaccccataaatgtatacacctactatgtacccacaaaagttaatatgcatataattctttacctctagcaaaattttgctccctgaagtggtatatgcacacatgaagagcaataggattctactcttaaatgtaatgtcttttttagaatcaagtcatatttttgtttgttttatttcaacaaagacttcttaatgttctatttttacaagaatttcaaactgcctttatttttattatttttatcaaaaaatgccttttgttgtataactaatgtactccagctctgttatcacattatgtcttgaatgttccggtatgtaatgatattgtgctaggtcccttggccacctattattctgaaatttctttttgttgtattcctatctgatgtgcaatgtttcttgaattgcagtttatgctcagccaattattctgtcttgaaactgtctttcattttgctctagcgaaagtgtcttccaatcatttaaaggaaaatgcatgaaggtacattttctgaattcttacatgtctgaagtgtctttattttgctttcatattagattggtaataccaatggccagacgattgaatattcagaatcattttctgcaaatagaagacattttaccattgtctttcagaattcatagttgctaatatgaacaaatgctgacattttgcaggtaggggagaagaaagttcatgtgtttctaggctcttcttttgatttttgttctgaaatttaaccaaaattatgtaaatacgtgaaattgcttttgccctttgtggtgtatttaattctgaagactctgatctttagtagccatagaacagttcatgttatctctttaattcttccctctcctctcttaactcctctttttctggaaaatacaaatatggatattgactcttaagtttgttcaggctgccataacatatcaaaatatcataaactgggtagcttataaacaactgaaacttttttttctcacagttctggagactggaaagtccaagattagggtgctggcagatttgatgcctggtgagggccaatgtcatatttatagatggtgctatcttctctctgacctcacgtggtggaagaggcagatctggtgcctgggaaagccaatgtcatatttatagatggtgctatcttttctctgtcctcacgtggtggaaggggcagatctgatgcctggtgaggccaatgtcatatttatagatggtgctattttctctctgtactcatgtggtggaagggacagatttgatgcctggtgagggccgatttcatatttatagatggtgctatcttttctctgtcctcacgtggtggaaggggctagctagctctctgaagtctcttataaggtcactaataccattcatgagggctctgccctcatctaaacaccgcctaaaggcctcacttcctaacaccatcacgctgggcgttaggatttcaacataggaatttggcatggcgggggaacacagacatttcaaccatagcagtgaccttctgtattcatcttctatgtctctattttgttttccttttgtgttttatttttttagtttttcatctgaattggggagatagcttcatttttttactttcaacacttaacattaattttggttttatattcataattatagttttactttctgtgaactcttaatatctgattgcttcttttaaatgacagatttttttttcacatatgccatatatcttctggaatctttctgagaaagccaattataatttgttcttgaacttttgagtttttgtttcctcccttatcagtatgtgtattagtcagcttgggctgtcataacaatatactatagactaggtggctttaataacagacattaattttctcatagttctggaggctgaaagtcctaaatcagagtcccagcatggctagcttctagtcagaactctctttctggcttgcagattactgccttctttctgggctctcacatggcagacagagagaaagaagtatttcttcctcttcttaaaaggccaccaatcctattggttcaggaccccatccttatgaactcatttaaccttaattacctcataaaagccctatctccagaaacagtcacattgtcaggtagagtttcaacatgtgaattttggaggaacacaattcagtccatagcagtatatggtctttgtttttctcgtttctcttgttattgttttgttcatcttcctcagtgcttattgtttgcacatatttattaacgaaggactaaacatattaatgtacatggcttcttttggttttctctgctatcacatttctacaccctgaatgagtgtgctgattgcaggtgccatatatgtggaaaaacatggagtatggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacaccccatctctgctaaaaatataaaaataagccaggtgtggtggcaggtgcctgtaatcccagctactcgagaggctgaggcaggagaatcacttgaacctgggaggcggaggttgcagtgagccaagattgcaccactgcactccagtctgggggacagagtgggactctgtcttaaaaaaaaaaaaaaaaaagagtatgtcattaactttttaagtcataaaaatctgtgaagaaacaatatatgggtgaaatattttaaatgaaattacttgtaaattactgtggtgacaacttgtagtacatgccttgtagcacataaacaattagtgaaatagttgttgatgtaaaaaccaccaccgcctcctaacatttattgaacatgtctcatgtgtcaagcactgttttgagtacttaacgttcattaactttgttaatatgcacaagaatcctgtgagttttataccactattaactctattgactacatgttgtagattaggaaactgaacgtaaaacaattaacagacttgcccaaggtgaaacagctactaaatgacaagagccaagattaaattctgtagtctggctcctgagcctgcacatttaattacatcacattgaaaatattataatcacaaaaatgaattttatctgtaaaaattgaaaaacttactggttgttttatagtcactattattaaaatatttattttaaacaaattcagtagtaattttcttgagaagagttactcaaataagatgtgtcagtgttactttctataataagaacattaggcctagctctacccccagcactaccgccaactagttctattaatttgtttaccttctcttctcttcagttttcttttctgttccatgttcatttcattccacaaggaatatatattgactactacattacaggctctattataagagcattggagacattaatgaacagaagaaagagatactttcttcagggttcttatattccagagggagacatagtccagaagtaaatacaagctcaatatagacttttgcttccagcaatgaaaacagcttatttctaagcaattcttccattgagaactggaaacctaagcaaaacataaaatatcatttgttataaagcatgcgagagctactcaagtgagatttacagacatcaaaatctggaaagaatggaaacacctaaatagatgatcttgccagctgaagctgcttttccccttagtgtttttaattccaaagcatctattgaaaggctgggtggctgagcaggaagtggaagctgagaggttgagaacacaccaggattgtcaggaagcgaaacttagaaataaggcctgccaagagacaaactccctggctttcagttgagatgctgaagggctaggagttaagaatcaactagtaatagcccaggcctcagaaggatggaagaccagttttgaataaggtaggccttttaaatactttgtcccatagcccagatgaatgccagaagcaaaagaggacatactgatgattcaaagcaatgataacgattgttgaagacattttggtagaatagaaggcaagggaggaaaataccagtcctgctaagggttgaatgattatgaggttcatactgggttggaaaaggagtaaaagcaggagaggattcattagcccaggagaatgggaatagcttttaaactagaggtcatggtgactggatacagaaagttgtgatcaaaaagctagtttttccagctgaacagttcaaaaattgataatgataaacttcagagtatggcaaagtcaatgggttgctggagtgaaggaggaggtaattaaacaagaagaaactaagaaattgtgtggttaggtcgttggaggaattatccaaattggatagtgaaattgcaaacgatgctagcaggagtaaaaattgagggaagtgcaaagcctcttagaatcagaagtatttaaaacgttatattattagtatttatttaaggagattttaacttcaggcaaaacattcagagggaaaaaataaaaaccatttatcccttgtctaagggtcaatttgtttctctcacccccttcaatttttttattctttaatccttcatttaagaaaaaaatacaatttgaggaaaaaggatcttttaattactttaaaaatccagccaagtattgagagtcgacaaccttaaatttcatagctattattttattataagtaaattgctatgcttcacagtaatttctgaccatggaataatgacctaagctcactgtgcaacatctggtataccctatgttgactaaaaatcaattagaatttttaattatttttgcaacatctgcataacaatctaattcaaagccaaattaaatggtccttctggtgatggtgtataatgacacattcataacttaagaaaactgccctttcccagagcataagacttgaaaatattcagctcgcctttcctgatttagttgccagattatattgatatagttaatggtacacactgttatattttaatagattgtgacaccaaatataagaatcactttttaaattttctgaacacatcttttgactctagcacttaattttcttatcaaactatttttcatagttagccaacagttttaaataatcctcatataattaactgctgataatataatgttcatccttctggcttatcttgagctgttgccagtgctgtttaaatcttctcatgaggagagtcagatgcaaacagaaatataatagagtgaccagaaactccagagacaaagttggatgctcatttctaatcaacacagattcttttttttttttttttttttgacttatccctgaaattttattattaaaattacttgtttgacattgtttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatgtgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttccgaaggaatggtaccagttcctccatgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtctctatttgattcttctctctttttttctttattagtcttgctagcggtctatcaattttgttgatcctttcaaaaaaccagctcctggattcattgattttttgaagggtttttttgtgtctctatttccttcagttctgctctgattttagttatttcttgccttctgctagcttttgaatgtgtttgctcttgcttttctagttcttttaattgtaatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaagtcactgaggacttgctttatgaatctgggtgctcctgtattgggtgcataaatatttaggatagttagctcctcttgttgaattgatccctttaccattatgtaatggccttctttgtctcttttgatctttgttggtttcaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcttttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacatagatttggtcttttcacatagtcccatagttcttggaggctttgctcatttctttttattcttttttctctaaacttcccttctcgcttcatttcattcatttcatcttccattgctgataccctttcttccagttgatcacatcggctcctgaggcttctgcattcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccgtgtgaggtgtcagtatgcccctgctggggggtgcctcccagttaggctgcttgggggtcaggagtcagggacccacttgaggaggcagtcggcgggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctctacccagttcgagcttcctggctgctttgtttacctaagcaagcctgggcaatggcgggcgcccctcccccagcctcgctgctgccttgcagtttgatctcagactgctgtgctagcaatcagtgagactccgtgggcgtaggaccctccgagccaggtgtgggatgtaatctcatggttcgccgctttttaagccggtctgaaaagcgcaatattcgggtgggagtgacccgattttccaggtgcgtccatcacccctttctttgactcggaaagggaactccctgacccctcgcgcttcccaggtgaggcaatgcctcgccctgctttggctcacgcacggtgcgcgcacccactggcctgcgcccactgtctggcactccctagtgagatgaacccggtacctcagatggaaatgcagaaatcaccgtcttctgcgtcggtcacgctgggagctgtagaccggagctgttcctattcggccatcttggctcctccccttctctaatcaacacagattctaatcacctcagatttcagtttttaatccttgattaattctaattacctagaacaatcatttttatttctctgtgataatttttgacatctctctgttcttcaacaggatgctgttatttaaaaagaaaacaaaaataaaactttcaccaaaattgcattaatctgtacatgatgggtacatgtgattgatctctgttgtttgcattctacatataattgcattttggtaaacagtagctacttttcaatgctaaaagctcagccattaattttctgcagtatagaattctcttgaaatatttcactgtttctcactgctctaattgctttaggaatttcctttaatacatattttgtatatatttttatacgtattttaagtttttctaggtaaatgtaagtccatgatttcttctactatttttggagtttggaattatcttaattttgtcataaatttctgtgaatatttgttttgctggtacaaacaaagatttgataattttctaagcactcccagaagctttgaataaataattttggtaaccacatgatgatatttatgaaatacataaagctcttaaagtttagggcaacctaaaccagtgtgaatcagactttaatgtgcatacttgtcccctggggatcttgtgaaaaaatcagattcagatttagtatgaaggaggtaaggtctgagattatattaatacatttctaataagttgtcaggtgatgcctaagctgctagtacccagactataatttgagaaaaaaagaaataaataactttatgttttgatatgtttatttttatccagtaaaactgtattttagcaagtttattaattttctctacttgtaggttatatgctatcactctgtcctttcaccatagtactttgtagaaaaactgtctaatcttgtttatccagtttttcatcagccctgctgggactatatacaatcaaatttttgccccattactttccatgactgttttcttgatgttctatgtgaacttattcatctccaaatcatggctatttatgctgactggttataggaaattaaggagtagaggacaaagccaaattttaaggagacaaggagcactctacatcagagtaattgtggtaagaaaatctgtggtactagagttgttgacatttaaggagctaaacatggtgttgggcagggaggaaaatcccatgtgccaagaaggatattgtgaaatgagcaccttctgttacacatgaacatgttctcatgctgctagataatgttaaaccatactaattgagttcatgttaatccctcacccttactcactgtagttgtaactccttacgatcaccagatatatatcatatatatgatatatgatatatatatgatatatgatatatatatgatatatgatatatgatatatatatatatgagctatacctggtcatggtcatctttatttttctcttagtcaattgtgaactaggggataaggtgcaatgtgcagcatgggacagtatctatttaacagctctttataaacacacatctgtgtgtgtgtataaattgtttatatattatacacacatacaaccataataatggtttacaccagtttctgcagtttgccttcccatttgatcaccgaggacaatgtatggtcaatttctatccataaccattatccgttattttccctttcgtctacttcttatttgtcctgaaatctttctgcattgcacctaactggtgaaaagctttttcttgcttctcccacagactaaaactctatgaaacattattcatcaacacaatgctactagtatctctaaagtctttagttatgaattcttatctgtaaagtgagtgaggagatgagactagctgaatatctgataagagtatttactcctcaggaaaccgagtattcatacttatattcagagttgaatgcattagtttaaataacaagatattacttgcgaattttcattttcttgaaacaacccacagcaatactttatccttttataggattttgttttgttttggcataattatgttgatactttgaaagtaaccttaaaagcaataataaaattaaagggtatttattgatttcatttacatttttcttgacttttttattcatttgagatctattgtcttatccccatattaattaatcaaatgttaagtcttatattgggaattattgattatagcttcaaaaggaggtttgtttataatgattttgtgtatcccttttccccagtgacttccactgtaagttcaggttgtttaataaagacattgaatattattgatctatgaaatgtcatgccaatttctaattgcttgatttcagtgtaattccatattatatttttattcattcaattgttcattgaattagttgttcagcaattcatatcaacattatgtattatttccactagtcaatacaatgcaatggatatagctcaattgtaggattattatcacagaaatgtatccattttaccaatctctgttattttgtgtctcacaaatcattcttgcattgtaaaatggaatttctgataataagtatatgccacaaatctgtaagattacttaattgattcctatgtttttcatactgcattttaagtttcttttgctttttgtttggaaatccatttgctcaaagttaaaaaaagcaacacaagattgtcctgaatggtattgcctaggttgtcttccaggtttttatagttttaggttttacagttaagtctttaatccatcatgagttaatttttgcatatgatataatgaaggggtcctgtttcagtcttctgcatatggctagccagatattccagcaccatttattgaatagcgagtccattccccattgcttgtttttgtcaggtttgtcaaaaatcagatagttgtaggtgtgtggtcttatttctgggttctctattctgttccatttgtctgtgtgcctgtttttgtaccagtaccatgctgttttggttactgtagccctgtagtgtagtttgaagtcaggtagcgtgatgcctccagctttgttctttttgctttggattcagccattgaggaagacagtgtggcaactccttaaagacctaaggacagaaataacatttgacccagcaatcccattactggatatatacccaaaggaatataaatcattctgttatgaagttgtatgcacgcatatgttcattgcagcactattcacaacagcaaagacatggaatcaacccaaatttccatcaatgatagactggataaagaaaatgtggtacatatacaccatgggatactatggagccataaaaaagaatgagatcatgtcctttgcaggaagatggatggagctggaggccattatccttagcaaactaacacatgaacagaaaaccaaatagtgcttgttctcacttaatgggagaactaaatgataagtgggaactaaatgataagaacacatagacacatagaggggaacaaaacacactggggccttttggagggtggagggtgggaggaaggagaggatcaggagaaataacaaatgggtatgaggcttaatacgtgggtggcaaaataatctgtacaacaatccccattacacaagtttacataggttacataggtaaacttgtgtactgagggtttgttgtacatatttctttgctacccatgtattaagtgtcatgattatttcaggacacttgtacccctgaccttaaaatataagttaaaaacaacccacaaaatttcatttttctctttctgtctcttgtataaatacataattagttcaattaataaagggtacattttaatagaggaatcaacattatatactctttatgaaagaaaaagggaattaaatttaaaaagaaaatattctgtggcaacataatcctagataaccagaagtacatccttggtctaaatagctctgcctgacttgaacattattatctacttcctgtatcatcttacccttgagttcaaattggaccttgtttggcagatgcttatttttctcacaccacaacttacattcccttttgggatctgtgcaatttgtacttgatagctgctcttgctcaggtaaggctttatgatatttttccagtcccgtttcctaatcctcttccctccgtttcctgataagcccatctcaactgtttatttctgctcaaatacattaactattccaaagtctgtactggggcttctaaaaaatagaggtagacttataggaggatccaatcctgacacttaagataattctggtagtgacaataattatgtttttgctcctttatgttactctgatattagtcattaaaatatttaccaagcatactttatctttattttattcaaggtaaggcaagaaacagtaactcattcaaagttgctcggttatttgagaatgcaacatgttgcagaaatgaagtccagctgggcattctggagacaaatgctgagacttctgagatattgaaaaccattagggaaagaaattatgactcttgtcctcttgctctgttcctggggtcaccatcgctctgcctcatactgccttttatgtttgctctatccagcctcctctcaggaggaacttcctctgcttgcattcgatttttgctctgcaataactaaaactcttaaggaacctgattatcataacataactctgtataatcaaatgtccacctctgttccaatacattgtagcagaaggaggaaatgtgtatgttttaaaacatcaaaaaaaaattagtgaaaaagaggctgattgcagacaagtacccgaaacatgaccactgtaatctgccattttaatctatgtcttaataataaagtgatacatcagtcatgttttctttattgacaagaacataggatctcaaagatcttgatataatttcaatattgatgatttaagttgtttcagacaggacagcaattgccagtgaaaagcaaacaacaataagttgtttaaagtgtgagaaaactactttgtaaattaatgtcaactgaaaaaagctaagatgctaaggtgtgtattctttgaaattatattggttgtacaaaaaataaactttgtattaaggctattttaatattttcttatattttccacattattgtaaaagttgaatattagagattattaaatgatgtaagcatctcgtgaacaatatttagtaaatccttattttatgaactacaaataaaatctaggacttaagacatgggttgtttaaattgaaaatgctacttgaatgaaatcagaatgactcaaggcatcgcttctacactttttggctaaaatcaagtgtaaaatgactcagggatagagtcaaggttgcaagagttttcctacattaatatggagacagatgaaaaagacaactattttttttctgcttatattgttgtaaagattttaagttttgaaaaaatattaaggtaacaaatatcagctttgttttttccttgtaaattttttttttacataggtgaccagagtttcatgccattccttttgtaagaactgttaatatagctaaggaaaaattataacagtttctcaagtaacttcttgtgtgttttatcataaaaacccatttaagtgtttctcagcataaggcaattttaagaacttgcattgttttaagataatacagtagccgaatcagtgttatattgtgtaaattttagagtatttttatcttcaagttatttttaatatatgtattgaattttaggtatttaacattgtactttcttctacaatatccctgtagatcattttcatttgagcacactttgagtttgtttattgtataaattcatctctttataacttttgtaatgtaataagggattctttggtattaagagaaactctggatctgagcagggctgatgtggaaaatggggcttgattccaaagggtgatggcagctatttcactgctctctctacagaagggcagttgcccagatagggtgtgtgtcttcaggtctcagcagcttggtagcaagaaactttctctcctgttttataacaatagttacttctaatatatactttgatattggtcttattaaaactcttttaaaaagaaatgtacctaataattgacaattctcattaattttcatttgatctaaaataagtgcactctccttgatattttatgctggcaaaacaaaataggttgtagataggatccattaaaaatgatctcttcatacatatatctaaataaagaaggagtaattctcatttgtgtttcatttatgatttatctttagtgttcttttttgtataatcaatttcgatgtccctttacattgatttgacttaaaagtctataattgtatgtgcaacttttcaataacatgtttattttgttagccaaagcaataaagattagagatgaggtaatccctcccaattctcccctggtattcctcaccaacaattttgtatcatgatctaatattaatcaagatgacattgtgatcaacaatcatatcaaaataaaaagcacagttgtgctgctgatagtgattatacataaataaatatcaggagattaacattgtttatctaaatactgatggggttcaaaacatactataccccaaatatggcaccttgccatttgagaaaacagtagaagtaggaaggtcactctcaccttccccccaacttcgttccccctgaagcaagctttaaaatctagctgacctttccctgaagtaggtcctaagacccttattccagaggtgcttaccctatacccagagaggaatatccttatccctgaaatgcaggagacaaagaagaatctacacaaacaggcctatggcattcccccattagtttattaccattagatcatgaccccttgtccatcatacttctccacaaatacccacttattcatcaaactaagaataatatacagattattttatatctttggatcttcatttctgaagccttctgtgtcatgtaaaacttaaatttgtatgcttttatcttgataatttgtcttttgttataggtgcctcaaccatgaatctacctatgagcaaataaaagataatactttttctcctcacaataccattaaatattgtattacataattctatgggaaagtatatctaagatttgtttgcagctggtgttggtagattatttcccaaaagattgtcatgattcacaaccccaacaacaatggatacagtgctatctttttaatccttgcctgagtgcatgttgtttttctttataacttttctctactcagaagaataaaaaagtcatctcattgttgtcttaacttgtctcttactaacagtgagatagattatctttagatgagtatatggatgatatataatttctgttctgtgaaaatcttattcatattccttacaattttttatttatcattttaatacaaatttataggtacttcttgtcagacatttatttacatgccagaagttttgcacatgtatctcccagcctatcattgttttgtgtgtgtgtgtgtttttttactatttagaaattagacttttgtaattaagtaagcctatattttgtttatggatttgttcctgttttgcttaataagatcccttctaattcaagtttacttttttgaagttttttacattgaaatgtaaaatagtacccagtcttacaagttaaaacccagagacacagagagtttaataatttgttgggtaactctatagctctttttagttactagtaactatgctataatgatcataactattaataatatctggcatctcttctgaacatctgctattaggtactggcaaccttttatactctatttcttttttgagacagagtcttgctctgttgcaccacctggagtacagtggtacaatcatggttcattgtagcctcaagctcctgggctcaagtgattctccaccttagcctcccaagtagctggaaccacagttatgtaccaccatagttagctaattttaaaattttttttgtagagacagggtcttgctatatttctcaggctggtcttgaactgggttcaaccagtcctcccatctcagcctcctaaaatgctaggattatatttatggccactgctcccagccctctatttaaaggccctaaatgttcttcagaaaaccacccttgatagccatgaattgttgctctcactctcaggtccaagctgattttgactggattaagctagtctccacatctcattcccagtacaattagagccagtggatctctagggaaattgagatgaaggtagctaaaaaggagcctttcactattcctcttgatttggtgatgttaagctgcaacacttagaatgtctgccactgtatgcctatgattatggaagccagctgaagatagctaatacccagaagaagcatggcccaaacagagatgctgtgatttataagatgtgaatcaagggtgctttgcttgatgccttgcttcaaaggcaacttgccctttcatttaaaagagccacaagatttccttttttgcagtaagccattttcagatggttcctctttccttctccctgtacatcatagagagtcatcagagacattggttaattatgaaatgcaaactatggaatggaggaagaatctcatccttaaatgtcctgatgcaatctcaagtcaacttaacctaaattatattattatatttaatttacaatataaacacttaccttttactcttggagagtaaaaggagagaataggtacaatgaagaatctacatgtggtaactttgatactatccaaaactttttctaagccttttaactttgtagtgtaagtaatatgacatttttttccctatactgtgtccttcctaagttattttgtaacatcatcatggatcttacttttatgcataaccttttagtttttaacagccaggtgtggtaaggaataaaagttatttttaacattgacctcaggttctttcttatacaaaagcattctgtaattggaaggtagctgagtagacagctttagccatgaaacatgaggccttgaggtcatgggctgaaagagatagttgaactctgtggcatcagaagttatagtgattagagattggggcaagaacgaagatagaaatagaaaatgagggactttaaaaagaggagtttttgatattcagtttaagttattttttgtgctagagaaatatttttagaaagggcactctgtgcgtaggatggcatgttgttcaatgtattgaagcaaatttagctgcagtaggtcacaggtgattcctgataatgcttgaaaattacttttttcagtggaagagaaggaacttaggttactgtctttggtccagtctgcttgcattttggtaggagagaatgctattctgcaataaatagaatgttcatttttatttggaagttatctttttaggcaccagtgactaattatataatcaacagaacctcattttctgaagcagtactgtgcatgttatttcactaaattttttaaaaggtgataatacaaccataacacaaatgtaaaaatgaaagaggcacattaaggtttattgaatgctatgtcattttttatttaaaggtaagttaacagctatattcattttagcaaattaggccattgtttcttttttctattttgcttcaggtatgactactgtatatgccacataaagtagagcatcttaaaagaaaaagtatatatagtatattgatgtataaattaaattgactgctctatttcagataatttttgccaataatgcattttccatggaaaaaacaggctcctttccaaatggaatgaaacacatatcaacttgccagtgcatgaacagtctgtacctagtttggaaaattataagtaacgctggatccaaaacaaaagtatatgatataatgtttaatattttctcaattttttgacattggttggcaattttcctttaaatagtcattgttactgttcttggagaaaacatcagttgtggtaaagcacttttccaaattttgttaactagcttgaccttctttagaaatgacagaaggtagaagatgatactgcatttttccactcacatgtgtgtataatgcttcatatactgctaaatctttatagaagactaaacataaagagattgtgttagaggcaaataacagagtagatattgacatttgggggggtggtaactgagttagaaaaacaccattttgtctgaggtttcagtaactaactgtttaaacatcttctcagctgccttttgtaaagaaaaaaagcaatagtttttcctatgattttttctcccatatttgatcttcattatgatatcttgactactttttaaaataatataattgacaatgaaagacaattttgttggaaaatctggatttctatgatttcttttaaaacaatttgagattgtagtacctgtgaagattgatgttaaaaataattttatgtttcaaaaggtagcaataaattacgaacaacgtgagtgcagtttctttcacctaccatttggctcattaaagaaaaaaagtacctgacattcagtcattttatgaaaaatcatggactaacctttgtagaaatgtaaactttaacaagattatagtatctttgaaactaggagttatgtgacaaccaagttctgatgtccttataagcactctactggatgaccccctaacatgtagtattggccaaatttgtttacaatgtgtttattttgcatttcttcattggatttttttttatactagtccaactagcatgcctggtggtgtgttggaggaagcatggctaaatgtactcttatcgtttttaaaatgtcttgaatgaggcccagcatttgaagccaacttttgggaaatgcagttgggttactgacattggagccttacaactgcagtggaaatatatgatgacttgaaaagaaaatgggaaaacaatggtgacatttagaagaaaattaagtttggggttcagtgttgcttaggaaagtattgttctaatatatagtaaaaatgggagagatcaaagaatctcagtgaaaaaaaatcatagaattttgtgctcactatttgattgaggtagtattttctattcaagaaaatgtgtcagaaactagatagggaaagaaaaagaaataaaggaaaggaaaaaggaaggaaagaaggaaggagggaaggaaggaaggaaggatgaacggacagacggacggatggacgggaggaagtgagggaaactagacagagttatagggcaggctctcgacttttggaaaagggaacttaaccatttctaaaactcattcatcaatattgttcactgatgtcttcactttaaaaatttattggtggctaggaaatatattgtaatagtagtgagtccaactagcatgcctggtggtgtgttggaggaagcatggctaaaatgtactcttatcgtttttaaaatgtcttgaatgaggcccagcaaggtggctcacgccagtaatcctagcactttgggagggtgaggtgggtagatcacctgaggttaggagttcaagatcagcctggccaacatggcgaaaccccatctctactaaaaatacaaaagttagccaggcatggtggcatacacctgtaatcccagctgctcaggaggctgaggaaggagaattgcttgaacctgggaggtagaggttgtagtgagctgagatcgtgccactgtactccagcctgcacaatgagagtgagactccatctcaaaaaaaaaaaaaaagtcttgaatatttaacaataccttttgaaggatccttaaaatagatttcctgacttttacatatgaatgatgaaagatttttttttttttgaaatggagtctcactctattgcccaggttggagtgcagtggtgcgatcttggctcactggaacctctgcctcctaggttcaagcaattcttgtgcctcagcctcctgagtatctgggactacaggtacgtgccaccatgcctggctaatttttatattcttagtagagatggggtttcaccatgttgaccaggctggtctcaagctcctgacctcaggtgatctgctcaccatggcctcccaaagttctgggattatgatgtaagtaaccagcctggcagaaagattttttagaagtataaaggctttgttttaagacaaccaaagatgatcatacgtctcttgctaaacatattaatttcatccatgcatctcatagcaagcattttttttgcatttaaattcactcactctaaaatatatcaaagttcttattcttggagaggtgaaatataagcactgtcaaatcaataaattaatttgtaaacacttatatttgcataagttaacctcaacaaatcatttttgaaagtgacagaattgtcagaattggtttgatttatgactcttgcccatgataaggaaatagtaccaaaaagattaaaagggactgcttttgaaacatttattaccctcctccttctttttttttccaaatgaaagcatttaatctaatcatctccataacatatgatgtatacagtggtgatgaatatactgacgtataccatgcattcagattcctatttttagagattacataagaaagaagtagtacattcaacttaaattcttcttagccataacaattattatttgaaatcttacccctagaatagttttcggtggaaaactggctatatgaaataaaacattaccttttcaatcatttctatgatgagccagtatcttagttcattcaggtggctataacagaataccataaactgggtagcttataagcaacagaaatttgtttctcacagttctaaaggattggaccatgagcaaggtgttgacacattccatgtctagtgaggcccacctgctttctgtttgatagatagtgccttttggcacggtagaagggaacaagacagctatctagcactaatcccattcatgacctaatgaccacccaaaggcaccacctcctaacactatcaccttaagagttaggatttcaaaatacagattttggggaggacccaagcattcagaccacagcgtttcaccccgacactctcaaattcatgttcttcttacatgcaaaatacatttgttctactccaacagccccaaaaatcttaactcatttcagaatctaccttaaagtccaagttcaatgtctcatctaaacatgatctaaatcagatatgggtgagactcaaggtacaattcattctgaggcaaatttctctccacctgtgaatctgtgaaatcagacctgttgtgtgtttacaaattacaatgatggggtagacacgtaacattagcattctagaagggagaaacattgaagaagaactggggcaataggatccaagtaagtccagaataataaagcttgagaataatctttgacttgaggatctgccctctgggccctctggggtcatagccctgcccacatggctttgggaagccccacccttgtagtgtcttcagtgtctctgtgcctgagcctccttgccatgctattgtgattgtctgtgatggcccccacctctgcagcagctctgtgcctgggtcttagcgctcatggcttttctgggcttgaatcttgcgctggtgatgatcagtagtctccgagcagccctgtccttatagttccatggagcatttccctagtggaatgtctctgtggagactctgacaatgaggcaattttctttctgggccctacatttctccagggagtccttctaaatctagatagaagcagccacattcccacaactttgctgggtacagtgcatgctgtacctgggtcagctggagccatcctaggtcagatgagctggtacttgggtcagctggagccatacctgggtcagccatacctgggtcagccccatacctgggtcaattgaggagtacagcaacagagtgcaggaagcagagcccatgatctgaggtggtgctgggcagccctggcccctcctttgaagttgttctgccctaagacccagtactctggccctgtgataggaggggcagctcctgatgatctttgaaatgccttaggggccattctttcattgtcctgatgaatagcacctgactattcataccaatttctttatcaaatagtcacttggccacaccttagtattctttccagaacacactttcttattccttttaatatggataggctgagaattttccaatttttaaagtgttgctttccttcagattaaaatattttaaattctctctttttactgtaagcaaaaataaatcatatttttttcaaatgtagttcactcacaagttctaccttccacaaaatactgggactcaaagacaattcggccaagttgtatgccactttataacacttttaggaggacacaaatattcgaattagcgtacccattatatgattaaaactaaaattctctttgggtcatatgccccttagaaatctttaaagaaatatatggatgaaaagtttagaatgattgatcaagaggaacctagattacaataagataaactcatactatttcactaattatactgtaacatgtatttttcataatggtttgttattcaatcacaaaataatctttttagtatggttcctatataaaatgaaatgtaacatttatcctgtgatatttaaaattgtcacctgagtagtatgtgaaagggatttttttctttaagcaatatattaagcatcaaagacacatgcataatttgaaatagtttcagttcatttcctcctttttatcttttctaacagagcatttatatgttgttcattactaatcattcaagaagaaaacattctcatattcttatattaacaggaaattgaatatggaccattacaatgagggtctatagtaatttaatatgacaaagaccgttagaaagcttcaaaattatttttaaggaaaacactaaccacctcatttatttgtgattttttttttttttgtaagggaatccaaaagtacaatatagtgatattgtgataagactccctatccatggccgggcgcggtggctcacgcctgtaatcccagcactttgggaggccgaggcgggtggatcacgaggtcaggagatcgagaccatcctggctaacaaggtgaaaccccgtctctactaaaaatacaaaaaatcagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaaaagactccctatccattttgagaaactacaattgagtagcaaggtgtcagaaagtacaatcagttcttatatcaagattcttacatggtagaattgctggtttagaaaaatcagttcaaatttaaacgataatctgatcaactccttcttggaaaaataaaccttattattcataactttttaaaatttatattagtcaatcattatttattaggttttacaaaaaacataagcaaaaagtatagtaaactgttgattacattttacaatactctcttgtgaacaaagaagaaataataatatagaatgcttacatgcttatgttcatgtatgaagtttcctcagttgtgttgggctaatgtaaattgcccaaacttcttctaaatggcagaaaattagatcacaatgtggatgaacaaacagaaatatctctacatcattactttatataaccagaagtataagcatatattcccgtttgaagtattttgttaacaattaactttgctaaatatttgtaggtattttattgataaatggaaagtgctaatttttcaaatcaattagaatatttcaataaacaataaaagttgatttctaatttctcccaatattacacctggtaaattgctccagattttataatacaaattggagcagatgggactgtgagagtggctctgactgtggcaaatcaattttctttaaacatttcctgtgccagggtagggcccactcccatcatgtcttccctagagaacgccaccgcagcttcacccttccttaaaaataattttgggctgggcgtgatggctcacacctgtaatcccggcactttgggaggctgaagcaggtggatcacctgaggtcaggagttcaagaccaggctggacaacatggtgaaatcccgtctgtactaaaaatataaaaattagctgagcatagtggtgcacacctgtaatcccacctattcgggtggctgaggctggggaattgcttctacttgggtggcagaggtttcagtgagccgagatcgcgccattgcactccagcccgggcaacagaacgaaactccatctcaaaaaaaaaaaaaaaatcctttgaacactggggactctgtgtgcttttctgagtttacattttgtcatctaacctcaggaataataatattccctcccattcttcttcagtttgcataattatgactgtattaatgtttctatcctaattctcaaccaacttggcagtcaaaaaatatatattaaaaagctcagagcgtttgctatgaaaatcaggctagaaaatggccaaattcctataaaagctgtaacacctaaattctaactgtttttacacgtaattgcacttgtttaaaattttaggttcagtgggtacacatgtatgtttgttacatgggtatattgcataatgctgaggtttgggcttctaatgctctcattgcccaagtagtgaatatagtacatgatagatagtttttcaaccctttccctccattcaccctccccatttttggaatccccaatgtttgcatctgacaaaggactgatatccagagtctataaagaacttcaacaaaacaacaagaaaaaaaaaaaaacaaataaccccattaaaaagtgggcaaaggacataaacagacatttctcaaaagaagatgtataaccagccaaggaacttatgaaacactagcatcatcactagcatcatcagaaagatgctaatcagagtcacaatgagatgccatctcatacaagttaagatggctattattaaaaagtcagaaaataacagatgttgctaaggttgtggagaaaatggaacgcttatgtgctgttggtgggaatgcaaattagttcagcccctgtgaaagcagtttggagatttctcaaagtactaaaattagaattactgttcaacccagtaatcctattagtggatattcaactaaaggaaaataaatcattttaccaaaaagacacctacactcatatgtttatcacagcactattcacaatagcaaatacatggaatcaactcagctactcatcagtgatggattggttaaagaaaatatgttatctatacaccatagaatattacacagccataaaagagaacaaaacctttacagcaacatggatgcagctggaggccactatcctaagcaaattaacatagtaacagaaaaccaaataccacacattatcacttataagtggaaaccattgggtacacatgaacataattgtacatttttgtacatttttattctatattcttgccatctttatcttctaggttataggaagcattatgatctgtcacttaagctatattagattttggagtatgtgttttaaagtaattcaatttcctgtatatgtcaagggaagatcacctaattctgacccttaaaaagccctgttttgaaaaattttaatagtcattcacacttctagaaacacttcttcacaaactctagtttctttgttcttgctaacatcaattagtagtaagaattatataatattttatcaatgtattctaagagaagacaatgcctccaagatagtaaagacatgtggatcaaaattaggggtaaaattccaatatgtattataaattttaataactatttgaaatcattttatgtttatcatgtcatttaaaaatactaccagtgtttataaaattattcagtgatattaaagaatgataaggcaggcattaatcaggatcatcatgataggtatagaaaccactgcaatgaggttttgtggtggggagagagattgggctcgactccaaatataacaaggaaaaatgataatttatagccaaggaacagtgtgtgtggcaaggggtcagcggatggaaaattgctaagaagaaacatgaggagtaaggaggaattctggctaaactgacataaaaggattcttgctgaagacaggccaggagatcagacaacacctgtgggatggggtatggtggaggatgaggaacccgattagattttgagagtgaccagatactagcatgaagcagtattcttgctagaattaaacaatgcagaaataaacatggaagctcaaaagtcaaagcctggttgagcaaagagttcagaggaggctgagtaggttcagtcgggagagaatattgtcatcatgtttaaaattcattgctctgtatatctcaattatgtttgaaattttattcatatttttaaaagtaatgcaaagaaacagctttcaccattacaaaatttggctttcagcatataaaaaacaaaagaagacctctaataccagcagaactataacagaaaaacagctttactctgaatattaaagtgcaattataaaaatttaaaaacaatcacatgcacacacataatgataaagtagatctacctgctttactcgtgtaaaataaatatctttatgtctcagattgaatcgctctagtgtttattatatctgtcttgtattttagatttttattaggaaaaattaaataaagggtttgtaagtctacatactaatattctgaagtatttgcttaaaaaagaaatactttataaaagctttatagttagtaaatcaaactattggttgaaaagtgcaagtatttttaaaactaaatatatatgtttacaatcctgccctactgcctgatatttaatatctaaaaaacatcccgcaatcttaacaatctagtaatagactagatgactccttagtcccttttagcagttccttggggacctgtgggaagtctctcttcacaggaacatcttcatttgaagataagagctgttatccatgtgtgctctccatgaagggaggaggttcagagtttgaatggtgctaatgaagttccttgctgtgcaacacagagcacatgcaatttgacgttgatgcaaatgaccctaaatggtgtgatcacttcgtcagactgaatatactgttcctatagcaggtggctattctgcactggcagaaaccgttttaacactttcttcccatttgaacgcagctcttctaacagacaagtataacatattgtaatgtattttaatgatttaaaaacttatattaatctccactttagtaaataccacccccaccccaccaacaccaccatgttttcctgaaatttctatattcttgcttttatctgattagggaaaaactcaatccgtatgtatatatatatttttacttgtagagaaacacctaatatactgatttctcattcaaagattagccaatgtcttttcctggaagctgcctgagaagtaagaaaaaccgaggtgatacattggagttctatttcaatatgcttcttgatattttcctgtgtggcttctaatacccctgtcagattgaacagtgcatttttctgtaagtccatgctctttcctggaacctgactagatcctgcatgctaagattctgtatagaccttgatcaaattcatggacttatcatcacaattttgatttggaaaatgcttttatccttctctttttagtttccatcccatcatctatgtctcatttctgcttatgagctcttaatattacttgccttataagttaaaagtatacctttttaggtgctttcatttgcaaaattttagatatatttaattttgaaattcaaataatgtggtttgtattatttatatttgtatgtttcctgaagatttctgtcaatgttgtaagtcatctggtttgccagtttgattgctaatatttttctctgaaattcttgagaattattccttctcttttctaggtcatcatcctctttcctatttaataatggttaactggagaatcaaagtagatttctcataccccatcatccccaccacatcttttttttttttttttttttttttttttttttttttttttttttttgggacggagtctggctctgtcgcccaggctggagtgcagtgtagagatctcggctcactgcaagctccgcctccccggttcccgctattctcctgcctcagcctccagagtagctgggagtacaggcgcccaccaccacgcccggctaatttttttctatttttagtagaggcgggttttcaccacgttagccaggatggtctcgatatcctgacctcctgatcggcctgcctcggcctcccaaagtgctgggattacaggcgtgagccaccgcgcccggccatccctgccacatcttattaaacttcaactctttagctttgagtcacacatatttttcaatgcatcacattctttccatctctactggcactgatgtaggtcagaccctcatcatacctagcacagattttaggagtcttttatctccttgtcttcaactcttcgcttcctcttcaatctaacctttgttttccacccagtggtagctctttcaaagaaattttcttctaaataaaacctctcagagatacccatgacctacagatttagtttcaaatttttcagcatggtagataaggtcctctgtgacgttaagttgggctaacataatagctcctctttatactttaagtttcattgcaagcctcatgaagagtacttggagttcttccttatgactgttgtttcatgcatttgtgatttttgcggggagaatgggggtgtgctcactcttttttctctttctatacctggcaagcctctgttcatcttttaaatctcaaatatcattgccccctgaaaatttcccatttctctttgggtttcactaagtgattactcctgtgggttcccagtaaatgttatcgcaattcatcatttacgtttctggctgcctcagttcttgaagcagggacttggctgatgtataaccaggacgtgataagggatagacacacaggagacaattaacagatgtttgcgaactgacacaaactttttcattctttttaaatccttcgtcttgaacatatgttcttttaaaatgtattctccaatgtttcaaagtacatttttttgtgtgtctgaatagaattaggattataatgattttggaattaacttacttttgcattgtccatatccttatctgtctgtctgtctgcctgcctgtctatttatgtatctacattagctcaaggttttatatttattttagagggcttccttgaccttctgtaattaatgttttacacattatgaatgtaaccgtagcattcaataggtatactagataagctttctcaaggagaaaaaaataatattcaaattttaaatgataatttagaagcatgatataatttaacttttgaagtatgcaaatgataggctgctattccatcaaaataaaaataacacattcaaaagaattcacattctaacctatgaacttttccttttatttcaatgtaactctcatgcaattaattaaaactcagtggggtattgtggtgaaaattttaatatcatgcagttactttcattaataatatcatttctttggctaagtagaataacaattgagtttatccagctggaaaaagttagacaaagacacataggcaggtaactattgtctattaggtaagaagaaatgcagcttttcttttaacatatatcaaacgacatattctgcattttctaggattcctttaaactgttttatgtggtaactgtcagaagtttagataatttaggtagttatggagttaatagttttagaatatttctgttacaaaacataaatatctttgcgtaccacctataatgtcataaaaccctagactagaaatatctgtttggagacattaaataaattaaattgctaccttaagtaatatggtggattttaagttccaaacaagtcaacaaaaattagaattaaaacattctgaggttttttttactttatactttggaaatattaatcatgtagtctttgtatgtaaatgacagaaatcactatcatgaaaattagatagcagtttttttattaaaatagagtatttattctgcaagttattgcattcattatccaacagtatattaaaatgtactttgatcaccattgtatacttcatcaatgtgcttttgtgcttcattaattagtaactgactgaaagttaatgttcatcctgtgtcagtctgctctagatacatcattttgctattcaaggccaaatcacaaaatgattataaattaccagcagcatttatttgttttacttctcattatgacaaattcaaagatcaaactgatagcatatcacatacatagaataatacattttaatttaataagcaataggccaggcacatttctctatggggaataataaatgaattgattgaaagcagaaggaggttgtaagctttttgataatggtgcagagcttttacatgttgatttgaactttgaaaaaatatgtaatatccttgtctttctcatgaaatatgatgtattttagattttggtttcttgagggtactttaagggttatcttttcttgaaataacatttatttaggcctttagttacacagatttgcattgttggtagtcttcattcagatcacactaattttatttcaaaccatactcacttttgattatgaaacataaaggttgaaatccttcaaatctgaggcatctctctgacctaaatttcagatgacatttaagaatatgattaaacaaattttcaaataaaaacagctggagtgcaacagttttcgtacttttagatactttattttgccactggggaaattatagtaaattaagattaaggattctaagtgaaactctataatcctagtgggttgtttggtattggaaggtaaggaaaagattgttgaaagtcaaagacaaagattgagctctcagatcagtatacaccaattgtagagacaatgtagctggctatccaagttaatggcattagacctctgaaattaaacacgttgccttcagtatgaatctgtagtcaccaagcaaacttctgattatttgaccccctcctagtttttttttcttgcaaggagaaaatatagggtcagttatacaaacagctataattacttttctctttataaaaagggtggaggttacaaaagcattttgcggagacttatgaaataaaatggtgagaatgcaagtgaaaaagacattacaagacaccaaagactggctttttaaacaggcacaatctgaaataaaattgatatgagaatatgcctcagcagaagtgaccttgtcacaaagttttccaacagagctttgcaattcagtagaggtgactcactgaagaagatgcctaaatctaatttatttttaataaaatttattcattcattcacatgttgattggtaattcaacacatatttactacatttttattcaaagtattttgctggtcactggagctacagtattagccatacattccagaactttcttctcaagttgcttatagtcttcctacagcattgtagaatatagtcaatatatatttttatgacttctttccatccttaatttaccttaagtcctcgttcttgccaaccacagttctacaaacaacaacatttcaaaataatttatttaacagttatcataaatataatgaatcatatgtgcttaaataaaacacacatccagtaatttctaaattctagaaatttactgaaacaagattttaattcaaaacttcatcttgctatattataatttctttttttgctcaagttaatttacataagtgtcacttttggccaatgaaatatagtagctaaagtctatgcgccttgtttctccaaaatctttacaaatgccgctatttcatttaagaaaaaaaaattttgttacatattttgcaaaaagcttgaaggaaataaaaactttaaatcttttgcccccccaaaaacttctctgacatattttaagatggctattcagagggcctgcaaacagaagtatgcaaagctatattttatgggggagatttgcatctgtcgagaaaatctgccttgatgcagccaggctttctctgaggctctccctttttcaattttggaaagattaactgagaatctggcacatttaaaagtctgaaacatttaccatttattctctctgagggctgctatctttgaggtttcatctacataaaaagaccacctttgctagccaggcttcctctctcttcctcccataacctgtcttaccatcatcatctgtttttggccatgctctgagccccaattatttctgtaatctcaagatgttatataaacttctgtaccccattaagtggttggagtaattattctgtggttctcccctgtacacattaataaatttgtataccatttcttctattaatctgcctttgtcagtttacttttcagagaaccttcagagggtgaaggggaagttctcccttggcctctataggttccatcatagtttccaaataccaaaattaataatgatattttacctatacagtgagtagttttaagatgccttttgaggtatcaaattaatatttattattaatgtgtcaagcaatgtgttatttgtcacagaggcaagattgccagatgccagcttcattagagtgtaaaatttagggtactaaacattgatgatcactgggaagaattccagatgattgaagactgtgaagccaattgagttttgagcattaaatgaagtgttattaagaatgatctgacctcctctcatgaattgtttcttatgttttctctgttgtctctattgtaatttttgttcagtggaaattaaagtcactcaaggtctcaaattaaataataaaattgaaattgcacatattttctccttttgtggggaaagaggtactgagacaggaataatacatggtggttgcaggagaacagaaaattccaggcagcagtttcacatgacatattttggtaatgggtcctagagatgaaacataactaattttagtatgtttcatcatgttacataggcttcagtgggaaaacaaactctgtggacaacctagttacttattgcctttgaatatgaaatatttgactcagaaagttgacctttaaaaagtattagctttatatcatctaaattgagcaaatgtgtataggaaaggttatgtctcctcatggtcattctttatattattaaattttaatgatatgtttatttgttctcttaggagaaatagtcacaactaaaatattctttccagaatttaaagacttgaaaaacaaatatagttttaaaactcagtttacttgtaataatctaaaaacacaaatagcctaatgattacagagtgaagaagaaggacaattcttaaggcagtatttctggagggttatctgagaattatatgctgcttcttgcttgctttcttgatacgaactacaaattacttacaattccaaactattcccaagctcaactgacataaactacagttgtcccttgaaaaaacatggcattaaactgcgcaggtccacttatacttggaccttcttccacctctgccagccctgggacaacatggccagtatcctcctcttcctcggcctactcaacatggtgatgacaaggatgaagacctttatgataatccactgccacttaatggatagtaaatgtaatctctcttctgatttttagaataacattttcttttctatagagcttactttattgtaagaatacagtatataatacacgtaacatacaaaatatgtgttaaccgacttgttgatgttatcagtaaggcttcttgtccgcaagaaggctattagtagtttgttgttggttttttgttttgttttgttttgtttttgagatggagtcttgctctgtcacccatactagagtgcagtggcacaatatcggctcactgcaacttctgcctcctgggttcaagcaattctcctgcctcagcatcccgagtagctgggtttacaggtgcctgccaccatgaccggctaatttttgtatttttagtagagacggggtttcaccatcttggtcaggctgacctcccgatccacccgccttggcctctcacagtgctgggattacaggcatgagccgctgcgcctggcctattagtagttgtgttttatgagtcaaaggttgtatgcagattttctgctgtgtaggaattggcacttctaatccccatattgttccagggtcaactgtattggtttaaagttcatacttaaaatttttttctctttatattttttaatttaatttggctttatataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagttaatgaaaactcagggaagggaccagaggtaattgttttcttctttggtggatctgaactttaaccagaaaagggaatttcagagaccaacttcatccagtgttttggaagagatggaggggagagagaccttgaggcttctttttcagttcatcatgttaaaatgccatattttggagtatcagtttctgagccctaacattgtgtacatgcatgtatatgtgtgtttacgtgttcatcataaatttagaggctaaatacaactttaaggtgaaacgctagggtgtatgcctatgatgaattactatggagcaattagaaatagatatctacaaaccaacatgaatggttcccattaacacagttttaagtaaaaaagtatgatcaactcaccttaaatctgaaatgaataaagtcaggtgctgcataaaaatatttaggtcaacaatcagctgtacaaatgtatatgacagtggtcccataatattgcaacatcatattttactgtaccttttctatgtttaaatgtttagatacataaatacttaccattgtgttacaattgcctatagcattcagtacagtaacatgctatacaggtttgcagtctgggaacaataggctataccatataccatcagtcctcaacctttttggcactggggactagttttgtggaagacaatttttccatgaaccagggtcagggtgggggatggtttctggatgaaactgttctacctgaagtcatcaggcattggttagagtctcataagaggcacacaagctagattcctcgcatgtgcagttcacaaaaaggtttgcacacctgtgagaatctaatgccactactgatctgacaggaagcggagctcaggcagtaatgctcacccttgcctgccacttacctcagcccagtttctaacaggccacggaccagcaccggtctgtggactggggttgggacccctgccataggtgtgtaataggctgtatcatctggctttgtgtttggtacactctatgatgtctgcacaatgacaaaatcacctaataatacattttgtagaacaaatccccattaagtgacccagatctataatttaaaataacagtgggaaaccaaactagtataataaactcatttccaggccgggcacagtggggctctcgcctgtaatcccagcccgttgggaggctgaggcgggcagatcacgaggtcaagagatcaagaccatcctggccaacatggtggaaccccgtctctacaaaaactacaaaaaaattagccgggcgtggtggtgcacgcctgtaatcccagctactcgggaggctgagacaggagactctcttgaacctggaaggcagaggttgcagtgagccaagatcgtgccactgtgctccagcctggcaacagagcgagactccgtctcacaaaacaaaaaagcaacaacaacaacaaaaagaaacttgtttcccacccaaaagctggcagaaaataatttttaataatttcctgcatattatttatctgttttttgttttgaatgttgtatatttttctcaaatgattaccaatttcttagttttatatattgaactctttattgaataaaatctttgatctcattttatttatttttcccacttgggtaattgattaagaatgtattctctgctaggttacaataatattctcctgcacatccttttaactttatggctttatatattgcattcaggtgtttaattcacttacagtgcatatttgcaattggtgctagttggttcagcttttttcgcaataacaaataacttcaaaagctcatagacttaaaacagcaaaaatatatttctcattcatttgcgtgaaaagtgcaggtcaacactcatgggctctgccatcatgttttcatgttgtaactagactgaagaggcagaggcagcctctatcttagaaatataacagctgttttatcaaaatctgtccacctctagtctttaaacttcataaggtaagggacagagtctgtattttctactttctgtgaaacccttgtttatatctttcgctcatttttctatgtattgcttctgttttatcacaaatttgaaaggaaattttaaaaatgtttctatgccaatcttctgatgcttatacgcattttccgtatcttgccaactgtggctggttttctcactttgattatgccatgttttgatgaaaagttgtttatatttaaatggagttgagtttattaattattttcttcatagttataatttttgtctcactgagggaattcacgctattcaaaaataacaaaaattatctaatattcactaaaagagatttaaaactttgctttttacacttagatcttatatccacatagaaccatttattatttagctgttttaatttgttttgggaatatttgtgtggggaatgagatagaaatcgaataaactatttaaaagactaaatggatgagatctattcataaaatgattcagtgctatcttatgatgtatagaataaaatccaaactctttttctttcctacaagcgctgaatcctctggcctaccattcacactccagttcattccattaattcccttgcttattttgtcactatctgtggctttaattcagtttttcaagtattaaccactttcttttctctttccgtattatccatctcttacccaaagacttcctggttttttttttttttttgagatagagtctcactaagttggccaggctgaagagcaatggcacgatcttggctcactgtatcctctgcctcctgagtagctgggattacaggcatgcaccaccacacctggctaatttttgtatttttagtagagacagggtttcaccatgttggccaggctggtcttgaactcctgacctcaggtgatctgcccgcctcggcctcccaaagtgctgggattacaggcatgagccaccgtgccctgcctgacttcctgtttatttttgtgtgtcagtttaaatgctgtgtttttagggaggccttttctgcgccatctatttaaattgtcatttcccttcaatttctgaagctagttctgttttttacagaactcttatttttttcctttattttttgttcatttcattattactgatttctcttcattgtactcaagcttcatgaggcagaaaccatatacatgtatattttttacttttgctccttgaagcccatcaaattcctggcatttataggtgctgaacaaatgaacaattgaattatgtgtcctcatttccttcttactttcatctaattaatcatcatattgcctaggttcagtatcttccatattctcacattagtccatttttgttaaaaacttatgggcactgtcttattatataaatctatgctatttcttattgctactgccatattatagatctacattatttattaaattgtaagctgtttttttctcttttacctttcccttctacagttctatttctacacaatagatcttcctaattttctaactgcatggcttttctggttataattctttaactcttcttcatttgcttcaagaaaaaaacctaaatttgtaatatgtacacaatattctgttgattcaacattctattccagctaccttctcatttcttccactttttactgcataattttgtaaacgtttttgtaaatatttattttatttatattatatataaaatatttatattaaatacaaaactttatgttttgtataaataaacattgagttctattatctttttcgcatcaccaaatctcttttcctttctctctgtgtgtgcatatatgtgtatatatagtttttattgattgattgatttgtggaatatttcatgtatacatgaaaatgtaaagaataataagatgaacttcttgtacccatcaagaattagtgacttgtagccaatcacactttatatatgtccacccaactatctcaaaatactggataattttgaagcaaaatcagacactttatttcatctataaatactttggaatgcattttttttttttttttgagatggagtctcgcactgtcacccaggctggagtgcagtggtgcgatctcagctcactgcaggctctgccttctgggttcacaccattctctggcctcagcctgtctgtaatctcagcactttgggaggccaaagtggaaggatcccttgaggccaggagtttgacaccagtctgagcaatatagcaagaccccatctttacaaaaatatattttttttttgagacagagtttcactcttgttccctgggctagtgtgcaatggcccggtctcggctcactgcaacctccacctcctgggttcaagcgattctcctgcctcagcttgcagagtagctgggactacaggcgcctgccaccacacctggctaattttttatgtttttagcagagatggggtttcactgtgttagccaggatggtctgcatctcctgacttcgtgatcggcctgcctcggcctcccaaagtgctgggattacaggtgtgagccaccgcacccagcctggaatgcatttctgaaagagaacttttagggcataatttacatatacatagtaaagtacacaaatcttaagcagcttgatgcatttttacatatgtatacaattatataaacaacttacatcaggatatataatagaccatttacaccatactgcaatttttttcatggttctttccagatggcatcctctatgggtaaccactattctaacttcaatgaacattggttaattttgcctttattaagactttattaaccttagaggaatgtaatctaatggcatctctatggtgtctggtttcttccattaacataatattgctgagatgtatccaagtagtgggtgttagtgatttattcctttttggtgttgagtagcattccattatatacatatgccacaattatggtgaaaggcatttatattcttcctaatgtttgctttttatgaataaagctgatgtgcacattcgtgtatgagtcttttggtggatgtatgctcaacaaagtggggacatgttcaggcatattatatattacaaaaccattttccaaaatggttgaaaaattcacgctcccacaagcaatggatcaaagttctagctgattcacattttcgacaacattattagtcctctcaattatagctattttactgatttatattgatatctcattgtgttttgattgaaacttttctaataaattgtttgaccatgatacatatgcttctctgacattacttctggatttgtgctaattacaaataatgtggcatgcacattcttgtacatctttttacttggtgcagttaccaaatatccacctgatcctagtgattaatttgcagctatgcctactacagatcataatttctattcttatctttagcctggattttattatctacacttggccctaagactctctactttagcttgctgatttcagcagatttctgtgtctctcaatctgtatttagcaatgaacctttccctaattctagcatcatccataccttcggcaaaatgcaaagcttcatctgcactacagtcctaccatctcaccatcttggcatcagaaacaatggcgaataatctacagaatattatgagaatcattgggtaaaaataaaaggatggagaaggttttaatagagaaggcaaaatattatcatggaagaaaacagcagagacacgtaatagagtagaaatcagctggagaagtttatattgcatgtgttgagctcatcagaaagatgatatgtttggtagatgaaagaagagactagttggtaaaatgtcttgaaaattgatcagtttcgttttgatttaatagcaaatagtaatcagccatgaaagttctcaaattcagtttcttccatgaacatattttacatgatagtttttcttatttcacaaaagcataatcaattattaaaatttaaatgtaactatgaatacatactgtagtaaaatatttctttccttgtataaagcaaatcaataatttttagaattaaatattttctattgcacctttcttaaaaaaagaagtcttgatccatattttctcagtgcctaagtaatatattaggtgtgtgaattaactttctagattaatattggtagatgctctgtacctcctcctgtgaaatttatgaagattaagtccattcactcacagcacctgtgttagtaagaacattttaaaattttctcatgcactgtttaatttaatgatttactttttataaaggagagtgctagtaggtattattgtcattttatatctgatgaagaaattactgaaattaacttagccattgaggacaaggcttagatgcacaccggaatctactgattcaaaacccatacctctgtctaatgtgagttatctgccctcttcactgcatgatttccactcatgtgcattctaaaatacatctaagatacaattgggattctatctaggagggtttcattttatttttcctgcagattgcagggaatacttgttttcttctctggagaaagttgataatttgtcaggtgcaactgcctccgattttaggaagtcatttaagtaatttcccttccattaaggctaataagaaccttccctacttgtttaattttgtgctttctggacttcaatccatttacaatactttagaaagtactaaatttaactgtgatcctttatagtgtgaagtataattttttttataatgttatctattaagaattcttgagacaacaggttcaaatctatgcccatcaactctttctggttttgttttttctgagtgtgtgtgtgcgtgttaggaggggagcagggaggtggtgttcacaaccatgatagatattatactttccattttttattctattattattatactttaagttttagggtacatgtgcacaacgtgcaggtttgttacatatgtatacatgtgccatgttggtgtgctgcacccattaactcgtcatttagcattaggtatatctcctaatgctatcgctccctcctccccccaccccacaacagtccccggtgtgtgatgttcccttcctgtgtccatgtgttctcattgttcaattcccacctatgagtgagaacatgcggtgtttggttttttgtccttgtgatagttttctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccacaagaaacattcgtgtgtatgtgtctttatagcagcatgatttataatcctttgggtatatacccagtaatgggatgggaggtggagtctcgctctgtccccccaggctggagtgcagcagtcgggatctcggctcactgccaactccgcctcctgcgttcacgccattctcctgcctcagcctcccgagtagctggggactacaggctcccaccacacccagctaatttttttgcattttcagtagagacgggtttcaccgtgttagccgggatggtctcgatctcctgaccttgtgatctgcccgcctcggcctcccaaagtactgggattacaggcgtgagccatcgcacccagctgggtattgtactttcaaagagaaaagcaataaaaataaaagaaaaataaaagcagacgatcttttaaaagatctctataaaaattacataagtcattttgcagaaattattgtaaaactggttattcatctcagagacttgacttcaaaacaaaaatgaagagcctgaacattatccactgaatttttccattctgaaaattaaagccagaaaaatcccagatcactggaagcctttttgcagctatcagcttgattctatgttctaaattactggaacagtgatttatagtgactatttctaaccatttcacttacttttggctaaattgtctttgctttagagcaatggtaacctctttgactgtacatctaaaattctgttttaagtatatcccaattcttctgtgcctctgttgccatctcagttttccaagcttttgttttctctccctgttttcctcttcgtggtcttttaaatttattttgaatgctatatcttctggatgctaagttggttttcttacataccacagtgactagccagtcaccctcttgcactcatgaacagcaatctattgagttccatgtatcactaaacatctttcctagtgctgtttcaatcatattcatgttatattgctttctattatataggagctgtcccctctgggcattttctgcccatctcccccactatttccttttcactccaaactgccactttatatgtctctcatcattaaatgtgtagattgatcttactttctttcagaatttcttgactcagcaaattgagttttgatctttaattcagcttttaatgatggtagtgatggtggtgttctggtgatgtgtatgcaggtgtattttattcatagcttcttcaggttttaattctctaaacaaaatcccctctgcctattcataatccagccaatgtaatccccaggggcacagagaaagcagccttcaattagggattagtcaggccaggtcatggttggctaaggctcctggctgagcctcctactagatcccgctgtcactctcctactgttgtaattatggccacttttatttaaatacccctgccattttatttcaaagttattggctgattttttattttccctttcttccctatattaataatatttttaaatattttactgttaagtattgagggaaatcaaagtatttcactgcaaaatatacttctttgacaaattttgagaagtttgttaagaggacctgcaaacagaagtagccctgcaaagctgtccttttgcagggagatttgcatctgtagagaaaatctggcttgatgtagccaggttttctctaaggtcttcccttttcttaatgtaggaaagattgactgaaagtttaacacttttgaaaatctgaaagaaacacttaccatctattctctccgagggctgctttctgtgagatttcgtctacataaccagaccacttttgctggccagacctcctgttctccccatcccataacctttttatcaccataacctgttttgccatggtccaagcttttttctgtaaccttgctacaggaaaagggtcccaatccagaccccaaaagagagttcttggatcttgcgcaagaaagaattcagcgcaagtctgcagtgcaaagcaaaagcatgtttattaaaaaagtaaagtggtgaaagtacagattctccatagacaaagtaggacattcctgaaagtaagaggaagaacgcgtctaccctaggtacaatgcttgtatatatataggattaaaaaaaggtcatgaggagatgtgctctgttacaaggttttgtggtgaagaattagttttcttaattactatattttgcaagaatcaatattattatctttaaagtaaaattaggaatctctttgttctcaagatatcgggatatctggacactcccaagtctgggtctattcagtaaacattatcaatcggtttccttaaccataaacatctagaggccaggaacacctttcttccagggaatgcagcccagcaagtcccagcctcattgtcctagctcccactcaagatggagtcactctggttcgaacgtctctgacaacctcatgatgatagatacatttctgtaccccactaggggttgggggtagtcatgctgtggttctccctcatgtgttgtccctcccaccttaataaatttgtgtgccatttctcccattaatttccttttgtaacttgatttttcagtgacccttcagagggcaaaggggaagttttcccttggctcctatggcatgttttttgtttaaaataaaagtcaaaaacattgattaagttgacagtccattggtaagcatgtattaatagcatgtttttttctatgtgattttatatttaggaatctggatgaataccatactatttgaaaaaataaatttaatggttaccaaattgaagaataaagaaggttaaatcttggtaagctatattagatatactgtaggggatttcaatccatttttatgggtttgtttggtttaaatggagtgtttagttaataatactttgaatcgtgccttctattttatttactcacagatagctacaccattaaatgctctatttttaggagatttgctatttagactagtaataaaatgtccagggtaaatggagttttccactaggaaacatatttttatccacttatacatatcaagttattagctaataagctaataataggtgataacatattgaagaatgtaaatgagaaacactaggtttcattttggagaagtaaagacatctcttgtttcatattgttttacaattgaaaccacagatttatttacttaaaaaaaattaatagccattttccctatggcgcttcacagaaagttacccatttgtaacacttctttcagaatgttctccacaatcaatattttttatgggtggaactatgaaaaccaagaatcaatagttgattataataataatgacattagtaataaaagttgcaatgctttatgtaaatacagtgacttttttattgatctcaaaactgcttgtgtgtgtaattataatattggctgattcattcatattaaatacctatagcaaaaatagaatgagggcttgaagtcattggcgaatatttccatatgaaatgttatgtctcttatctttagtttagatatggatatttatgtttaattttttttgaattagcaaacatgtagtaaaactaacaggtgttcaaataacattcagaggggaaatgtcactattaatatgttttacacataaaatacaaatatctacatgtttaagtgccctaggataagttattataatttttcttttttctctctcagaattatatcttctttaaattattgatttccaaatatttctcttgagccaagacaccacgctgaattccacctgcctactttgtgtcatcacttagatatctaatagatattttaaacttaacatgtgcagatataaccttctgaacctgtttcttttttgcctcagtaaatgacaactccattttcccagttaacttggttcaaaaatcataaaatcaaccaccaattgatcacaacctgttacagatttctttgttccttcttcgcgctcactgctccacttgactagccttgaaaaataaaaattaaaataattttttttgagacgcagtttcgctcttgttgcccaggctggatggagtgccaaggccccgtttcagctcactgcaacctctgcctcccaggttcaagcgattctcctgccttagcctcccgagtagctgggattacaggtgcctgccaccacgcctggctaatttttgtatttttagtagagatgtgttggtcaggctggtctcgaactcctgacctccggcaatccgctcgccttgacctcccaaagtgctgggattacaggcgtgaaccaccgtgcccggcccgaataattttttaaaatgatggaatcattattggattttatttttctccaataccaaatattctaatatttagggaaacctattgggtttcttcagagtgtatgcagtatctgaccacttctcaccattttcatttttaaccacttatagtccaagctattattccatatcacctagattattacagtgatctccaaactggtttgcctgcttatccctgtgttccccttcacccccagccaaatctattctcaatacaaaagccagagtaattctattaaaatatatggagatcattgtactccttggctcacaaaactcattggctctttatttaacttaaaataaaagctgaagtccttctaattaccaacaagaccttacatgacttggagccctgttgctctctgaccttatctcctaatgctctgcctccttgctcactccaccccttactggtttccttgacttgattttaatagactaggtaattccattctcagggcctttgcacttgccattcctgccacctggaataatcttccctcaaatatctataggcattttttcctcacctgcttaagttcttgttcatatgttagtttcttagtgagctctttcctatctaaatattgtaaacatctctgacacctcctatctacattttgtgcttttttctccttagcacatattttttagttaggtttattgttctctgcctcttctctagaatgcatttttttctgtgaaggcagaacttttttctttttcttttcattactgtagctccagttcttgatgcataatagatgctaagcagtatcttgtgaatgcatggatggttcttcctattcctctccctataggaataaaaaatttggaagtaggcgagagaacactgcttagtgaatataaactaagaatggaagtacttatctcaaaggtttcaaatagaaactgatgttatgatgaatcattctttcaatctctttgtcacacagtgtggtcagggagcaagagctcctctaggtttgggaacaggatagcaatccactctaaaatcccatcctcctgttgtgttgggagaacattttgaattgagggtatggtaaaatactgtttcccaaacaacttactcattgaaacattgttggctggggtgtgtgtatgtaagggagagtagaacattctggaattatatgaaactaagtctgttttgctaaaacaaaatgaaagttctcagcattcactaggatttttaacgtcctgcaagtgattgattaagcttttccaacaactgatttttgtaacaaatttcatttaaagggatacaaatggcataataagatacatgatatatctttttattttcctgtattactttgtatctctcagtgctacccagaagacagtcactgatggtaatcaacaggcttctgtcactctgagagatagaaagagtggatgcaatttactttaaattctttttaaaccaacccttgatgcctggcttattgcagatacctggcccttttggctatcagtccttcagaggcatcagagaataaatacccatcacaacagctcctggtgttgtcctgggatagtggatgccgctttcttgaaaactgggtattccatctgttgataaggttgaccacaaatgttagcaatagtcccacataggtcattataatatttgtatcttaagtgtgattaatcttcttctttcagtttatctgtgaaactctcttatgcttttataagatattaatgggacattagtataatcttaaattaagattggttaatactgcactgttggtacataatttatgcttttagcaaagatggcttgtgatgtaaatattgcttaaaaacatcaatacaggacttcctggaagttccataacattttacccaatgatggggtagaggttaaaaggagtaatcaatgatttctttgatttttctcactgctgaggactatcctaagtgctttatatacatttacattaattcttaaaacaatctctcaagattggtattattagaaccactttattgataactaatctgagagtctcagagtggttaagttgatttacccaaggtcaagttgacagacggttaatctgcaaatacttactgaacatatactatgggtacagttattctactgagatgatacagacaacaaacagagttgcaatcctcatgtcttgccagatgataaaaacccacctacaggagtaccaaaattgttattatgaattaataatgtattcgtattcttgagattttgctcattgtagctgtcatttaaaacaaactttaggctgggtacggtggctcacgcctgtaatcccagcactgggaggctgaggcgggcagatcacctgaggccaggaattcgagaccagcctggccaagatggtgagaccctgtctctactaaaaatgcaaaaattacctgggtgggatggcatgcacctgaaatcccagctactcgggaggctgaggcaggaaaatcgcttgaacctgagaggcggaggttgcagcgagctgagatcatgccactgcactccagcataggcgacaaagcaagactatctaaaaaaatgaacaaacaaaaacaattaaaaaaaacccaaaaaactttattttgcaagtgtagacatgacaatgtattaacttaaattaacctgataactttagccaaatgtttattgtgttgtgttatttaacgttagataatattagtttgttttgtgtaaatagctgcaattacacattaaacaagaatgcaggaccagcctataactgtagctaatagcatatatatattatgttatagggtttacaaaatgattgttactttttgcagtatcacaataatcctatgaaattagtccattttgggggtgggggcaaggggagggatagcattaggacaaatacctaatgtatgcgaggcttaaaacatagatgatgggttgatgggtacagcaaaccaccatggcacatgtatacctacgtaacaaacctgcatgttctgcacatgtatcccagaacttaaagtatgataataataacaaaagaaattaatccattttaccgattaggaaactggagatcaacttggttaacaaatgctcaaagccatgtaccattaagtggaagagggggattcaaacccaagccctctgtgccatttttctagctcttttcaagataacaatggaagatgtgaactcactttctgatgttctatgattgaaaagaaacatgcttccacaaattgttctaattttactgcataattgagcagattatactataaattaatgtgttggcacagttaactatttcttgtttacttttctttccctaaggagtctgctactctgcaggaggccttttaaacagaaacatcccattaactttcttaacacagaggcgagaaaacaaacaacaacaagcatagctacaatcgctgttattaggcaccctgaaaagatgtaaccctgagcattggatagcagtaaatcatagaaggggggtgtcaggatggggaagccagaaagtctagcttactttttctcaaaatatgatctgctttagaatcctgagggagttgattaaacatgcagattcctgatctctggcccaaactactgaatctcagtctaacggcagagttcctaatgggcctgttttcataaagattcctggatgatggtttttgtttttcactcttgtacattaaatattaggactttgagaatctagttcattctgagtcatatgcttcagttaaggtactctgtctgcatagggtactctggctaatttaaacaaacaggaatttactaagagcacccaaaagttactgagacaagaagcagtattgggaataggaaggaatggagttaccttggggtctaggaagcaagaaccacaacatgaaaaatctgttcaggctattgtagctcagtctggatggatgctcgccgtttgtagtgtctttgtttgcatgcacaggtcatgtgttggtcccgtgtgtaatgggtaggtgggcccctgcagatgaaactggattgaatagggaaaagataagtccaaaaaggaaagggaaagaagggaaattaatactgagtagtccaaacatagcttttctacagtacaaaataatctagtttcactattgattgaagctaattgctattcctaagtaccctcctaataagacctagtctggaagggcccttcactcataaaaacaatgaggcatttaaatgctgatgatgggcctggcaccatagcttatgtctgtaatctcagcactttgggaggccgaagtggagaagtggaaggatcccttgaggccaggagtttgacacttgttccctaggctaatatgcaatggcctggtctcagctcactgcaacctctgcctcctgggttaaagcgatttttctgcctcagcctcccgactggctgggattacaggcgcccaccaccatgttcagctagtttttgtatttttagtagaggccaggtttcaccatgttggtcaggctggtgttgaactcctgacctcaggcaatctgcccaccttggcctacaaagtgctgagattacaggcgtgagccactatgcccggcccaaaataattttttttttaaaaatgagcaaggcatagtggcatgtgcctgtagtcctagctactggggaggctgagtcaggaggatcccatgggcctaggagtttgaggctgcagtgagccatgatcaggccactgcactccaggcaggatgacagtgcaagatactatctcaaaaaaataaaatgaataagtaaatgcctcttatgaaccctattgacatcaagtaggaatgagcactagagctttaagaggcctcagctcagcctatccagccctttggtggtgctgtgtgtctacaaaactttcctttgtacacagctactttttcccctacactcacctcaaaagggcttgtcaaggttgaggttgtagcccctagttattgaattgtttaattcaataacttgttttgtgaaaacgtagcagagataaataactttttctatgtaatagaacccacttaggatagttagctgattaaagtttatcatataactatagtgtccataccattaggtttccattgtctgcccttggccttaacatttcctcaacatagaacactcctccaaatcatatttctgactctttctcagcatttgtatttccgctcaaatggcattttctcaaagggaaatctttatgaacttcctcacaatgcccctgccttctactctatcctcactgcctgatcactccctagtctattatgatatttttccttcatagcagtcattatctgattaataagcatttttacttgtttaagattagtctctttatgctgcctcccaacatacaaacagtccccccaaactgtaaagtatctgctttcctcaacaggttatgaataagattgccatttatttaaagtaggacttgaatagatatttgttacttaaatccaaagctatcataatgccaatctctttaacaggggcacagaaggcccttcctttccattctatctttaaacacattatcatttatcctatgccttaaacagaatcgtgtttatagtttgctgaatatgctatatgctctttcatttttcatgaggatttctgttttttttttttctttgcatgcacagaatttaaaaaaaatttaaaaaaaggaaaagtcacaaggtggattaggttgctagaccttaaaacactccatgatttctttgtcttagtcatttcctttttttaattgctaaattttctttccagattccctgcttttcttttagtaagagtttaactgtaccttatacaaatcagtaattattctcttaataactagttatactacagggttagatagttggctcattcattaacaaagttaaacattttattttaaaacaagttttattttgtaaatataaccatttagcaataacttaaatttaagtttaagccataaatggaaaaattactacaacggtaaagcaacatgtaagtcagtctcaagagtgtttaaattttatgcaatgattaggaaggatgataggtatcagatctgaaactttataaactgtggacccttccctctcagcctatacaaaaatcaactcaaaatggattaaacacttaaatataggatctgaaactgtggaactactagaggaaagcataggggaaatggttcaggacagtcaacaaaaccaaaaatagacaatgaggttacataaaactgaaaagcttctgcacagcaaaggaaacaataagcaaggtgaatagacagcctgtagaataagagagaatatttgcaaattattcatctgaaaaggggctaatatccagactatataaggaattcaaacaagtcaacagcaaaacaacccccaaattattcaactaaaaaacgggcaaagcgtatgaatagacattcctcaaaagaagatattcagataaccaataatataaaatgatcaacatcactaatcatccagaaaatgcaaatcaaaaccacagtgagatatcatctcactccagttagaatagctaatataaaaaaagacaaaaaataataaatactagaaaagatgtggagaagaggcaactcttgtacaaggttgatgaaaatgtaaattagtgcagttattatggaagtcagtatggaacttcctcaaaaaactaacaataaaactcccatatgatccagcaatcctaccactggatatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatgctaagtaaagtaaggcacagaaagataaaataccacatgttctcactcaggtgggagctaaaaaaaaagtgagctcttagaagaataaagtagaattatggttattagaggctgagaagtttagggaagagggaaagaaaaaaaggttggtccatgggtacaaaattatagcttgataggaggaataagttctagtgttcacagcattgcagagtaaatgtagttaacaataatttattgagtttttttttttttttttttttttttttttgagacggagtctcactctgtcacccaggctggagtgcagtggcacgatctccgctcactgcaagctctgcctcccaagttcacgccattctcctgcctcagactcctgagtagctgggactacaggcacccgccaccacgcccggctaattttttgtatttttagtagagatagggtttcaccgtgttagccaggatggtctcgatctcttgacctcgtgatccacctgtctcagcctcctaaagtgctgggattacaggcatgagccactgcgcctggctgtattgtgtattttcaaaaagctagaagagatgattttgaatgttcccaacataaaggtttgataaatgtttgaggttatggatatgctaattactctgatttgatcattacacattgtatatatatactgaaatatcactctgtaaccataaatacatacaatgattctatataaagataaaatgaaaagtaatgtttatgcttttattgtcaaatgtaattatatatatttaatttttgcttatgataagactattagagtctgcagataaatttaagtgcttaagaaattgaaacacatcagagttttacattgaaatgtgtggatctttcttcaagagtctcaagctcatgcttaactggacaattgaaaaatatcactctttactgatttatatcaagttttatttgtactaaaaactagttttagtacttacctttaattttctagtactaaaactaaaaactagttttagtacttacctttaattttctaaggaaagctagtaagatgctttggctaactttattgaagaataacttggtatgaaattatgatttgtgatagaaaaaagaacttagattttattatttattttcaaaaatcaaattaatgaaatatttagattgatcttttttgttagtcaataaattctgactgtggttgatcatggttttccagggcagacactatattaattttagtgtcatttgaaagaaaaatatgttacaactgagaatatactcatgaaaagataagtaacaatttaaacaatacacatcacaaataaagcagaacctattttttggaaagacttgctgtattattaaaagaggctactattggtttgattagtgtgacaaacttcatgatggagtgggaatttttaatggtcatggaaaattatttaatttcaggaggcgaaatattgatggatgagacattcaacaaagggttgatagagggagataggaaaggaaatagaaatgtacctggagacagatattgtcaatatgaccagggagaattaattgtgtatggaacagtgagatacatttgaaaatgtggtataggatagattatacagaattctgaggagtttaatactgcatttgtatccattagcaatggtgagctgtttaaaagaagtttttgaatctttagaatatttatttgaaaggtttgatatatttgttttccaagtgtgatctaaagatagatcacataataaaattgtctagagagttgctaaaaatgcatcaagctcccaaaccctaaccttctgatgtagtatgtttgggtgggaaccaggactacattttttagcaagatctcttattatttatcacttcacaataagtcttagaaccattggaggaggaactatagcctgtggagctcccttctctaaggttgctggagcccagtctctcatgcctctctcagcttattttcaaatataaaccatctcaaacattgtgactcaacaatacacctgaacaattaaagatgagtgcattttttttcctatgctaaacctcaaatgagtgaaatggaccacccaatagtcccatagctagctttttaaaatttttattttataaacatagaaattgactcttacggtcttaaagtttcaaagttatatttgttttatctgagttccttcctgaggaaaggaccttcaggcctctcaaaaaacgtgtcaaagaactgaaactcatcagatcaccatgtccagacaatgaaatactgaaccccctcattcatcatgattactttcttgccgctccctagttcctgttttcttacacattgtttcatttctttcctgctgtataaactcctagttttagtgtgtcaaggagatggatttgagaatgagctcccatggcctctgctgcagcacccaattaaaacctccttccttgacaatactcattgtcttagtggttggctttctgtgcggtgagcagcaggacctagaccaaacccttggtgtttcagtaacatgatcagaaattgtgatttgcttccaacctgtgttcaaagccaaggctctcagagaacatcattggtcacctttattagactgtcaccatattaagtaggactcttctgattgcatgatataaaatccagagactatgcaaacttagcaatatattttatagaagaataactttttggtagaaaaaattaggagtgccacttgggccttgttttgttttgtgtgtgtgtctgtgtatttttaaagtataagtctaaagtgacattcagaagagaaatgtaactctatacctttcattattgatgcatcgatttgaataatttgtgtaagttcttgggttaggcacacatggagtgtgtgtgaagagtaacgaagccttccatttgttcttcacaaatttttaaatgtgtctcctttattctttccattttgaaaaattaaatcattctcacgcctccatttgctaggtgtagatattcatatttggaaatctttgtatcctctgattgatgggtataagtctgtcatggaggttgccatgtaaagctaaatgcagaatttgttttctctatgaattgattgctcatgtaaaatcactttttactgctgctggtatttaacacataaatctatcatttactttttttttaagtgaaggagctactggtttatcatgtgtaggaaactttttttcactatgtcatcactaaatcgaaggtaaaattatgtttttttcctgaactatgaattctatgctttccttgaaatagataaaatagataaacaagtaaggtattagaggagtctggaaaatattcattagtatccacctttaggtttacctgaagtagtcaggattttctttttagtattccatttttatatgaagtaccattttatatcaacttcttttgttccattgtcagaatctaaagaaatattatctttctacctggcatttaaactggttctctatttttaatggatgatgtgcattgatttgaaataccttgataaataattatttaaatggatgaagagacaaattgttccagtaataaatatttaacctaggagtaggttaggcactttaaaaagctgtagtaatacatgcaaggcattttggttaatattcaaaaactgacctctgaaaataataaaaaatgtgttaattataatccaagacataccagagtaaacaccaatgaatcctcctttattttaccttgtctctcaatattctaattctgtaacaataaatatactcttaaaggtgaattttagacattatcaatttatctattagaaaattatatgatgctaattccatcatgatacatatttaacaatgtaataaattaattaagttaaacacaatttattagattaattacatggggcttaattagtaattaaataaactacactataacatatttacaccaatttatggaaaatgcttttctctttatctttattttttaattcctgacaacctggtagaagttaaactacagaaaaaacatctgcattctagattttgattattagtattctaaattacaaatgcttgtacttgaacaaattatattatggtaatttttttcctttaaagggagaatatcaatggttgaagatcaggctatttatcatcatctttgaaaaagcaaagtaacaatacagcccatttaggagacacattaatctcccatgtgactccagaagcaaacagaattttaaaaagcatcttcagaaattatttggaatatacttctgttctctaagaatatatctctaactttcttttaacaatttaagacataaaggcaacactagatactgatgcttcaggaagtgtcacagtagaaaagttttaacagagtttatagccctggggccttggaaggaaaagctaaaaactataagtagggtagtagtgaattacaatgataaaaactaaatgtcttccttttgcacattaagttatgttaaaacactgactggtaagttacagagctgcggtttgaacctacatttgtctgaaccaagtttccacacttttgaccacaataccttgatgcagtgattaagaaggtattttgttgaagcagataataggaattcatacacttcctctgtacttgctgaatgcatgatcttggacaagatacttaaggcctttgtctcaggtttttgttttttttgagatggagtcttgatctgttgcccaggctggagtgcaatggcgtgatctcagctcactgcaacctctgcctcccaagttcaagcgattctactgcctcagcctctcaagtagctgggattacaggcacctgccaccatgcccagctaatttttgtatttttagtagaggcggggtttcaccatgttggccagtctggtctcaaactcctgacccctcaggtcatctgcttacctcggcctcccaaagtgctggaatttcaggcttgagccaccacacccggcctcagttttttaattctaaatggagtgataatactataaaagtacttacttcatgtattagtccgttctcacaaagctataaagacatacctgagattgggtaattgacaaagaaaagatgtttaatcagctcacagttctgtgagctatacaggcttctgcttctgaagaggcctcaggaaacttacaatcatggcagaaggggaaggggaagtaagcacatcttcacatgagagcaaagtgggaggtgctacaatggataccccattctccatgatatgcttgtttcacattgcatgcctgtatcaaaacacctcgtgtaccccccgtaaatatatataccgactatgtacccacaacaatttaaaaaaataaaataaaatgacttctccccatctgtagattatctttaatttctttaaggtttattttacaggtcaaattccaacataaccatatttatcaatcttctattttatacttagtttttttatgtcttatttaagaaatcctacctttcccaagactttcacctttaatatttgactaaaagtctttttgttgttgttactgttcttttttttgtttgtttttgtttttgtttttgttttagacagagtcttgctctgttgcccaggctggagtgcagtggcacaatctgggctcactgcaacctccacctcctaggtgagttcgagtgattctcctgcctcagcctccggagtagctggaattacaggcgcccaccaccacacccagctaatttttttgtattttcaatagagacggggtttcatcaggtgagccaggctggtctcaaactcctgacctcaggttatccacccgcctcggtctcccaaagtgctgagattacaggcatgagccaccacacccggcctctactaaaaatcttaagttttgttattgacatttcattcctaggatcttctggagtttgtccttttatatggagtgagaagaggtcaaatttcatattttgttgttatcattgttcatatggaacattttgtgagtctctgtgaggcagaagttccatacaaaaaagtgtgtttggaagtaaaaagaaaaatcagaaaccagaagattctgaaaatgaaagattatcatgataaggaatcatattagcagtccagcatattaaatggaaggaatgtctgaaagcaccaagcaaagataacaagagatggacatcaaggaaaagatatgagttccaagagttaaaccatgaaaaacaaaactgtaaatacccggatttttaggggaaaaaaatagctgcagtaaaggcagtaatgaaacaataaagaaaatttcatttgcttaaaaaaatggagtctcaacactgaaagattcagcaatgaaagtataataatgaaaaatatatataacattagtttaacagttgaactcaacatctgtttacaaatttaaatttagacagtcttgctctagaatcactgctgtgtgaatctgtatgatttgacaattacaagtttgcatgacacactagatattattactatcgggctcaatttttttttttttttttttttttttgaagatggagtctctttgttgcccaggctggagtgcagtcatgtcatcttggctctgtgcaacctccgcctcctgagttcaagcaattctgctgcctcagcctcctgagtagctgtgactacaggtgcatgccaccacacctggctactttttgtaattttaatagagacggtgtttcaccatgttggccaggctggtctcgaactcctgacctcaggtgatcctcccaccttggcttcccaaagtgctggtattacaggcatgagacactgagcccaccctgaattttttctttttagaccaaagtactatagacaaaagcacacaaaagtcacactgatctctgtattccaactcctatctttggcatttcctatgaagttacagcgagactattttactcagcaaactatgtaccatgcaccatctgtggatggcagtggggaaaaagataacacaggaactcataatttaatacagtgtcagtacagtattatgagacaagataggatagaagcgggatcctcactattgaagagtctgcaagtgctataagatcctgcatggcagagagcgttcctcacgtggttagggagagaattacagtggagcaaaagaggcaataaattacaatcagcctatgtgactcagtgtcttcaaagttaataattgctaagaatctgaaatctaaaacaaatactgattattattaaactacagtgtaacacatactttcttcttggctatcaggtctttcttctttcaatacctggaggaaaaatactcaccatttaagccacttgcggaaagcccctttttgctttctaaaatttgcttcacaaaatgtatcattttctccttcctgtattcaaagcagttttagtcctattttagcaatttcaatgtgcattattttagttgtctgtctcctttaccacactatgaactcctgaagcatgatgtcaatatatttcttgtgtctaaaaagaaaaggaactcaacaattgactgttgaaagaatgagaatgaataaattgacaaataaatgaatgaactgaatgatcagcttgagaactcaaacatacaaaccaaaacagtatgccaatgggtattcatattttaaataacttaagcctcaaaaattgcatctcttgtgtttacattgaagtcaaggtctttggtccagctatcataccacaaaatagcgtgagtgcttcgcagcatcactgttactattctttcctccagttctccaatcccatcatccaaagtagtatttctctttctttcaatatagaaatgtcactattgaaaacctatcacatgttttattctattcaaagagaaagtaagacatgagccttagcattgcctcacccatattctcatgccctgcattgttaaagaagccactcagcagagctgtgctcttttaacactagcttgaaatttcatctctcagtgttgtcacagccaaatttttacaaatttgtgaatatccagttagagttcaattgtgagatcaacctttctcagcaactagatttccagccttttcttatgaggtcaggaaattcttgagtgttttccaagatgcacatgtttccagtttcacaaatagtaccaagacctaaatgaagctcctgattcctcccaggagtctagtaaagcacaaagcaaattctatccatttatggcccttctgtgcactaaaattacagctggtcctttgcaatttttatgtagagggaatttagtctctttattatctttgtacttgaaattatgaagagtcttattcaaagcaccgtacagtttcaaccaaagaacaggtatgtgccagatttaaaaatttggacaagaaattattaagtgactaatgtctgatcatagaacattgcacaatggacccgtttattttacatatcatcacaacttggattcgcacaacttgtgttttgcttgtaacttctatttcttgacttgattgctttgaaaagtttgcattctttaactagccttaattatttgtgtgtatgtgacatcacttttctctaaatggtcaaagttactttgaattttgttaatatccacttttaaatcaatgccaattgtcaaaatattaaatatataatttatctcaccaataaggaaactgaaattacctaaccaaggtactcattttatttaccattaattccctttattcagtcagtttgtgtctgttaagcgtgttgtttgtattaagcactatggtagatgctaaaaatgaagatatatatagcactgaacctaccctcaaaatacctaagaaaaagagcaaaagaaaaatcaaggtgaatggcctattacaatacagtgttttaagagctctgacagaggtaaggcaacaactttttcagaggaagaaactcataagcaaaggactggagaaaaagtagaaaggaattattaaaacatcaacgaagttaaaagactataggttttggagtcagaaacccagacttgtaacacaaacttacttagtatgtgactatttttgacttgtcccttcaacagcctcatcaataagagcaataaagtggtcagaatgacagccccaggaatcactgtagccatttcttcttagccattgcaaccaaggactacacgtgttaccaacccacagttctagctgaagcacctagccaactaactagcaacatttagggaattaaaatgtgaataatagtgaaattcaatatatattccgtcagtctcttgtgtatgatcccaaaagaaagacacaaaattgactttatgttcttcagaatccaacacaaggagagaatcctgattggtggcataatttagagcctgttacatataaacaaatcaattgctgcgaagagtcaaatctatttcccatcctgaggaatgagtacaatttgcactcatgcttcctcatggaatgatgtggcagtcctgggtcagcttgccttcagatctattcctcatgcctcttttgctctgctcaatgcttcagggtgctgatatgaaagctacttttttccagggttccctaatagttgacttctggctgggtataggcaatgggaagtgctgattgaattattggaagggagtagccaggctatttctccttcagcctcgctgtctaatgtaaagtctctagaagctgctgtgtctccttcctgggtctggctctcactctcagtgcacaggcacagcctcctttttccagggacctctgaccctctggcttcagaaactccatcttcttatattttccctccagcctaggcgtgttaactagtctgtcactattttctcatttgcttcattgtctcatttgacttctcaatgttcccatcatccatataaccattgccctgcattaaattccctctattttggcaacttaaagatgtttctggctgggcacagtggctcacacctgtaatcccagcactttgggaggctgaggtgggtggatcacatcaggtcaggagttggagaccagcctagcgaacatggtgaaacctcacctctactaaaagcacaaaaattagctgggcatggtggcagatgcctgcaatccgagctactcgggaggctgaggcaggagaatcgcttgaacctgggaggcagaggttgcagtgagccgagattgcaccactgcactccggcctgggtgacagagcaagactccatctcaaaaaaaaaaaaaaagatgtttctgtcttcacagatgaactgatattgagggcataagtttcatcatcaattatatcatgtctataataaaaatggtaagtttgtaagttatatttcttctaacatttatcagtgtgggctgggatataatgtaaaaacacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctccaaaacatatttttccccaactatcaagttttatataagtagtaaggtagtaagggcagagagtacttgtttctgactagtacctggaagaacaattaagagcactaccatactcctcaaaattcagctgagttggagataagataggcaacggtctacctgggacataaataaacaaatgttaatatagtttaggaataaatgatatcagaggaaaataatacataacaacatggtagtgacttgagatggggttgttgtggtggtggcacaatataaacactgaataatcagggaaggttactcttaggaggtgccctggaggaaagacctaaacgatctgatggtgccgaccttaatgaaaatccagggaaaacactaccggcaaaactacagcaaatgacaaggcccaaagtagaacaaatttggcatgacttgtttctgaatcagaaacttatacttgctagtttctcaggtgtcaaaaagtacaaaaaagagaagtacccccccaaaaaaagaccaatttgaaaatgtttttaagtggcaataaattcatttcaaaacaaacaaacaaacaaaccatggactatgtagttgtgaacagtgtaaactcccagaaaacactcggtggtaaacatatgttagtctaacttgctaaattagttgagcatgtattatgttccattgaccattctgagtactttaaatgtattaattcgtttaattcttatcacattatgaagtgatatggtttggctctgtgtccccacccaaatatcatgttgaattgtaattcccaatgttggaggtagagtctcgtgggaagtgattgaatcatgggggtgaaattcccccttgctgttctcatgatggagttctcatgagatctagttttttgaaagtttgtaggacttccataacttgaggtcttagatttaagtatttaatccattttgatttgatttttgtatatggtgaaagataggggactagtttgattcttctgcttacggatatctggttttcccagcaccatttattgaggagactttcttttccccagggtatgttcttggcacctttgtcaaaatcgacttcactataggtgtgtagatttgtttctaggttttctattttgttctatgggcctatgtgtgtggttttatgccagtatcatgctgtttggttacagtagctctgtagtatcatttgatgacaggtaatgtgattcctccagttttgttctttttgtttggaatagctttggctattctgagtcttttatggtgccatataaatattaggattttttttctatttctgtgaagaatgtaattggtattttcgtagggattgcattgaatctgtagattgttttactagaattgacattttaaaaatactgattcttctaatctatcaacatggaatatttttctattttttgttgtccttttcaatttgtttcatcagttttttacagttttcattatagggatcttttacttctttggttatcctaggtatttaattttatgtgtggctacagtgaatgggattcctttttaaattttttttcacattcttcactgttggcatataaaaatgctattgatatttgtctgttgattttgtatcctgtaactttactgaatttatcagttctaatagttttcttgtggaatctttaggtttttccaaacatcagatcatatcatctgaaaacaaggataatttgacttcttcctttccaacttggatgacctttatatctttcttttgtctgattgctctagctaggacttccactatcatgttgaataacaaggatgacagtgggcatacttgttgtgctctagatcttagaggaaaagctttcagttttctcctattcagtatgatactggctgtaagactgtcatatatggcttttattatgttgaggtatattccttctatctccagtttttttagtgtttttattatgaaggaatgttgaattttatcaaatacttttacagcatcaattgaaatgatcatatggtttttatccttcattcttttgatatgatgtattacattgattgattggcgtaagttaaaccatccttgcattctagggataaatcccacttggtcatgatgaataatcttcttaatgtattgttgaattcagtttgctattactttgttcaggctgtttgcatcaatattcatcagagatattcacctgtagttttcttctatttgttgtatctttgtctggttttggcatcaggctaatactggccttgtagaaggagtttggaagtactcccacctttgttttttagaatattttgagtaggattggtattagttcttctttgaatgtttggtagaattcagcagtgaagccatcaggtcctggacttttcttcactgagagactttttattatggcttcaatcttgttacttgttattggtcagttcaggttttggatttcttcctggttcattcctggtaggttgtacgtatttaggaatttgaccatttcttccagattttccaatatgttggcatatagttgctcacacgagccactaatgatcttttgaatttctgcagtatcagttgtaatgtttcctttttcatttctctttcaaaaatttctctttttaatttctagtttcataccattgtggtcagagaagatgcttgatattatttcaattttttgaacgttttaagacttgttttatgctctaatatatagtctatcattgagaatgatccatttgctgagtaaaataatatgtattctgtagctcttagatgaaatgttttgtaaatatctatgagatccatttggtctatagtgctgattaagtctgatgtttctttattgatatagtgccagtaagatctgtccaatgctgaaagtggggtgttgatatctccagctattattgtattgggactatctctctctttagctctaataatagttcctttatatatttgggtgctccactgttgggtgcatatatatttaacattgttatattatcttgctgaattaacccctttataattatatgatgactttatttgtctcttcttatagtttttgtcttgaaatctattttgtctgatagaagtatcacagctgctgctcttttttggcttccatcagcatggaatatctttttttatccctttattttcagtttatgtgtgtctttgtaggttaagtgtgtttcttaggaatagatccattaagattttgttttgtcatccattcagccagtctatgtcttttcattggtgagtttagtgcatttacattcaatgttattattgataagtaaggaattacttctgccattttgttatttgtttttgggttgttttgtggtcttctcttctttctttctttcctgtcttcttatagtgaaggtgattttccctggagatatgattattttcttgctttatattttttgtgtgtccattgtatattttttggttaccctgaggcttgcaaatactatcttataacccattattttaacctgataaaatcactgtttgcataaacaaacaaacaaaatgaacactaataaaaactatatgcattaactttgtctccctcactttttaactttttattgtttctatttatatcttattgtactgattatgtcttgacaagttgtggtagttactattttttattggttcattgtttaatctttctacttaggattaaagaagttcacatgccacagttacagtgttataatactgtgtgttttcctgtgtacttactattaccagtgagtttcatacattcatgtgattatttattgcttgttggtgtccctttcttactgcttgaagcactccctttagcattactttttatttatttgtttattatttcgatagttttaggggaacaggtattatttggttacatggataagttctttagtggtgatttttgaaattttggtgcacctataacccgagcagtgtacactgtacccaagatgtagacttttatctgtcatccctctcccaaccttcctcccgaaccctcaaagtccactatatcattcttatgcctttacatcttcataccttacctcccacttataagtgagaatgtaagaggcttggttttccgctcctgagtaacttcacttggaataatggtctccaactccatccaaattgctgtgaatgccattatttcactcatatatatatatattccatggtacatatatatatactccacattttctttatcctcttgttgatttatgtgcattgggctggtttcatatttctttttctttctttttttttttttgagacagagtctcgctttgttgcccaggctggggtgcagtgatgggatctcgactcactgcaagctccacctcccagttcatgccattctcctgcctcagcctcctgagtagctgggaatacaggtgcccgccaccatgcctggctaatttttttgtatttgtaatagagatggggtttcaccatgctagccaggatggtctcgatctcctgaccttgtgatctgcctgccttaggctcccaaagtgctcggattacaggcgtgagccaccatgcccagccctggtttcatatttttgcaatcgtgaattgtgctgctgtaagcatgtgcaagtgtctttttcatttaatgacttcttttcctctaggtagatactcagtagtgggattgctggatcaaattatagatttacttttagttttttcaggaatctccatactgttttccatactggttgtactggttcacattcccaccagcagtgtaaaagtgttcacttttcacaacacccatgccaacatctattatattttgttttttaataatggccattctttcagcagtagggtggtattgcattgcggttttgatttgcattttcctgatgattagtgatgttaagaatttttttataattgtgattatgaaaaaaattagtgactgaagcactcccttgtttcttgaccatttgtatatcttcttttgagaattttatattcatgtcctttccctactttttgatgggattagtttttcatgctgatttgtttgagttccttgtagattctgaatattattcctttgtcagatgtatagtttgcaaaaattttcttccactctgtgggttgtctgctggctctgctgattatttcttgctgtgcagaagcattttagtttaattaagtaccgtctatttgtctttccttttgttgcatttgcttttgggtacttggtcatgaactcttagcctaagccaatgtctaaaagagtttttccaatgttgtcttctgaaatttttatggtttctggtcttatatttaagtctttgattcatcttgagttgattttttgtataaggtgagagatgaggatctagttttattcttctacatgtggcttgccaattttcccagtaccatttgttgaatagggtgtattttccccgctttatatttttgtttgctttgtcaaagatcagttggctgtaagtatttgggtttatttgggggttctttattctgttccattggtctgtgtgcctatttttatgccagtaccttgctgttttcatgactatagccttgtagtatagtttgaagttgggtaatattatgcccccagatttgtgctttttgattagtcttgttttgatcatgtgtgtgcactcatttttggttccatgtgaattttaggattattttttctagttctgtaaagaatgatgttggtattttgatgggaattgcattgaatttgtagattgcttttggcagtatggtcatatttacaatattgattctacctgtccatgagcatgggatgtgtatccatttgtttgtttcatctatgatttctttcagcagtgttttgtagttctccttgtacagatctttcacctccttggttaggtggattcctaagctttttgtttgttttgcagctattgtaaaaggggttcagttcttgatttgattctcagcttggtcactgttcgtgtataacaatgctactgatttgtgtacattgattttatatcttaaaactttacagaattcatttatcatatcttggagctttttggatgagtgtttaggggtttctaggtgtatgaacctaaattggcaaaaagtgacaatttgacttcctttttatcaatttggttgccctttatttctttcttctgtctcattgctctagccaggacttccagtactatgttgaatagagatggtgaaagtgggcatccttgtcatgttccagttctcagggggaatgctttcaacatttccttgttcaatataatgttggctgtgggtttgtcatagatgacttttattaccttaagttatgtcccttctatgctgattttgctgagggtttaaatcataaaggcatgctggattttgtcgaatgctttttctgtatctattgagataatcatgtgatttttgttttaaattctgtttatatgacatgtcacatttattgacttgcatattttgaaccattcctgcatccctgtaagaaacccacttgatctttttgatatgctgttagattcagctagttagtattttgtcgaggatttttgcatctatgtttatcaggcatattggtctgtagttttctttctttgttatgtccttttcttgttttggtgttagggtgatactggcttcatagaatgatttagggaggattttctctttctgtatcttttggagtagcttcagtaggattggtaccaattcttctttgaatgtcggatagaattcagttgtgcattcatctggtcctggacttttgttgttgttggcaattttttaattatcatttcaatctgctgcttgttattggtctgttgagagtttccttttttttcctagtttaatctaggagggttgtatttttccaggaattatccatcttctctgggttttctagtttgtgcatttaaatgtattcatagtagccttgaatgaccttttgtatttctgtttttgagatgaagtctcactctgttgcccaggctggagtgtagtggctaatctcggctcacggcaagctctgactcccgggttcatgccattctcctggctcagcctcctgagtagctgggactacaggcacctgccaccacgcccagctaattttttgtattttttagtagagacggggtttcactgtgttagccaggatggtctcgatttcctgacctcgtgatccgcccgtcttggcctcccagagtgctgggattacaggcgtgagccatcgtgcccggctgatcttttgtatttctattgtattggttatagtatctcccatttcatttctgattgagcttctttggatcgtctatcttcctttctttattaatctcactaatagtctatcaattgtgtttatcttttcaataaactagctttttgtttcatttatcttttgcattttgtttgtttcaatttcttttagttctgctctgatctcgcttatgtcttttcttctgctgggtttgggtttggtttgttcttgtttctctaattctttgaggtgtaaccttagattatctattcatgctctttcaaactttttgatgtaggcatttaatgctactaactattttcttagcagggattttgctgtttcccagaggttgtgtcatgtttgataggttgtatcattcagttcaaatcaatttttaatttccatcttgatttcattgttgacccaaagaccattcaggagcagattatttaatttttatgtattttcatgattttgagggttccttttggagttgatttccaattttgtcccattgtggtctgagagagtacttgatataattttattttcttaaatttattgagacttgttttgtggcctatgatatgtcctatcttggagaatgttccttgtgcttatgaatagaatgtatattctacagttgctaggtagaatgttctgtaggtatttgttaagcccatttgttctagggtatagtttaagtctgttgtttatttgttaactttctgtcttgatgacctgtctagcgctgtctgtggaatattgaagttcctcaatattattgtgttatctatctcatttcttaggtctagtagtaactattttataaatttgggagctccaatgttaggtgcatatatatttaggattgtgatattttcctgttgcatttatctctttatcatttttatataatgttcctctttgtcttttttaactgctgtcactttaaagtctgttttgtctaagaatagttgactccttcttgcttttggtgtccattgcatacaatatctttcttccatcttttcaccttaagtttatatgagtccttatgtgttagatgagtcttttgaagacagaggatacttgattggtgaattctgtccattctgccattctgtagcttttaagtggagcatttagaccatttacattcaaagttagtattgagatatgaggtactattctattcaccatgccatttgttgcctgaataccttgggatttttgtattgtgttgttgttttataggtcctatgagatttatgctttaaagagattctattttggtatattttgaggatttgtttcaagatttagagctccttttagcagttcttgtagtgctggcttcgtagtgctgaattctctcagcatttgtttgtgtgaaaaagactttatctccccttcgtttatgaaacttagttttgctggcaaaaaaatcttagctgataattgtttttttaaggaggctaaagataggatcccatccctgctagcttacagggtttctgctgagaaatctgctgtaaatctgatacattttcctttgtagattatttgatgattttacctcatagctctttagattctttcctttgtcttgactttaagtaacctgataagtatgtgcctaagctataatctttttgcaatgaatttcctgggtgttctttgagcttcttgtacttggatgtctatatttctagctaggccagggatgttttccttgattattccctcaaataagttttccaaacttttagatttctcttcttcctcaggaacatcaattattcttaagtttgttcaataatcccaaacttcttggagaatttgttcattttcttaaattctttttttctttatctgtgttggattgggttaatttgaaagccttgtctttgagctctgaaggtcttccttttactttttctagtttattgttgaaattttccagggtattttgtatttatctaagtgtgtctttcatttccagaagttgtgattcttttttatttatgatgtctattctctggagatttttttcatccatattctgtttttaagttttggttgttttaatttaagtttgttttctcctttctttggtgcctccttgagtagcttaataattgaccttctgaattctttttctgacaattcagatatttcttcttggtttggatccattgctagtgaactagtgtgatcttctggaggtgttatagaaccttgttttttaatattaccagaattgtttttctggttccttctcatttgggtagactatgtcagtggaaagatctggagcacaggagctgctgttcagattatttttttctcattgggtgctcccttgatgtggtgttctcccccttttcctagggatgcagcttcctgagagctggactgccgtgattgttatttgtcttctgggtctagccacccagtggggctacagggctctggtctgatactggggagtgtctgctaagagttctgtgatgtgatctgtcttcagatctcccagctgtaagtaccagaacctgctctcatggaggtagcaggagagcgaatttgaggctgtgagagtccttggttgtagttgtttagtccactgtcttttttgaatgctgggtatgctagcagtaaagttgtcatatggacagactcaggacttctggttagcaagggtgttaaagttagtagaattagctgttattttctccttccttggagcagggttgttctgttatgacttgctgtaatggcttgagttggttggccttcatccatgaggtaatgctttcaagagatcaccagctgcagtagtatagaggggatacaccttgccctgaggccaccaggataagtatttgggtttctctggtaatggatagggctatagagcttccaagagtttgtgtcttttgtgttcagctaccagggtttgtagagacaaaccatcaggtcggggcagggttaagtgggtctgacctcagactctccttgggtggggcttgctgcaaccactgtggggaatgtgggggttgttctcaagccaatggagttacgttctgaagggaattaaggctgcctctgatgtgtcatacaggttgtcagggaagtggaggaaagctggcagtgacaggcctcacccagctcccaggaagccagcaaggccagtctcacttctgctgtgctctgtcaacaacaaacagtgccaagtttatatccaggcctccggcacacagggctacaagactccctgctgagaaagaaagcagggcttttaggctttgcccttccctgtctgccacagcttctgtgcttatgtctgcactttgcatttgctccccagactctgcccaggaaaattcactctctcttgaatttactacaaagtttagtggaagccttcttctccctgtggcccttccctgattccactggctgcgttccccaaaggcccctgtgaaattaaagtcagaaatggcttccttggggttccctgaagattgggcatgcctacaaggctcttcccattgctcattctacttttgtattttacttggctctctaattttgtttcagctcttggtaagggtaaattattctcttgtgatccttattttcattttcctgagtgtattagtccattgtcacactgctataaagatactacctgagactgggtaatttataaacaaagaaggtttaattgcctcacagttccacatggctggggaggcctcaggaaatttacaatcatggtggaaagggaagcaagaactttcctcacaaggcagcaggagatagtgtgaacatgtgaaggaggaattgtcacatacttgcaaaaccatcagatgtcatgataagtcactcactatcatgagaacagcatggggaaaccatccacttgatccaatcacctccttcttttgacacatggggattacaggtccctccttgaggattacaattcaagatgagatttgggtggggacacagagccaaaccatattactcagtgaggatgtgtgtttgggggcagactttccacctctcgcactttgggaacgcacaatgtttcagctgtttcatggaggttgcagcagcaagccacttcttccaaagggtttgtgaattattttggttttcctgttgtgttccctgcagtggttcttggagcaaaagttcacaatgtgaatctccacatgctagttctgtccatctgagtgggagctacaagttagtcttgtctcctatcggcaagttttttcatcaccaacttcctttagtatttcttataggacaggtgtgatggttaatactgagtgtcagcttgattgcattgaaggatacaaaatattgatcctgggtgtgtctgtgagggtgttaccaaaggagataaacatttgagtcagtgggttgggaaaggcagacccactcttaatctgagtgggcaccatctaatcagctgccagcatggctagaatataagcaggcagaaaaatgtgaaaagagagactggtctaccccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagactggtctaacctcccagcctacatctcttttccatgctggatgctttctgccctcaaacatcgaactccacgttcttcagttttggaactcagactggctttccttgctcctcagcctgcagatggcttattgtgggaccttgtgatcatgtgagttaatacttaataaactcccctttatatgtatgtgtgtgtgtatgtgtgtgtgtgtatatatatatatatatccattagttttgtcccgctagagaactctggctaatacaacaggtctgatattgatgaaatgcctcagctttttgtctggggaagtctttatttctctatgtttaaagagtattttcactggatatgctattctagggtaaaacttgtttttgtttgtttgtttgtttgtttttattcagcactctaaatatgtcatggcactccctcctggcctataaaggtttccactgaaaagtttgctgccagatgtattggatcttaattttatatatatatatatatatatatatatatatatatatatatatatatatatatatatatatattttatctcttgctgctgttatgatcctttctttatctttcatctttgggagtttgattattaaatgacttgaggtattctttgtattaaatctgcttggtgttctacaaccttcttgtacttggatatcggtatttttctctatgtatagaaagttctccgttattatcccattgaataaactttctacccctatctctttttctacttcctctttatggccaataactcttagatttgccctttggaggctattttctagatcctgtaggcgcccttcattattttttattcttttatcttttgtgtcttacgattgtgtgttttcaaatagcctgtcttcaagctcactacttctttttttttttttttttttttttttttttgagacgcagtttcagtctttgttgtcaaggctggagtgcagtggtgcaatcttggctcactgcaacctccacctccccagttcaagcaattctccagtctcagcctcctgagaagctgggattacaggcgcacaccaccatgcctggctaatttttgtatttttagtagagatggagtttcaccatgttggccaggctggtcttgaactcctaacctcaggtgatccaccctcctcagcctcccaaaatgctgggattacaggcatgagacaccacgcccggcccaagctcacgaattctttcttctgcttgataaattctgttatgaaagggctctgatgcacccttcagtatgctaattgcatttttcagctatagaatttgtgctcaattctttttaattatttcaatctctttgttaaatttatctgacagaattctgaattccttctctgtgttgtcttgaatttctttgtgtttcttcagcacagctattttgaattctctgtctgaaatgtcacatttctctgtttttccaggattggttcctggtgacttatttagtttatttggtgaggtcatgttttcctggatagtgttgatgctagtagacattcttcagtgtctgggcattaaagatttaggtatttattttagtcctcactgtctgggcttagttgtagacatccttcttgggaaagctttccagatacttggaaggattgggtattgtgatctaagctgtatctactttagggggctccccaaacccagtaatgctgtgtttcttacagacttgcagaggcacctccttcacagtcttggacaaggtccaggagaatcctctggattcccagggagacactcttgttctcttcccttcctttctctcagtcagtctctttctctctttctctctctctctgttctgaaccacctaaatctgtagttggagtaacataagcaccactgtggctgccaccactatgatggtactgggtcagacctaaagacagcacagtgctgcatctcacccaaggcctgctgtaactacttcctggccactgcttatgttcactcaaggccttgtggctctacactcagcagggggcaaaaccagccaggcctgtgtccttttcttcagggtggcgatgtccctcaggccctgggtggttccaaaggcactgtccaggagtctgggactagagtcaaaaaccttagacgtctgcctggtattgtattcggctgagctagctctcaaatcacttgatgcagttcttcccacttttctcttccctttccaaaggcagaggagcctcactcctgcagccacaaccaccgcaggccatgaggagtactgccagactacaagccaatgtttccttaaggcccaagggctcttaaggcagctgtggtgaatgaggaactggactggaactcagcttttagggcagtgggctcccttctggcccagggcaggtccagaaacatcatccaagagtcaggtcctggaattagggaccccaagagtctgcttggtgctctgccttcctgtggctgtgctggtacctgaggccagcaagtctcagtgtctcacccaaagcccttgatgcagtacctgggtatcgctgctggttattcagggactaaggaatcttagttagcaggtgatgaatgctgtcaggactgagtcccttccttcaaggcagtgggttcttttctggcccagggtgtttgtctaaaaatgtcatttgatagctagggcctgtaacagggacctcaggactctgttgccctatcctattgtgtctgacctggtatccaagaggcaaggcaaagtcctctcccttcttctctctcctcttctcaagcaaaatggaggggtctcttggagctggaagctctgcaacttggggattaggggaggggtgatgccagctctcccttggctgtcccagctggtgtctcagtagtcacgtggcccccccagtcaactgtctgtgagcctagttcagcattaagtgtcacctaagatttgtagtccttatgacccagactgcctttcaaatttacctggagacaagagcgctgtagccatctgtgctgaggtttgaaggcactcaagttctgatggctgtgatccaggattctcctcaggctggggctggtttaaaggttccctcagtgggccagtgtcagttgagtttggttcagttttcttttctgttctaacaggacaccactgagtttagtgcctcacaattgctgtgctctccccactactctgcctagagatgctctgggcacccctccaaacctgccccaggtcagggaggggtggcatcatgattcaaaactgtttttcctatcccttcagtgcctctttcgacgatacaaagttacaaccaggtactatgagtgctcacctgatttctggttcttgtgaaggtgtttcttcagtgtagatagctgttaacttggtgtccttatgggggcggggttgggggatgatggagtcttctattccaccattttgctctgcctcttctctagaaggcatttttattatatacaatgaagaaagtattatcaacaatatataaataaatgctaagtcaattaaaaagcaccagcaatttcatagataaatggccacaaatcatgattagcactttacagaacaggaattatatattgctagtaaacatatatgaagacatattttggacttaatagtgattagagaattacatatcataccatggtgagttctcttttaaattcatttgattggaaaaataaaataaaaaggtcattatatcaagtgattaaaaagacgtgagtcctctgagtcttttatatatcatttctttaaacataagttgataccaatgctttggaaagcagttagatattattgtgtataattttgtatactgtgtgatgaagtaattttggctgtagatccaggggataatctctcctgtgtactctggaaacagcaggttcacagcagctctcttcacaatagcacatctgtagaatcaaatcaaatgcttccacattagtcaagtggctgaatatcatgtaatatgctgttataaatccacaaaatgaatataccacaatgacacacaacagcatgcatgaatcttagcaatataaacataaatacttagcaatttaaacataaaacaattaaaatgaaattaaaaattttggaaagaaacatagatgagtaaaaagaatatgaaaagaaaagaaatggaatagcaaacaggcttcagaagggttgttctcttgggagagggaacagaggaaatgaggtgaaggaagagaaaataaatacatattaatgattggtgagattctactctttgtattgtgtggtgggccctcagttgcttattacactactcaagagggatgactgcataaataaaaacagacagccatgcatgaatcagttatgacagtatcatgcatatacgtacagttgagcaattctatacaccagggttggaaccaaaaattgccatctacctacttcacaacagtaatctactgccattattccagagccagttctgagtcttctgcttctttcacctttcttttgagcttcattaggagcatgctattattttattttgctcattctttaagactcaggtcccgctgctggcatacagtgattcacagagtaggggatggtgtgtttcctctgctccattcggtctttgttttcacaacaggcagattagaagtttcttattgaagccccagaaggaaaccatctctgctcgcccatctttttgtagtctcccagcctcagtcatgcagagaaacttgaagcttctcttcaagctctgaaggtcagccagaccagaaactaatgtgacatagagtctcttttccaatctctgtaggtcaggctcttgccaggatctgtctcagcctaatctaaaccatggaccctatatcaccaggccccaggcactgtcttctctgaagggtgcaagacatacctcaaatattttttattcttcaggactaaacgagacttgaaggctcagttgcctccttcaattcattggctcccttacgtccacagcagcttcttggctcataggaggtagatgtgttaggtttgatagcaaagtgtagccaggatgtttaaaatttgctattttcccagaaatgtctactctcttaaatattcttttaattttaataaagttttcatttttataggattatccgctcaaaattataagaactttgtatttatctattcattaaccccctttataatcatttcttttccttcatttgcaagacgtaaccattttttatattttactttgcaaagtaaaggaaagatgaaactctaggaatagcaagcaaagttttaacatttacagatggcagagcaggtttgagaataatctaactttgggaatgactacaaagggtgttaattaagtagcaggtgttttatcacctatgtctattcaaaaaaaaatgtagcacagatgtagaaagcttaagtacatctatagtttgtataacaaaactctatattcattgggttccatctgccacactaacctcaaaccacacttagtgccaaccaattaacaccttgattaagctatagaccacctgcagcttcagcaatgtaatgaattcactgacttttatacaaattcattgtaaaacctagactgaaactgcatagcaaaaagagaaaaaatgataaatgattcatgcatcagccttggtgtaggcacacacagacacacacacacacacacacacacatttactaaggcatgcacatcaattgtctcatctctgctgctctcttcattttttaaattttctttaacaaaggagacttggctaaaggcatttcaggcttataaacccacaaactataagcagaaaagaatatcatatcctcctccatcaactcaaattttaaaaattccaggaaagtactccaatttgcttaactcaggtcacatgctagttctgaataggattgggcattctggttgacacagtttaaattggttgcctaatcctgtggccacaatgaaaggatatggctgacagaccctaccataaccatgcggcaaaagcaggtgaccaaaatatatttagtctgaaaaaaaataatctaaatgaataatgtaagataattgatacatgtatgtgttgttagaagtatattaaattctctgtcttcactttttttggtgaaatcttcattgctcacttatgaattatggaacagcttttctttccatactgagaaaaaaatagttacttcctatcagagaaaactaagagataagttaaaataatttaaagaagaaaagagacattttgaataatgaattttgtgacacctgacctactaacagttggcaggattgattagagaggagagagctggaaaaaatagtagacttttatgatcatctttatgtaatgttgtaaatggaggaaagttaaactggaaagataggtctgtgtttctggagaaaggttatacaatgaggaggtagctgggtgatgactgttctactcacgctgtcgcaatgtttgcagtagttatgaattatttttttctcaacttatcatggcagaatgccacttataatttaaaaaaataacccagaatccaggaaagatgaaaaacagcaacaacagtataaactagggtaaaaatatattttatttagcacagctcattttgttttactttattttgtttatttatttattttgagacaggatctcactgtcatccaggcggtagtgcagtggcctgatcactgctcactgcagcctcaaccttctgagctcaattgatactcctacctcagcctcctgagtagctgggaccacaggtacacaccaccatggtgggctaatttaaaataaaatattttttgtaaagaaaggttcttgtttggttgcccaggctggtcacgaactcctgcctcagcctctgaaacatgagccactgtgtccggagcacagctcattttattaagaagctcattgcagagctagttatccaaaactatgagaagagattcatccagttattcaggatttagcatcagggtgtattctaaataaaggggctcagaggctgtcatgactttaagtgtcatcattccataccaatcctttttatgaaaaggaagaaaaagaagttctcgaattttatttgttctcaaggagaactctcaaggagaagaatggcagtttttagtttacattattatattcatatggctgatgttttacttctgccctcaaaatcctctctgaaaaaatatcttttgtagcctaccctaattggaaatatacagagaaggaaattctgggaatcacagttcaatctgatccagtggacacattatagtcactacagttcatgcattttgaacctgaaagctccacacttctttttaagccatatgtaatctacaagtaaacaaagccatactcctgcctcatatgaaaatatgacatatctctcctgccttataactgaacatagacttagtcttcattctaacggttacaaagtcccatttcaaaaagcagttttcttctttcatctgattcacactccttctttaatatcctataacttacttagtgagatatgcactgatagctactattaatgcattgtgtgtttggcgataggggaataggaaggggaaaaacaatacttgttatatgtgtgtgcatgtatttgtgtgtgtgttcatataactaaggaagaaaaaactattgtagtcttaatttctgcaatcagtcatgtggttgcagcagatacttctatctgcccttttccactgcccattccattttctcagcagtggtcaactacctcaagtgagactattacaggttctacagacaagggaaagctagctttctcaggcaggaatggaaagaaaagtaggcttagtggaattcagggattcaatcttgtcatttcatctaaatttgcctatatgtccccatcctaattttcagggttccatttatttccaattaatgccccaaatttgagaaaaatgattctgtgagttaggaaattcaatttgtattgtaattcagccattatgattagattttgggtttggtttcagatctttcagacctgaggttataggagataaggatttattttagggaaggcttagaacttacccaggttcttactgagattcaatctgagaatttaaagccatgagattattttcctttgataactactaaatactgtatcaataagaagcagaatcactatgaacattatacacacacaaacacacacaacttgttacaaggatttgagtatatacaattatgtgagctggttgcaacagtctctgtaaatttgctgattttggatttgatactggtgcttgaagactctagggcaggatcagtcaggaaggaaaaagaaggatgtaaagtgggagagaggaaagccaagtttaaacccacaaatatgagctgaagcccctgaggacaaactggagcacatgttcattctacaacattggtgataggggttccctacaggagaaaccggtacttcctttttggcagtaagcagaaacctctcccaagagtttgggaagctgcaggaaggtccatgggtagcctagccactgcaccatggtaatcagttgagcaagcagatgagtgacatgtattaacaacaaaagctctcttgactgtctcaatctctttccaaacataagaaaccatatgactactgcttggcttcttccctctaaattgcacacgaaaatgtctctgtggttcactctaatctgaaatatcaagggaaggaatttctggaaatgtaatttagtctaggcaagtctacacattactaagccaccacatggtatctttaggttgtttcgatattgtttgggtattgtgtgtatacaattgattaatatttctaagttttgttttataaattgactttcattgagatctatttcttgtaaattcaatcatgtggaaaatacaaatagtaaatcaaatataattttatataggtttgagaaatttctgcatttctattggcagtaataccccagactactctctgattagtcttacgtgcatgtaatgtactttttggtctttgacattccaaggcagctcagtttaatgattttgtcccccttatttcattagtactcatattttatagtaattaaaagcacaggctctggatatagcctaaaatcaaatgtcagcatcaccacttattagctgtgaccccaggtatactacttaactgctctttgcctagttttttcttgtgtaaaatagtctaggattaaattagctgatatttataaagtgttcagaatagtgcttgtctcattatgttctgtattttccccatatggtatatactaggggagggattaggctttttgttgaattttttcttgtttttttaatgaatattcaccaataatcattcacccaaaattgtcacaaacactcatgttggccatatggatcaagctctcctaaaatgtggtaatcatgtataattttttgaacatgctttaatacacacacatacacatacatgcacaactatttccagaattattgtgtctttttttatatttccagcagcaaggtataagaaatccagtttctctgcatcccttgcgagcatttcatattgtctatattgtattattttatctgttctaacaggtagtgatatattgtcatggttataatttgcattttcgtaaagctaattatatcagacatttttttcatgtgtttatttgtctgttaatgtcttttgtattattatgaattggctttctttaccattgaatttttcaggattctttaaatattctagatacaagttctttgtgagatatatggtttacaaatacacactctcaatctataggttgcctttttatcctctgaatatggtctttttaatcttgattaagtacagtttatctgtgttttacttttaccgatcatgattctgtgtcatgtctaaaaattctttgcctagctcttggtcccaaagattatctcccgtgtttcttctaaaagttttattgtgttgcattttacatttcaatctgttatacctgggccatcttttgacaacttctatggttcactgcccggcatcttctatctagttgttcatagtctcctatccttttataaagaaatgttagtggcatcactgggtcaaagaagtctttttttacagctccgggatatggataggtgtttcaaacaccattctaaatttctgattagcttcatgtgcaaacgactattctaagcaaatcttggataacctctacctttggttaacgatattttgaaatactgatgtaattattcttccttatcctaatagtaaaaaggatgaatgaacttttttcttcagtagtctcaatataagctgtgggactaatacttgtcataggccctttgaaatagcaaacacagtgactttcatactatttccacatccccctaagctcttgagctcacatttgcatttctcttcccacttttcccttctatatacagatagtaaatacctttgaagatatcattcaagtgagataatttgttgcaatttttcaatgtttcattctagtttatacaggtcaatgcctttgctatgattttaaggcttaagcaaaaccttggtgttttatgaatttctacttattgagcaaaacctatatttgagaaaacaatgtgtatagtggcaaattgtaagaaaatatatccatctctcaaaattgtataaaagtatagtagctttgaattctaaaatagatccaattcctcaaattgactatcattatttttttcctttggaactataaacaatcaccatttctgattaatttctgtcatataaatcacaatccttgctttgtattattttacttgatatattctatatataaaacatacagttcacatatagttaccatttcttttccatacaacagctaaagatgtatttgactattgaaatgcttaagccttacttaaaaaattttacatttttataatactaatttttaatagcacttttgaagataatttgaaacaaaatttgagaataataaaatttgtcattttataaatatagaaattgatagactacagagttgatgattgcaggtttgtagtttaaattggaaagattttgtacaaatctctctgatagtcaatactaaatcagtaatggagtaataaaaacctcttaaattgctttaattcatatattcacttatctaaataccactggcctgtatcttaaattattgagaacacaactgaaactcagtatgtcaatacaaagggttctgaacatctaaataacaaatttcaaaacccatcaaataataattctcaagaaaatctttcaggtaactttcaattctaatggacgcttgaacatctattgtttttgtttgtttgtttgtttgtttgtttgttttaatgttagcatattagaagttgcaatgtggctgggtgcaagtggctcatgcctgcaatcccagcactttgggaggccagggcgggtggatcacaaggtcagaagatcgagaccaacctggctaacacggtgaaaccccgtctctactaaaaatacaaaaaaaaaaaaaaaaaaaaaaaaaaattagccgggtgtggtggtgggcgcctgtagtcccagctactcgggaggctgaggcaggagaatggcatgaacccaggaggcggagcttgaattgagccgagattgcgccactgcactccaccctgggtaacagagtgagactccatctcaaaaaaaaaaataaagaagaagtttcaatgtaaaggaaaaagaggctttaaaaacagcagttctcctacaactagaaatggcaccactatcaatattatattaaatgtcaatggagaaaaaaggaataatgccaatactatcaaaaataatttaaaaattttagcagttaagggatgtttaaacggtgaatgatactttgaaaggaccactgtagagtaaaatatttgatgttcatagtgattactctgagttattagaaaatatacatcgagcattacattctgattttaaaagggtagtgaaactactccatatgatactacaatggtgggtacatgtcatcataaatttgtccaaacccatagaatgcataacaccaagggtgaactctaatgtgaaagtgtgaactttgatgataatgatgtgttcatgtaggttcatcaattgtaacaaatgtaccattctggtgaccaatattgatgacgagggaggctgtgcgtatataggatcacgaggcatataggaagtctctgtaccttctgttccgtttttctgtgaacccagagctaatctgaaaattaatgtctatttttaaaaaactctttgagctggatattggagggaagaagaaaaataaaacgatttgtatggaaaccctgggctctggaccctagattatacatatctgaaaacaaaagagaactttagcttgttaggctgaaatatctgcattcaaaatactccactgttttacctagtgacaatggatgaaaaaaattgatttacatatgtataactaaaacacatgttggggtggtatggtatgctatgctgttggaagttaggataacggtaatccttgcaggggtagtaactgaataaggggcttctgggatgaagataatattgtttctttgatcctggggctggtcacataggtgtattcagttttgagatgagccttacctccaaatctgtccttgaataaatttcttgttggttccccttggttgatcaaatcctatcatctgctttataataatacaacttaatgattaaaattttaaatgtacctaatccctaatcaaatataagaaaaatgaatagaacttaattgcattgcagctaagttccaatttcataagtgaaaaggaaattgttttcgtttattttagctttatattaaaaaatacacgaacaattgtttggagactgttatggaatttcctagtcatttccatgaactatttctggtgggttttgaaactaaatgtagttacagggcaattgtttttgctgtgtaattctttatgtctaataattggtagtcttcattcaagataaaatgtcttagatattataaattttcttctctgcccgaatatgctgctatagactaaagtgagtatctttaggaaaatacatttgtttcaaaagtacatcctgctattatgcacaagtattaattgttttgatgtgtgcctttttttgtttttgggacggagtctcgctctgtcgcccaggcgacctcggctcactgcaagctctgtctcccaggttctcctgcctcagcctccggagtagctgggactgcaggcgcctgccaccacgcccagctaattttttgtatttttagtggagacggggtttcaccgtgttagccatgatggtctcgatctcctccgcccgcctcggcctcccaaagtgctgggattacaggcgtgagccaccgcacccggccgatgtgtgccatttttatcatgactagaatcactcatgggatagatttgcacatttttacctcaggggttgttgaagaagtcaggccatgtagtactcatgaggccttgtagtactcatgttaatttatgtcatgttcattttgtttcactggtaggcaaggaagaaacctaggccttcagatttttggttttgctcaactatcagaaaagcctacatgaattatgtagacactgatttggttgcagttcatttataacttatgagcaaattatatttctagtaagaaaagtattctataatttgaagaatctcaatattttatatgcttcaaaattgacagtttaatttcagggatttgtactttaaatatgtatattagaaagaactttgaatagttcatggagaatctctgaagtctcagaaagaatctgttccatatcaaagaaataagtggcagctacagtttaaaattaaacttaaataagaccttttctatgcctgtctgaacgtttcatttctttagatcttgatgttaatagaatgtaaatattctccaacttcattatttcactgaaatttccaagtattcaacatgataaaattctttctttttaagtctttaaaatattttggtgacctttgctggtcttttcatttttaccaaggcagagtttattaggtttatgttttctatttccatatcaagttttattcatgttaaaaacttaaaattaatggattatgtaaagtgataagtgcatcaatgaatatataactggctggattttaaacatacataaataagtatgttttaagtccttcaatgaaggcacttaatctatttctccctcatttcccttctgtaaaatggggatataataatatacttaaaaccttagcagagtgcttgacacataagaagcgctccttgagcattaactatattattattttacagtgatattgaatatttgatgctgtatatggtacttttaaaaaattgattgtctaataagcagaaaataaggctgtggtaaatcaaataaaggataaatgatttagaggctaatttgaagtaaagtataaagtatgctcttttaaatttttatgtttttatgaaagttttgggtgcttatagcaacttttgaattcctttcagcagtgtgttctttcttacacaatttcagagttttgaatctcttccttgggaaactttttacagaaaggaagataatcatcaaaaatttgtgattttaaatatcctcttaaaaccaaagttcccctttttaatggtttactgttacaacctattctctataaagagagaaaagatatagtccacatttatactagcttcttttaaaatattttagaagaaacagaagaatgattagtagaggttttcattttccattgataaaaaatcgagaatgagtctttctacctgtagtttttcctataattgttttttcaaatgcagtctactatgtgaattaactactcagaatccattctcaatccctttctcctttgtcttttattacttttcagaatgggaagcttaaatttttgatttcacaggcttctttgcctctagggttacttggttactcatgcaacacaattctgctatgaggaggtgtttccttccagaataaaaaggcctcaaaacaccaggagaaaatcctatgccttttctccttcctctgaattaaaatcttacaagcctactccagtctcatcttaagccctcctgttcttctctcactggctggtgtgctccactttttgcttaaaaacgtaccctgtgcccagaatactctcctcagcaatcctccccttctgctatcaacttcctcataatctagcccctctttccccaactcatccaactagatcaggcttcctctctcatgtattattcctgtgtagtccttatcacatttttatgtatatatgaaatatctggatacaagccacaagcagcagggacatctatcttctttatccctgtaccttaaggagcaagcatttaatgagccagttatcatggggcaagcactgttctaagcactttacatgctgtcactcatgctctgttcattacaatatcttattttataggtgaggcaactgaggtagtgaaaggtgaagtcgtgcatgggtagcagagctggatcaaatgtaaatagcttgccccagagtctttgcacttaaccataactgccaggaactatgtctctagagaggtgctggagtgaagagtttgaggcattttatttgaaaaacaacactaggccaggcactgtggctcacgcttgtaattccagcactttaggaggccaaggtgggcggatcacgaagtcaggagatgagaccatcctggccaacatggtgaaaccctgtctctactaaaaatgcaaaaattagctgggcgtgatggcttgtgcctgtattcccagctactcaggaggctgaggcaggagaattgcttgcacccgggaggcagaggttgcagtgagctgaggttgtgccacagcactcaagcctggcaacagagcgagactctgtctcaaaaaaaaacaaaaacacaacactaatagccactctgttgtgtaatgttctaaatgacatttagaaacctttgtgcattattgtgtattcttcaatagctcttatgtctaaccatccattgcttgcacaacttccttttgccacatttctttgttgtgttatatgtgaaagcagttgttctctagtattaaagtgcatgagcaacatggcagatacctttagaaagtgtacattctcagtgcttcctctaccagtattctgattccacagatattctaaggtaggggccaatcatcttaaaaaaaaaaaaaaagaaaagagaaagaatcccaatggactcacagagtgggtttgctgaaaatgaatattcccttaatgaatatgataaaaatgaaacagattttgttttaaaaaattgcaattataaagttaggatagttacatcattttttaaaatatagcatttttaaagtgtcccagaggctagaattattttttaatattagatttcctgtggatgatacaactacaagcagcactgtaaatataaaagatcaaagtgggctaagcaacatttctaggagatgattttcgactcacaaagcaacttcctggactttttaaacacatttaagcacagtaaacaatgctatctcaaaatgaggcaaattcaactttttctattccagtaaccatattaagtcagtattttttttccattttctaattactgcacttattttatcagtgtgttgttaattatatttaatcctatgaaagagcaaaattaaacaaaactaattgttccttgctatttacttatatatttatatacatctgtatatatgtttatgtgcaggtttatttttatcatattcattaagggaatattcattttcaacaaacccactctgtgagtccattgggattctttctcttttctttcttttttttaagatgactggcccctaccttagaatatctgtggaatcagaatactggtagaggaagcactgagaatgtacactttctaaaggtatctgccatgttgctcatgcactttaatactagagaacaactgctttcacatataacacagcaaagaaatatggcaaaaggaagttgtgcaagcaatggatagttagacataagagttattgaagaatacagaataatgcacaaaggtttctaaatgtcatttagaacattacacaacagagtggctattagtgttgttgttttttttttttttctgagacagagtctcactttgttgccaggcttgagtgccgtggcgcaatctcagctcactgcaacctctgcctcctgggtgcaagcaattctcctgcctcagtgtatacatatgtatgtatgtatgtacatatgtgtgtatgatgtaggtgttggggaaaagctgagtgttgggaaaaaagctgagtcagggcttgcatgtctgacataatgtaaaagagtcttggaacatgtctgggggccaggatttaaaaccccttgtagcctttggaacagcaagctctgtgccaaagggtagaaggctgccctgctgcaccataatctaagtccagggcataaaatccctcttggcttggatggaatccagggctcaggggataaaaccccttgtggcctctggaatgcatctagacttgctggctccttgcttcaagcactcccaggatcatagatcgattgcatcttaaactagaagaacatgttttccattatttcaagtagcagaacatgttccatatgcttcaaaagaaatgctaaaccattacagctgtcgatcatgtgcttgatatactgctttctttcaacccccacatcttcaccacctgcttctttgtttgatcaccaataagtagtgctggcttccagagctcagggcctttgcagtctccatactagcatcggccccctggtcccactttatgcactcttaacttgtcttgtctcattcctttgactctgccagatttcgtagcccccactgcctggtgttgggtctggtcactccaacatataggtagccttggtccatggtggtgctaggtctctggttggtgtttcaccatgtgtttgtgtaatattacataccaccacttttatcttaaatatatgtttggtgtgcatacagtttacctaagtatgaaaataaatgttggaaaatctttgtagaatatgcctccatagactttaaaaggaagtattcacagttgttagtaaacatatcctttggttcttaatgatattatagattgctttctcactgaatagaatttttgtttcagattggataaaaactgaaaagataaatatattctaataatgattaagatacaactattttaattaacattcacatttaatttgataatcagattgtattaaagtatttgtatttttctaatatgaatggaatgctaggtgtgtactcaccagacttctctattatacctcgattatactcaaacttaaatagattgatcaatatttaatgggcttcagcatgtgaaagtgggatattttgatttgtttcttttgattttaaaacactggattttgaagacttaatgccaaagtaggcttcaggttctactgctactttaatgtaaaaatttccttcatcactcattttgtcttttgtttaaaagtttgttttaaaaagcacagcattttaatgataatgttattgtttttccctgaaagataatttaattaaaatattcaaatattctttttgtcaaaaatgtgttacttatgttcaattatcagtgaatccagataataattcctgaattaccccaccttataattatccagaagaacctggtttctatagaagtatatataccatctttcctcctcaaagactgtgctgatgttctgctaacagaatgtttatgatacttatgtattattgtgagttatgtttccaggatttctaaaatatatttctatcttttccttagcagctattttcacctataatatacagtattgataaaccttattaaaaaccttctccaggccagatactaggctaggtgccaaggtttagttgtgaacaaatggtctatcaaccttatatagttgtggggaaaggtgaggggtgagggggaggggaaaggtttggaaagatagacatcattcattacaaggttaaatatggaactcagatctgaagtatgagtagcagacaacaatttgtaggaggtgggaggggtagcttaagacttctctaagtaaaaggattagcctatgcaagaactgaaagaattcatggaaagtgaacacagaatatccaaggaactaaaagaaggccagtgtggaaaaaacgaaaggcaatagggaaagttatgagagatgaagctagagtggttgccttaggccacgccatgtagttgcaaatatattatgtttaggattttgtgtgttatcccaagagtaaatgaaagccagtaaatgttagttgacagtacaattaaaatctttgcagtatctaataggaatataatatgacatatttagccatataccaatactaagtaaggaggcatcatttgaagtttgaagataatacttaggccaaatttgtcaataactgattttttttcattgcattcagtaataattttttctcttttcaagaagcttattatttagttgggaaagcaatacagaaataatttacttactaatagttaacaaaatataataaatattatagtgtcaaaaaattatgacagattatgagttgctgagatctctaaagagatcagattgtattaaagtatttgtatttgacaaatactttgcatttgacaaatgtttgtaaatgaaggacaaaaaaatacgattcaatattccaagaggttgtaataacctgtaatgtagataggttcaagaatgtataagacatatttcttgaattatgtaattagggcaccaataataggtcatgatggtaatttgggcttagatggacatcaatctgaaatctgagaattttcaggttaatttctgtacaggagctaatatatttgcccaaaaaattaactttagtgtgactgtatgatcagatctgttgagctgtgtaggaaacatctgccagttcacagaaggtgtttattttcatgatgaaataggaaaataaaaaattctatagtgagttcttaatcccttctgtacaccatgactatggttcctctaattttaatcaaatatggccttagatttttatgcatagactcaagtttagtttacaatactaaataaacattttgttaatgtgaaagcgttcaacaatatatgcatttaaaaaaataaacagtaagcagtgtttaaaaatagtaaacaaaaaagtaaattaaattgttgtattttgtatgtaacactagcaagtatgttttttaagtgagaaccatcaaggcagttcattattttaaaacaagtgaaatggttgctttcaaacacacttagaggattataatcactaaaacttttatggacagcaatttgataacgtatacataaaacatccatcctgtttgatgcaatagttacattctgacagtcttccacaagaaacattgaaacattttgataaggatttattgagaaaaatgcattttgaattatttttgcttcctatataagatgtaacagcaactaaatatctaaaaatacaaagttggttaagagaataatggctcatacatttgatgagctattatttaatacacaaaaagggtgcatacaaaaactttaatggaataagaaaagtttcatgatattatcttagtgggaaaaagtgggaaattaaattgtatctgtggtgtgcatgatgtattagttttccattgtcactgcaataaattagtataaacttagtttaaaacagcacaaatttattatcttacagttctggaagtcagtaaaatcagtctcagcgggctaaaattgaagtgttgtcagggctagtttcttctggagactctacaggagaattagattttttgcctttaagtttttagaagctgccttcattctttggcttatagtccctgtcatattgccttttctccctctgtttccactgtcacataggcttctctgtcactgacccgttggtatccactttataggagccttatgattacattgggcccaatcagataatccaggatttatcttcccgtcttgaaatcctttacttaacacatctgaaagtcacttgtgtcatgtaaggtaacattatttataggttcctggaattaggatgtgaacatcattttggggacattattttttctaccacacatggaataactatatttgttatttaaacaaggacactgttgaaaattaaagagggcgttattaataattatttcaggataacagaggtaaagaggagctcttcttagaaaatccagatagtaacctaagtacacggctagagtgataagaaatgacaagctctctgagtttaaacagatttcctttctttgaaagtgtcatgtttttgttatcttgaaaaactagttttttcctttttctttgtagttctggaatgtcaccattatgtgcctagtcgtggatcttttaactcactatactcaaggaagctcattatactcaaggattcttggattctcagactcaagagaaacactaagaaatttctattattactctgactttttcacctcaaatattttttctctttcctctttctgaaacttcatatatgtgtgtgtctgtatgcatgcatatatatacatatatacacacacatattcatatacatattgacccttctaagtgggttctcaatttctcttaaatttttgttgtattttctatctctttttgagattctgagatttagtacactttatgttcctatttactactatactcagcttaacttgcctgctttatggatctgtggactttgattttgaaacatctcacatgtttgcccagcatttcttctgctctggtttctctttcaatattttcccttgcacatttcagcttcataaaagttattagaatttctggttctctgatggtatctttttctgttcttagtgctgatatagattaattcatttttaaacatttctgcaataatttaaatgaaatttgaggagcacatgttatgtttatattagctttccaactgaagctaaattgtggctgcatattatttcactgtacaaaaaggttataattagcttacccaggtacttaatataagttgtttctactttaatagctattatgatattaagtattccatgctggataaacacacacacacatacacacacaaacacacgtgcacataaattagggaacatatctgtgattatttccctattaagggacaaggatatgttgaattgaggttttccttttccacaagaaagattgcaaatttcaaatttctactaattggtctgagattgttcagatggtagagtttcattatctgatagtcatgttctataaagtgaaggaatactgaaccattgcttctaggagaaatgaaggctcaaattcctgaagatctctggtcacatttcatcaaccaataaatacataaccttgttttatgtgtgtttatttttaaagatgccttatttcatattttttaaattaattaacattgaattcatggccaacatcactatcactcatgcctgaatgaagcctatctaacaaacatattttctctgtgaggtacatcacaatcttctcgagcttaggaacactagctagacttcctcactatgcttgggagctgaaatcaagccacttaaaatagagaaatcaccagcagaaagcaaaatgatgcaaaacacctggcactagaaagaccatgaaaaggacacttatttacaatgtgagagttgaaccatgaaggcagagaaggccttattggaccttagttagaaacatgtgggttgggcgtgaaagcactgtgagcattgatttggagattacaaaatattttagtgagtgggcaattcataaatgtaaaatcacaaataatgagaatagattgtgtttcctttctacatattccataacatctattaacaactttggaatacaaaaattaatccccccaaaattcgagtttttcttttttttgaactagactgctttatttcagggagctctcaagcttcttgttactttgttaactaatcattgaattttccctcttggtcaatcatacaaaatttagaattaatacaatactatcattccccccttttcaataaacttactgtgtaatcttcagcttggcatatattaactgggagcaaaattttgacactgcgaaagaaaagattcagtgatatcattagttatcccacctatatgcttagtcttataaaacctaggactgcatgtatcatgttgaaaagatacttcaacctttgcctaacaccagtgtcccaatcagggatctactttcatttttcatttactggaccattactaatgtccaattgacaagtttattaagctttgccctcacccactttgatctacaaacctgctcagttcagaggagagaatacaagacccactgctattcgttttacagaaattcaaatgttctttatttataaatataaaagagggtttgattcagtttccagaagaagagaagacttgaagagttacactgaggactacctgatggctctgtaggtggagaaggaaggccagtacaaaggaaagtgcaggagttcagattagaagagacacatccatggcttaagagagtagcaattctaaaacattctaaatattctaaaatattatagaatggaaatctggatacaatggtgactctacaaatggagcaccataaaccagttgtagaatgcatttctatgaagtccagaaatgtattgatactcacttcaagatctcttgcctgttagaatgaggatggtgattgaggaggtaatggagaaaaggttaaatcatctctccaagtcatattcttctttttgagcatctaatttagatttcttatagaaaaagtgttttaaaagaataaaacatagacatgaatctggataaataatattgtttgtatcagtcacggactggaaccatgagaacatatgacatgaactacatgttggtgttaaataaaataattaatgcaatgtaatataaaatagatcactaggaaattcaggaggggaaatttttgaagcagttccatagaaacagagctactctgggagtcaggagttctgggagatgcaaaatccaaagcgggttcttgcacccactctgggatattttggccagtcaggttcttggtgctttgggttcctcaattgtaagatgacagaggtaaactaagtgatctctaaaacagtcccaatatctactattcaacaagtcacagtaatagacagagaagtaggaaaattgtgttttaagttcctgtcttagatgctgtaaagaagaaagtgatacttctacaaagtcaaagagattgacgttggagagatcctcttctgatttagcaaggacatagttattgaccacattagatatcatctgattataattaagttatggaacatttaagtggggaagataaagagagaaataaacatatttatattccaaatatagcaataactaaaaaaatcggcaagtcatatctcacatacatagacatgagaagaaatgtggtcactggacattgccctttttctatttttacaaatgctttctttagttttttccagagggtggtgaggtacatagggtagagtacatagttaattttatataattataaacgagtgtatttgaataaaaattctactatttatttatttatttatttatttatttttgagacaaagtctcattctgttgcccaggctggagtgcatgatctcggctcactgcaacctccgcctcctgagttcgagcaattctcctgcctcagcctcttgaatagctgggattacaggcatgtgccaccacgcccagctaatttttgtatttttagtagaaacggtttcaccatgttggccaggctggtctcaaactcctgacctcaggtgatccacccacctcagccttgcaaagtgttgggattacaggcatgagctatcatgcctggccaaaattctattttttaaaaagtatatcttacctatgtttagataatttttctgatgagttagtactcatatgggtgcttttttttttttgaaatacatagactattggtcttagacataacaggacacacactaaattctattaaaacaattcagggactcacccatgcatacagcaattatgattgtgaacatccaagacaaattagtatggaatgtcttaattaaagctgggtaaagtaatttttttacagatagattgaattttattaaatatttagagtggtatattttcatttcactcttatgtaattaatatttagcacagttctttgggtatcaggttgcattatttatgcacattttttgagaaatataatagtgtttttttgttttgttttgttttgttttgtttgttttgcgatggagtcttgctctgtcacccagagtacaatggctggagtgcaatggtgcaatcttggctcactgcaacctccacctcccgggttcaagcgattctcctgcctgaacctcctgagtagctgggattacaggtgtgtgccaccacgcccagctaattttttgtatttttagtaaagacggggtttcactgtgttagccaggagggtctcggtctcctgacctcttgatctgcctgcctcggcctccctaagtgctgggattacaggcatgagccactgcgcccggcctgagaaatataatagtatttctaagaagtctctggaaaatagaccataattttttttattatattcaaaatgcaaattttgccttttgctaaccagataaaaatacttatgattttcgtatttgcttagttacaggtattaactgagcaaaattgttaaaatgtgtttgattttgtttggatagggatttgttttcatgttttcaaactaaagttgagaatcttttccagtggcattcttaactcatagatatgatgtgaaaattgtagttgccttaatcctgctcttgttgtctttaggaaaactgtgactcatatcagtagcttattaccaaagttacatggctattagagtttgagccttgggatagaagagtaaacattctgcttttgtcatgagatactgtttttttggctatagtattccctctaaggcagcctctaagaaaagcatcatttatcttagtttagctatgagaagtctacagaaatcctttcctcattttaaaaaaatgagttttcagaaatatccacaaatattcaatgaatagttaagcacaaaactgtgtaatgtttagtaacactcaacagatgttttgctaagccttttttaaaaattataaatcaataaatacataaagaaaaaacaccttgaaaatctttatatcctttaatggtaaaataggacagtatgaattctcatctagtcctatggttttcacattgggagtaaaagcgcttggatttaatgagaagtgttctgttggaatgaaagaaaactgaatttcttaactctaggcagtagcttattagcacagtattgttctctggtaaatacctttgcttccattttctcacctgcttccactcgtaaattctcacctcctgcaatagaaactttgcctcttagtgactttgtggttgaaactagagaaaagctgtttactcagcaacatctagtattttgctgcttcttcctgggtgattagatttagaaatcatgaaaatggaggcttttttcttctactttttgtttggcaagcatgttctaattctttttttttttttgagacaagagtttcgctctgtcacgcaggctggaatgcagtggcacgacctcacctcactgcaaactctgcctccggggttcacgcccttctgcctcagcctcccaagtagctgagactacaggtgcctgccaccatgcccagctaattttttttgtatttttagtagagatgggatttcaccatgttagccaggatggtctcgatctcctgaccttgtgatctgcctggctcagcctcccaaagtgctgggattacaggcgtgagccaccgcgccaggccaagcatgttctaattcttaaaattgatctgccaatgactgtggaaaaggtaatcacttatttcatacagcaataatttattattaatattttttaaaaatactaaaaattaacctcatatcacaaacttttttttctcataaactgttgtgtcactagtataatctagaatttaggaggggagttattttttaaagaaatcacttatttgtgattttttttttcctaaaaggatgatttaaaaattatcttttgacttttcaaaatcaaactttttctccttgagtttaaatatttattatgtttcaaatgtcttaggaaaaataaaagataattttttcatgtactgatagtatatacattaattttccagagctctgtctaactagtgctgattgatcaccagagcactaatttcttcacattatgcatgcaaatataaaactgctctcttgtctgtgttatttctggcttttaaatgtgtttacaatattttagaaagttgcttagtttttgaatttctcaaatgccgcatatatcagtaagcaaaataaaggccattaaaaaattacagcagaattaaaatttcaaggcagaagtatgtcactctcacacgataagccaaaagaggtcagacttgtctttctaattatttccagagacctgccctacaaatcaggaaccatcacatggatacataaaagtgtctttaattgtgaaagcaactatgcaaattattcattgctatcatccctgatcaattcccagattattttcaaactgagagacccaaaatgacataattttaagggagttacatggaatagtcactttgataattgtgtactcattttaacatactagaaaaatatgatatattaaaacaaagctttgactgatattgtttaggataaagctaaataaaatttataaataagtcgatttaaataaaacattaaggagaaaattggaccctattgtaggagcttgactatggcagccattctaagggtagcatgtgattgaggttcagtaaagtgaggtccaaagcagcccttttggctctgtaggtattatttgattgaaaggagtcaagatttctctaagaactctcagagtaaggagccttgttttggggaagatgtccatgagtggcatacatagcagaactgtgagcaagatggcacttcagagccactgctgtcaccatctctctccttgaatcttggtctttttctccctctggtgcttctgctgtctcccatctcctccataagatttcttcctctaccctccttccaacttcaactattgctctaaataacttaatgactatggtgtttccctatgtatgttcccaaaagttatttcccagaccttgctctctaaatttagatggtcttgagttaagcaccgcacctttggtataatcagttatggccagggtgctgcagggatgccagatctacttagagctgtgagcagggcacgttcattcagacagtctgtgagctgaagaagacagtttgatgtcatctccaggatatcattaatgtcacccaggaggaaattgaggcctaggaatgattatacagcaaatgaatacacattcaagactagagtccattgggttcattgctaatcaaatattatccccatttatctgaaaatatttattatgcatcatcagcacatgagatattatgaagtaactaaaagtgatttagccatagagtctttcccctttagaaaactaatataggaaatagatcccagcaatgtcgagaattattatggactgtggaaatgaataggtttagactactataaagttgtgaaacaatgaaggttcatttcctgaatctactgaatttctttgattttttttttttcatttccttttctgtctttcctttccaggggcctagtactatcatgacatgtcttgttctagaattctcttcttttcctcactcagtccctatcaagctagatatatttgctccccaaagaaaaaaatgtttctttcagctcttttttcttcttttcctttcctttccttcctcccttctttcctttctttcttccctatttctatccttcctttctctttctttccaacattgccaactgacaaacaacccttctcaggtaagattttttaaaaggaagaacctctggaactatatttatttttttgtgcgtcactgattacttttttgttccattgtttacatttcccgtcatcttactgactgcctactgctgttcttcaagagctctatatttgtacctctttgcttttctattttattgagtctattgtcatgtcatatatttttgcatcccttcttcttatattatcagtttctaatcatatttccaactgcttttataatatttatatgggtatcacattattgcctcatcttaatgctttgaaaattaaagcatcacattggccctgctctgcaatagggatattcctatcctaggaattagttctaaataactaattttcatcaatgatcagtttttttttgtttgtttgttttattttgtttgtttttttttttttttttgagacggagtcttgcactgttgcttaggctggagtgcagtggcacgatcttggctcactgcaagctccgcctcctgggttcacccattgtcctgcctcagccaatgatcaggtctttaacttgatctttagtcttctctttcttgaatttcaggatgttaccactttttgcctttattaataatgtgcgtgtggatattcaaaaatttttaaatctattttcctctatattcaaacccttcctttccttcaagaacccaaaacctaccacactcataaaattatcagactgccacagcatttggtaacctctataactgtatttttctgacaccacatgaattagcaatcattaggttaaagagatattttaagaataggaattaatatttctagaaataaaacatctaaaaaatggtttataaaaagtcacttttttaggctaatcaaacataatatagtcattataatgttactataggcagagaaacttacagggctgatgtacagtattaatttttaggttcattttaacatgcagttattgggtccagatattataatagagtggaaagattcaactgtctattaataaaagactagaagcaatcatggcacctccatacagtaggctgttttatagttttgaagaagcttggcatatgtcctgcaagaccattgagtcaagggaaaaagcacattgcagaagaggatacacaatctaatatatgcatacaacaaatgttcatacaaatatgtacacacattttatatttgtacagggtcagtgttgaaaatggtgcaacaaattgtccacactggcttctactaaggtaatgtaatagttactttatacattttattatattttgaaatttcccaataagcctaaattaatattataataaaacaaatgtattacaaacaacaaaaaaaaataaagaacattggaaaaataaatgctatcactttaacggacatactcattccatttctagttgtttaataattgtgaaagtgaaaaaagtctcatgttacagtacattcattctatatgaaatattaacaactttaatacttaatagttgcaagtgtcatttataaataaagttatatttttaaattatttcattattttggtgctgtttataaggcttcaaaagatactcatattacttgagaaatatatgttgtcttttcttctaggtgttataaactttaaacaaatttaatttgctgtgtattttagttgaatatggagaccgacctgctgaagtaaaaataatagtaaaagtaactctatatcattcaaaaatggcatgctgttataattttatagtttcatttataattttacagtttgtaatttcatccagttctctacgacaacatacttgattcttttgggattagactttggagcaataagatgtgattttttttcttaaagtcattgtaatctaaaattgtccaggtctcacaaatcttgctgctctttttttttttcattattttttattattatacttttaagttttagggtacatgtgcacaatgtgcaggttaggtacatatgtatacctgtgacatgctggtgcgctgcacccactaactcgtcatctagcattaggtatatctcccaatgctatccctccccctttcccccaccccacaacagtccccagagtgtgatgttcccctttctgtgtccatgtgttctcattgttcaattcccacctatgagtgagaatatgcagtgtttggttttttgtccttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttataatcctttgggtatatacccagtaatgggatggctgagtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatgatatctcactgtggttttgatttgcatttctctgatggccagtgatggtgagcatgttttcatgcgtattttggctgcataaatgtcttcttttgagaagtgtctgttcatgtccttcgcccactttttgatgggcttgtttgctttttccttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagataccatttgtcaattttggcttttgttgccgttgcttttggtgttttagacatgaagtccttgcccatgcctatgtcctgaatggtaatgcctaggttttcttctagggattttatggttttagggctaacatttaagtctttaatccatcttgaattgatttttgtataaggtgtaaggaagggatccagtttcagctttctacatatggccagccagttttcccagcactatttattaaatagggaatcctttccccaatacttgtttttctcaggtttgtcaaagatcagatagttgtagatttgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggtagtatggccaatttcatgatattgattcttcctacccatgagcatggaatgttcttccatttgtttgtatcctcttttatttcactgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctaaagttgcttatcagcttaacgagattttgggatgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccattaatacctaatttgttgagagtttttagcatgaagggttgttgaattttgtcaaaggccttttctgcatctattgagataatcatgtggtttttgtctttgattctgcttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacatttcagctcctgttattggtctattcagagattcaacttcttcctggtttagtcttgggagagtgtatgtgtcgaggaaaggaacaaccggtaccagccgctgtaaaatcatgccaaaatgtagagaccatcgagactaggaagaaactgcatcaactaatgagcaaaataaccagctaacatcataatgacaggttcaaattcacacataacaatattaactttaaatgtaaatggactaaatgctccaattaaaagacacagactggtaaattggataaagagtcaagacccatcagtgtgttgtatttgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgatctacaaagagaattagactcccacacattaataatgggagcctttgacaccccactgtcaacgttagacagatcaacgagacaaaaggtcaacaaggatacccaggaattgaactcagctctgcaccaagcggacctaatagacatctatagaagtctccaccccaaatcaacagaatatacatttttttcagaaccacaccacaccgattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatgcaaaattgacaccctaacatcacaattaaaagaactagaaaagcaagagcaaacacattcaaaagccagcagacggcaagaaataactaaaatcagagcagaactgaaggaaatagagacacaaaaaacccttcaaaaaattaacgaatccaggagctggttttttgaaaggatcaacaaaatagatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaaatcttgctgctcttaaccactatcggtacaccttcagaatggccatgttttatgccggaaactgccttgtttactctgcaactcccttggtatttcactttcacccattatcagttctttcatgtttttctgtcctaccctcctactgcagaaagctcacttcctggcagtgcccagtcactgttcctagagcagccctagggattgctgttttctgctatctgtggaagcccaaggacagaaaggttgtacgcaggcagcacttcctttcagctttaccttaccagagacttgctgtttggaacacagaaatgggtgaggacactctactcttaccgttttgcccccatctcatcctggcaatgcttgtgttgtggttcctttacctataacttcctcctgtcaagacttgtaggaggtttaggagaggctgttctggggaatgtgcagtttgtgtctgttgctgcttccttttcttggttcctggttcccacctctcaggcatgcaccagacatcctccttagacttccttaacgaaggacaccttctctgcatgcaaatcagctcttaaaaatggatacctgggggtgaatcaatgtctaacctaattctaaatataaatttaagcttagcctgcaattctgtgacatgaaacagatttataagtttgcttaacattatctatacactatggtcatgtaaaattgctttgactggaaacctgagaaaaacatttttacttacaatttctttttaaaaatttgctttctttcagagtttgaattggtatttccaagaaccagataataattacaaatttctattcttttgcagttttgctcctttcccataattctggtactccagaaagtagaactaaccaaataaatgtgcaatttgatttaaaattgtaccactggtcctgacagtaagaacaattgtaattttgccttaacgtccttttttcacacttaccagatgccttgaaactgtaaatacattttaaaaacgtggagaaactttttttcccacttcctacttattttgttctaactgtatttcacaattccctgttgctccggtgatttatgtgtttgccattttgtctgtgatgaaaatatttgtaaagttaccttcagtaaaaagactatatccattaacttaagaatggcatgatactttaaatttttaaaatgaatttgataagggaattattttagaaaaataaagactttaagtttgatgttttggtttatttttcaataagatgacaaacgaagggtaaagtacatggaagactagatgagagggctatcacaggaagcacccatagactttagatacatatgcaaagggatttaataatctattcaccaatttggtgagggagggattcttgttttaggattatggggatagactaatacacaatattcacactagattgtacagatgaaattgatagcagattatcacatatacacactcctagcacagggaaagaggatacagcacaccaccgtgggccacatgaagttgcactcaaaagcagaaggaacaagtagaggctgtgggagagaggcttcatagtgtcaagagagcagggtgacacctgattcccatgggaggatgtggttggcttatttgaaaaattccaccactggcagaaaattgaaacctgctactcaggtatcagcaagaactccacctagtccctttgataaggagccttgtttggctgggggaccttatccacaggagcataatggagaagggagcttgtgcgtaagccatttgagtccttattggtttcaccagagggccttagttttggcattacaactcaaaatgactcctgtgttgtctttacttacgaggaacaaataccttctctagtagttaaaaaaaaaaaaaagatgttttattacaaaggcaaaaacaagggctcttatggatgtccaaggccctgcactatgggaagagttcaagaccctaaacctgtattctatgttctccaagagcagtcctctttctctcattcgtggatgatatgctcgaatatgtgtagagcatccttgcaagtagggagctacttacactttctcttcctaataattgtcaacaaaaagagtcaaactctgtaaaatattttaagagatttattctgaaccaaatatgaatgaccatggcccatgacacagcccttaggaggtcctgagaacatgtgctcaaggtggtcagggtgcagcttggttttatatatttttagggaggcatgagacatcagtcaaatacacttaagaaatacattggtttggttcagaaaggcaggacaactccaagttgggggtcttccaggctataggtaaatttagacattttctggtttacaattggctgagtttatctgaagaactaggatcaatggaaaggaatgtttaggttaagataaaggattgtggagaccaagttttatggtgcagaggaatctctcagatagctgacttcagagagagagagcaggttataaaatgtttcttatcagacctaaaagggtacctggctcttatttgattgtctcctggacctggaaagaaaggaaggaaaacaaaggggaaagaggattctctataggatgtggatttttcccacaggatactttgcagggcaatttcaaggtatggcaaggaaatatattttggggttaaatattttttccttgtcttgtaatgttatgccagagtcagactgaaaagtaagtcacaatatatagggtcaaataaaatccatctaatgcgaatttatggttgtcaggcatgactccctagaccacttaggtaggaatttgggtaagataaaaaatcagaacttagtcctcataatcttgtatgtttctcttgagagtcttgactttccagctacagtgcttgctaacaactctttctatgctttccagttccaattccaaagagatctgatgatctcttttgccattgttgcagagggattaacacatggccaggttatgaatgagctgcttctgagacaggcatccattcttattatactcagtggtagctaaaatagatgtggagacacataacaaaacatggctaaataaagaagcagaaattgagggcatgggtttcctcatcaaggaaagatgtgggaagcaagaccttctgaaatatgcatagcaaaataccccagagcctcaaaccagttctgcactgcatttttttctttcataaaataaaactttaattttttaactaccaagtcaaactagtgaatcagccttggcttttccctctttcttctttccactccccatctgtatttttgacaaactaaagatgtgaagttttctttcttaatatttctctcttcctttgaaatataaagacattacccagatccaggctcctttcccttcagcgtgaatctgttacagctgtcctctggcacctttagggatcctgtacctccagaatctctctttgtcagtccctgctgtacccagcccaaccaatcctaatgaaacaccagtttcaaataggcttatgtatctccctattcttccagaattgtcctcaaggcaataccttgaattgactcctatctttctatgtatctgccctatttcctgacaaaaggaggctaactttagggaattttacacctgcatagacaactggaattgcaggttaggatgagattaagatcaagattgttatatgttttgctgcatttgttgttttccaaaccagatcataaccccctggaggataggaattaagtcaggttctttttaccctagaacccattcaatcatatacactttgatgttgatttctttatactttgaaagcatttataggaagttatttgtgtaagagttaaagaagaaagaaacacaaaaagtggctcaacagtcaaagacaggtttattttggagaataaacctgagaggggcatctggccaattttggtcaggagcattctctcttacagactaagggtatttaagcgtttaggaagggagagcttatcacaagctcagaatgtttctgtgcacaggagagttttattgtggggtcggcatgtctctggacagagggtaggttatctcagggctggcatgtttctggttggagtggaggttatctcagggctggcatgtttctggttggatggagatttatctcagagctggaatgtttctggtcggaggtgtcacttgtagtttatggtcatgctgacattagtcattaggctaatggtttggggctggatttacgcggtttttaatcaaggggaacttaaaattgctgtgtttgtcctagatggtgatgatcctgctctgtcaatttgtattggttatttgattcaactgcttagaaaaaaataagtatggctattttgtcttatctgatgggattacatagtataaaaacagactggcttaagtatggcatctcaacatctcacagccacaaactggatattgcgtcctaataatgaattcacgttgatgatcttttcagtggtattgcaaaagaactcccttattgattaaacacagctcttgatttttctaagcatataagtaaaactcaaagaattaaaacaataaagttttcctgggagaggaaaatcaggaaatctgacataaaatgccagtttgccttaaattagtaattacttgtgtaaagtgtgcattaaaagatacatagcctgggcacagtgcctcacacctgtaattccagcactttgggaggttaagccgggcagatcacttgaggtcagaagttcaagagcagcctggccaacatggcaagaacccatctctacaaaaaatagaaaaattagctgagcatggtggcatgctcctttagtcccagcttctcaagaggctgaggcaggagaatggcttgaacacaggatgcagaggttgcagtgagccgagatcgcatcactgcattccagcctggatgatagagtgagactccatctccaaaaaaaaaaaagatacataaataccacttaactatgtgatttgttgaaattatgttctatgtatttacttttatcacattgaaatacattctgttcttatatattttttttcaagttaagggtgaatgccaaacatgcataaacctcacctatagagtctattgcctttcagccttgttatgccttaatactgattctgtatgcatatatacataatttggtagatatttagcaatgttacatttggaaaaactaggccagtgtactataatcagctttggaaaagttgttctcatttgcaatttttcttacaattgaacaaatgactgttaaatacttcatttttctaagtatatggattaaaatatagcttgtagaaatgtcagagtattctaacttgaaatgtaggaaagcgttttgtgtagttttgtaagttctttcttcaattttgtggattagtaagtacataaaaagaattcattctgactgtaggctgacaacattggattggcagctgaaaaaagttgtcagcattgcctgtcagattcaaacttagcagtgtacaaggtttataaaagcttgaagctatcctgtcaacactggcatttcattaaagattaattaacccgaatttgcttgctaataaagatcaaaatatcagtcatttctctcacaaaaaacgtgtgactaacttgtagcttatgccttgtgtatgtgcatattcatggttaagaaatgaagtactataggtcttttttaagtttatactaaaggcaatggtgtgcaaaggaaagtggaaggttttagttaaaattagatcagagcatacacatagctaaaactgacttcagtatttgctgcaaccaggaaaatagaggaaaatatctcttttctttgaagaccattccagaattgattttacacttcacttttctaatgttcacatattagaaaaaaagttaatcctatttaaaatgtgaaaatagatcacttcatatttccaactgactacaatataatacagtgaaaatgttgctaaagttctatataaactatatgtgttaaataagtaaatgaaattaccagaccctcatgacttttccgctcttatagcaataataaaaacatcatttaaagctgctgtgttacattaagtcattactgggcaacttatttaatgaaaaataagcttatccattatgtaacaaatgttttattggtaatgtattgtgttccctgaactctgcaatgtaatgaggataaatggtaagcaaaacagacacattatgtatcctcacggatttaacaatttattgggggaacaactatgggtttaagtcatactacaatgcaaaattgcagctctacatgtgctatgaaggagtggtttccaggaccataagagtctgtgataagggggtttacagaataaagcagatcaaggaagtcctctttaagaggttgccctggagtttagacctgaagaatttgtgaggaggtatcagttgaaagagtcagggaaagatctgcccagacagaagggctgaataaaagaccctttggcaagaaggagtgtaacaaacacagggactgttatgggttgcattatgtcacaccaaaaagatatgctgaagtcttaaccccaagtacctcagaatgtgactttatttggaaacaaggactttgcagattttacaaagttagaatgaggtcactggggtagaccccaatccaatatgacgcgtgttcttgtaagaaggagaaaggtgggcatggacatgcagaggaaagactatgtgaagagacacagagaataaggacatattcaagccagggaattcctgaggttaccagaagccaggaaagaggcctggaactgatccttccctagcaccttcagtgggagcatgactctgctaacaccttgagtttggccttctggcctccagaagtgtggcacaataaatttctgttgttatcagtcactcagtttgtaatactttgttacaacagccctaggaatgtaatacagggactgaaaacatatcagtgtagattgcaaaggaagaataagagcaacttgatctgaagagaggatagaacaataggcagggacaagacaataggtcctgaaggccatttttatgagtttcctttttattctaagagcaaaggatttaagaagtacaagaaaaagatgatagtagcttggacactagagtggtagtaatggttatagagagaaatcattggaaatagggaagtgaataaaaaattatgaataaaccacaaaaactcaggcttactcaaggacatcatttaagccattgtgtttgcttttgtcatcaatttttcaatctctattaaaaactggttttcgttaacagattgaggagtagttggcatgtaatataatgcatgtttaaaaagtgtgaaatttaataaattttgacatataattataaaggtatcataatcaagatagttaacatccaatcatctcatatccaataatccaataattaatgtctaaacccaaaattttcctagttcctctatgtgttactttatttatttatttattgagatggagtcttgctttgttgcctagcctagagtgcagtggtgcgatcttggctcacttcaacctctgcctccccggttcaagtgattctcctgcctcagcctcctgagcagctgggactataggtgcacaccaccatgcccagctaatttttgtatttttagtagagacggggtttcactatattggccaagctgatccaatctcctgactttgtgatccacccaccttggcctcccaaagtgctgggattacaggcatgagccaaagcgcccggctgttactttattttaatattcctttctctgaaatttatttttcttatattgtcatcccagttttttattattagcatgacgtattatttcccactattttaaaacttatttgtatctttgtattaaagggagttccctgcagacagcaaataattggattttactttcttgtttaatttgataatgtctgccatttaattggaatatttagttcacttacatttaatgtgactattggtatggttaggtattaatccaccttttttttttttttttttttttttttttttgagacagagtctcgctctgtcacccaggctggagtgtagtggtgccgtctcggctcactgcaacctccacctcctgggctcaagcgattctgcctcagcctcccaactagctgggacaacaggcgcgtgccaccacacctggctaagtttttgtatttttagcagaggtggggtttcactgttttagccagggtggtcttgatgtcctgacctcgtgatctgcccacctcggcctcccaaagtgctgggattacaggtgtgagccaccattcctggctaacccaccattttctacttgttttctatttgtttcctttgttctttgtaatttttcccttttttcctgctttctttaggattatttttattccattttatgtatattgttaccttattagtcataaccctttattttggtggttgtttcttgcttcaagtaatattaagttatgtacctcttcacatatagtatgaggaacttgtaagaaaatattactacttccaatttcttctcctggcctttctgttattattgtcatgcatattattgtatatatgttataaaagtcacagtacaagtcatttatcacttgaatgcatttaactattaaggaaaatatcttatgtatttacccaaaaaagttaattctacttgtgatcttcatttctttgagggaattttaatttttacatgattatcattttactaaattacttttttggacatttcttgtagtgtggggtttgctggtgaaaaattggttcattttctttgtctgaaagtacttattttagcattttttaaatgatattcttccaggttataaaattctagattggcgtcctattatttcttttagtatttaaaaatgttgctcaactgactgcttacttcattgttttctactagaaattggctgtcattttgatctttgtcttttgtaaaggcatatgtttttttgtctgacccctttcgagattttatcactgattctgagcaatttgaatataatgtatcttgacatagttttcttcatgtttcttgtggttgaagtttgatatgattctcggaactgagagtatatagttttcctcaaattgcaagattttggctactatttcttcataattttttgtccctttttatttctcctttcctttagagactcccattgacaaaaagattcaaactctgtaaaatatttgaagggatttattctgagccaaatataagtaaccatgacctgtgacatatccctcaggaggaactgaggacatgtgcctaaggtggtcagggtgcagcttggttttatacattttagggaggcatgagacatcaatcaaatacatttgagaaatacattggtttggtccagaaaggtggggcagtttgaacttggggggaggatttccaggctataggtggtaaatttaaacattttctagttgacaattggttgagtttgtctaaagaccttggatcaacagaaaggaaatgttcaggttaagataaagattgtggagaccaaggtattttgaattctcatagtggctgccattaaagacaatagatgacaaatgtttcctattcagacctttaaaaggtcctagactctcagttaatctcttcaggaatgggagggcctgggaaaacaaagatctagctatgttaatagagattctttacatatgcaaattttctcccacaaagtacagctttgcagggccatttcaaaatgtggcaaagaaacatgtttggattttcttctttgtcaggtaatgttacacataaaatatttggattttcttctttgtcatgtaatgttatgccagagtcagattggaaagtaagtcacgatatatagggttaaataaaacccatctaatgagaatttatggtttgtagggcatgactccccagatcccttagataggaatttgcatgagataaaaaaaatcaaagcttagtcttcaatcccattgcatttatattagttcactttaagtattccacagtttatggatgctctgttaatttttttttcagtttgtattgttttgaattctatgcctccaaattaatttttctcctgcaatctctaatctgcttccatctagtaaattatctcagatattatattaataattctatcaccagacattttatttgatcctttttaacttccctgtttcttcttaacctatttaatctttcctctcattttttgaacatatgaaatttgatgtaatgacttaaaatgttctctttttttgagccagagtctcactctgttgcccaggctggagtgcagtggctcgatcttggcccactgcaacctccaccaccctggttcaagcaattctcctgcctcagcctcctgagcagctgggatcacaggctcctgccacggtgcctggttagtgtttgtatttttagtagagtcagggtttcaccatcttggccaggctggtcttgaatgcctgacctcgtgatccacccacctcagccttgcaaagtgctggaattacaggcatgagccactgctcctggccttaaaatattcttgtctaattttatcatctgtgtcagttatggattggttttgattgacttttctcttcacatggttcagattttccaatttctttgtgtattgttaatttttgtttggatgccaaacaatgtgagttttactttttgggtactggatatttttattctatattctttagatttcttttgaaaagcagttaaatcacttagaagcagtttgatccttttggatcttgattttaaacttagaacagaatttagtgctggggctttttttttttttttttttttttttttggtctcacttcaaaagtgtgacctctctaagagcagtgcccaatagccatatgaattaataagattttttagtttgaaaacactcattattctcagccttactgagttctgaatatattgttctcactattcttttcaggtggctcttttcatatccttggttagtgtcctaacaaacatgtgctaattagtacccagctgaatattcgaggagaattgtttacagatgtctggaattttctctctgctgccctcttttctctttagtgtgcactttactatgctgctgtagagaggctatcctactccagaaagacttgtttataatttcttcacaccactcatttattcattttctcctttatacttcttccaatctggtttttacatcctctgaaattcttatcaagtcatcagaccatcattttgctaaatctagtgtttatttttggtataaatattctggcctccataatgtctgacctcatcttttattaatttctccttcaatccatcacattaaaaaaattcttcgatcacagtaggcatgattttgtcttagaacatttatactggctattttttctgcttgaaatgccctttcttcagatatttgcctcgttaacaaactcctctatttctagacttaactcttcgtcttagtcttagtccatttgtgctgctataacacagactgtggaattgataaaagacagatatttatttctaacagtctggaggctgggaagtccaaggtcaagtcaccagcagatttggctctccagcaagggctgcatcctccagagtgaaggaaactgtgtccttacactgcctccagaggcagaagggcaagagagagacactccctctatccactgctttgataaggatacctaatctcattcatgagtatgatggttaatattaggtgtcaacttgactggattgagggatgcctagatggctgatgaagcatgttaatagatgtgtctgtgagggacacatctatttgccagaggagactgatatttgagttagtagactgggagaggaaaattcatcctcaatgtgggtggcaccaaccatttgtctgccagtgcaggtagaacaaagcaggcagaagaagaggataggcagcttgttgagtctttttgctccttctcttcccatgttatgctggatgcttggcttcctctcctcgtgcccttggatattaactccaggttcttcagcctttggtctgtgaggcttgtaccagcaacctcccaggggctcttgggcctatggcctcagactgagggctgcactgttggcttccctgatattgaggcattcagatttaaactgagctatgctactggcttctctctttctctagcttgcatatagatagatacagatatagatatagatatatagatatatatatagatcctattggttctgtctctctgcagaaccctgactaatacagtgacggaggagccctgaaggcctaatcacctcttaaaggccccacctcttaatactatcacactggcaacatctgaattttggagagggcacattcaaaccatagcactcttcaataagcctaatcaccctacttaaaattccagcaacttcccaggatagccagtctctaaagataaccctcaataaaccttgtgtaaccctttcctcttgaatctgggctagccctgacttggagccaatagaatgcagcaggtgtgacaatctagatcttctgaggcagtcagaggacaacttgcaaattctgactgggtctgcttaaatgctagctgtcagggtgctcactctcagtacacatggagaggccacctttaggcaccttgatcaataacctcagctaagcctacatttgacaaccagtatcaactgctggccatgtgatggagctgtcttggacctctagcccagactaaagccctggctgatatctgtctgtaaacacatgagaaactgtaagtgagagccaactagatcagctaaaacacagtaatacaagttaataataaattgtttgaagccactaagctttgaagtggtttataggcaaggatagctagaaactctgtttgccctgcacttcaatttttaatctcttgctctttgtctttttccctcagcatttgttatcatttaacatactatatgatttgtgatttattatgtttattatttattttttgtcttgttgtccccaccagattgaaagctctaaaaggtggcaatcattgtttgttgtgctctctgatatatctcagttgtctagaacagcatggctaatacatagtggaatttcaataaatatttgtaaaagtaatgaagaaggcggtagtctatcctaaaaagttaaacaagactcattcaaaagatgatcacaaatttactcaaatgtggttcattcccaaagccaaaatgataaattaagatgtcaacaaatatctatggaacacaagctaaattacagacttgtaattattaatagcaaactggagagtaattattagaaaaaaatgaaatttgaaattactttcaaatattacaccattataagcctctgggtagtgattttagattaatataaaatttgatgaaaccaatcataatgaaaaagatacctaattattgtcactcaaaaataataatttaaacaaaatttaagggcatataaccacaatgttcaatacttggatttgttacagtaccttttttaagtgattacagggttaacataatttgagttgtgcatatttatttacattaatttcacttcacttaatggaatctgctggagattgacttgtgtttgtactaaaaatacataaaatatattaagaaaaagcagagagagagccactgatttattgtgtttggtgtccaagaacagctcaaactgctttctgtgaaagagttatgccttactgtttccttaaaaatgttttgtctgccgggcatggtggctcatgcttgtaaatcccagcactttgggaggctgaggtgggcagatcacaaggtcagcagatagagacaatcctgtctaacacggtgaaaccccgactctactaaaaatacaaaaaattagcccgccatggtggcgggtgcctgtagtcccagctatttgggaggatgaggcaggagaatgccgtgaacccgggaggcggagcttgcagtgagccgaggtcacgccactgcactccaccctgggtgaaagtgcgagactcggtctcgaaaaaaaaaaaaaaagaaaaaaaaagttttatcttgaaaactatatgtcagttcttagttgagttagtaatatgaggaatggctacaagtttttaaggaaaaaatacattttaagaatgttcactgaaaacccttttaaaacaacaggttctgaattttaaaaatattcagatagatttctttttgaacatataactggaatctttattacaaaagaatcatcaatgtttgacttctaattcatatgccaacatgcatttctaagcaaactataaccaagaaaaatgccaagcacactctgtaagcttagaatgcatgtgaatttcatattaattctttttgactcctcctgaacttgagcatcttacaggtctgattgggcaatttatcagttctcatgctcaatgaattcagtcgtagggcacatgcaacttaaagcaatgaggcctaactgccagggtgcttagaaccatcagtagggatgaatagcacagagtcagcatacaaatagaacatgaacatagagcaaaggcgaacatttagcctgactttggagcaaaaccagagttaagaccaagccctacctcagcacactgacgcttcagttttacatgtttgcttcgtagacagaactacttcacatttatttaccttccattatacaatctgcacattaaaaacaaaagaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaaccctatctaaaggaagcagtcactacttagctctaccaatagttgccatgctagattgtgagaccagggatgccaggtattttgtttctgcaagagaagccagaaatatggatttatcatgtcaactctcctaataaatactgaaatgtacttcattctttggtgctttatgcaagacaaaaaaaaaaaagaaaaaagagagggagagaaagaagaagcgaagaaaagacatggactctcatgtagattgaacttggtccacagtttactagcttgagatctgtaagaataaactaaggaggtaagagaaggaggagggcatattacttaggtgagaagtaattgtaaaatgtattataagcatttattagcacagtaaaatttatggacaaaatagaaacttcaaactacattaagccttctgtaatcgagctgtatcacctgcttctcattgatatcctttttcttactacttcctcccttattcagagaagtgttggctaattgttcacaattttactatgcactcactttccattctactctattaattaacactatcattcatttatttaatgaataaatatttttcaagttccatatgcgttgctttctagtatacgtggaaatgtggtatagccaaaaagtcacaatgatcacgtggatgctattcctaacgccttggcctctcaatatgttgacttccctgaattccaaaaggcatcatcattttgcttcagctcaacattcctaaggtcataatctggacattgctgttaccaggaagtgttccatgtctaaattcatgaattcagatttttaactcattgacccacccttccttccttccttccttcctgcttgcattcctctcttcttgccttcctttctttatccttctcttttccttctttccttccttccttccttctactctcccttgcctctcctgttctgaattctgtaagtattattgcactccatctattttttgctctcattaaattctttgaatcttgtaatttctcttatatcaacatcttctacctcccagtagtatggggtcctgttttattcaagctaatcttcatgctctttcatattagtgaatctcatgacaaaatctgtactctttggatcttgattttttatagacttgacatgtaaaattctacctttttgttaatccacttccctccactactggaggttgataccactgtgagtttaggttcatcaaatttgattagacctcaaaattctctagatttctagatcttttacatatcttttaaccatatctttttcttactcttcacagtggctattttaaacctttctcattctactcaagctccgactgcaactttttcttacttaacacatgaccatcagggcaactgttcttaaatttcttcacttacctcatctaccaacttaactaacaaggtatcatggttttaaaaagtgctatgttcaggataattccttcaactatgcttattatactatccgctaaactgtccttatttttcattcattcattttataaatcatatattaatcacctagtttgtgacaggtactgttctgggctctttggccacaccaatgagtaacacatattaggatcctgttctcagaaagacgttccactgaaaggaggtaatcagctgttagaaaaatattagtttcagctagtaataagaactgaaaaaatactaagacaaggtgatagatatatcagatagtgagtacctgggtgtgaagacacttccctgaggaagagacatttggtcagagaatgacaagaaggagccagccatgagaagacgtagaggagaagcatgtgaattcacaggaaagaataagcacatgcatcctaacttgggaaaggacttggtgtgtttcatcaatgcacatgcagttgaacaatcatgggtaatagtgggagatgagattagaaggtcaatcaggagcttaatgtaggttatgcaggaagccttttgtggttgttaagcatgggattgatgtcatccaatttagatttttaacaaaaacccataccatgctgaatgttgatggagttacgtaagggtagaagaagagatattatttagtaggtaattcaagtaatgtaggtgagagataatggtggcttgattttagggtgatactagggaaagagaatggttgacagattaagagtatatctagagggtaaagccaaaagatttgctgatctatggatatggaagttaagagaaagaaaggaacaagaataactcctagtgttttttgtttgtttgtttgtttctttgcttgactaattttgttatgtcattcattaaattgagaatgaaagaacaatatttttgagatcaaaataaagttgcaatcctgagttaagttttatgcatgctaaatttagatgctttattaggcatgcaagttaagatgtctaattgacaattggatatgtgagtttggagttcagaagagaggtcagcactggccatcaatattcagtacccgatgtcttgtgggtggtaaagccatgggactaagtgagataatctagggagaaatcagaaagagaaaaaaattcagggcacatccctggctcactctaatacttaaataataattagagaaagaggaaccaacaaaagagactgagaaatacctagcaagataggtgaaaagacaaggaagagtgatacatgctatagaagctaagaaaagaaagtacttaaagaggatgcaaatgtacatacttgccagagctaaaaaagaaaaagatgcaaatgaccaactgtttagctgagaaactagtaatgttaaaactgtgaaatagctgttgaagttggtctggaggggtgtcatttgttataagaactatttcaactgaattggagtcatttgaggagagaatgggaggtaaacaacaggagacagagacaacagacaactcttcttgtaagttttatcatgaaaggagaccaagaagagaaatagtagctggaagagaatgtgggctaaagcagggttttataaagtgggaagattctagaatatgtatgctgctaggattgattcaatagaaacaaattgatgatgtaggaggaagaggatacttgcaggaaccaagttcattagaaagtgagtcgcagatggagctagagcacaaattgagggatagaactttgacgtgagcagggacacttcatttattgtaaaagaaagaaaggggatgggtagaagtttaggtaggtaggtaaattttgtgatgaaaacaaggaagccctagattgaatctatttaacaaggtcatcatttgaaagggaagagtgggtggaaaagaggtagggctggaggccactacacaaagggagaaggtatgaatactcattttacatagtgtcagagtaaatatgcagtgcagtggagttgcagagtattagagaatgccattttgtcactcatggtcatgtatttagagtgagacaaaatagaattgctgtgcatcttgaagcctgcacaatgtgataggctgaataatggtccccaaagatattcagattccaatctctggaatctatgaatgttaccttatatgacaaaagagactttgcagatgtgaaaaaattgaagattttgagtacatgagattaccctatatttatcagatctgttctaaatgtagtcacaactgtccttataagaggaacaccatgattttagcccagtctgactcattttgtacttttgacctacataactgtaagataataaatttctgttgctttatgccactaagtttgtggtactgtgttgcagcagcaataggaaattaatacagtccactacttcattcctttcctttgtatctttatcctctctcttctttcaggccatttcctgttagcaggtaaacatgcttaagagtttccttttaaaaaacaacattaataaacaaaaaaccacagaatttcctacctctacctgctcagctctagctaccatccctttttatatagtccttttaacaactaaggcttgttatttttattatttccttctcatctctcatctactcaaatcttctgccaactctcgtcaacttcttttttccttagtaaactgctttcaatatttggcaaggtgctcttattcttaattccagtatattatttttacttctacccttttcaacctctttgttaatcagttgatttccccattctggtgatattctctccccttgggttctatgataccacatttttaaaaaattacatatttgctctctgaccgttcttctttattctcctttatgggctacatttttctcatggctttttcttggtgcaattttttaaatttattattattatgatgattattattattttgagacagggtctccctctattgcccaggctggagtgtagtggcacaatcatggttcactgcaaccctaacctcccgggctcaagtaatcctcacacctcagcctcctgagtagctgggactataggtgcatgctaccacacttggctaattttgttattttttgtacagatgaggtctcaccatgttgcccaggatggtatcaaactcctgggttcaagcaatccgccttcctcagcctcccaaaactctgagatcataggcgtgagccattgtgccttgctttattagtgttgttaacagggctctacttttttctcattctacatattcttttacagttatcttagctatttcccaaaactttctatttgacactcttagtactcacctggacaaatatactctgttctgtacaccttattgtcatgctaaggtgtcctgagttggaaagacaggctctcttgtcctgctccatggcacactcatgtccgactgcagtgattaactgtattggatttggtgtcactgaactgattttgaattctgaccttgcttttttcctacctgaaatagcaagtgatttaccacctgaatgtgtaaaacagtataaacccactaaactgtattaattaaatgagataatgcacatcaagtacaacgcatagtacctggcatatagggggttaataaatgtgggcaaatattagtatcgctagcttcttcttttcctctctaagttctgtttctgctggtaattctaccatggaacttctcttttccattgctgttgttgtagtagtttctaatgtctcctacaacgtttgatgttcacagcccaccattgccacccccactcctctttttatttttctgcttcacctttcctattactcttgtattatttttatttttcccccattttccccattattcccacattctttattttttctgttttccttacgttgttctccttctcctccaccttttattttttctgaatttgcacatctcaacaaatagtccagaccactctttgcagacttcttcattgccaggatctgcttcttagttttcatagttactgtttactttttcattatgatttatagtaaagatgggaagaaaatgactagtggcaggcctgcaggcctttcttaactaaagacagccctagaaaagaaatttaaagaaaatttctcaaaacatgttagtgacagaccacctggcaaatactaataatatgggctaatgggagagtccttatctatggactgctgcagcaggatgtctagtatgcttatggaaaacaaatctagaacctacggatttatgtgtcatggcccctggaaatgtatataccctatgtaactatcctaatataaaatttaaatgtttcataccaaaatagcttccttttgtgtaagttatgtgactatgcacattccatagcagctttgtttgttaaatctgggccactgtgtcctgatgtgataagaaaggcctgggaatttgtcattgtctttctggatctttccctgctttgtctgtgctgtttgattacatttgtccttgaagtcatcagtaaagcttgatactaagtaaggtttataatttgtgtgagtctgataggacagcttgaatccttccttgtgttttctcattggatatggtggcattccagatgattacagttgttaggaaatttctctctggatatctgaagcaatagtaggctatgattccaacatatctatctgtcatgattacagttctctttgtggtaatatattatcatatgtaattcagtaaagaaatgtgtatacatgcatgtaatacatcaatgtctatatctctgggtccatacaatgccataagagcaaatgtcaatctaagcattgatttgatgttatagagcctctagaatttttgactgctaaaaaaaaaaaacaaataatttgttaatttggtttctatttaagaaaccatttccatagaaatagatgcagttcttttactgaattacatatgaatcaaattcacaaataaagttagctcactttaaaatcatctaatctccttttaaaatgtatgacataaattatttaggtgttatttataagaggtggaaatataacacatcatatttatatcctttttttgctgtaatgatgaatattacaatttcttgagtgtgctattttccagacaaatgtgtattccattgtattgtcattagaaccataacattttctagaatgttacttacatcttaatgaagggataatcatgctatgaagcttttatattttcaacattacatttatttctcagtaattctctcactttgcagaaatgattttcattcttttacatttttaatgtgtgatgtacctaatggaaaataaagataatgctaaatgaaaatgagtgttattcattgataagaattcaattaatctatacaaaggtccctttcattacctcttttacagatttttaaaaattctctatttcttttataaggtttccttagatattctctatcattgtttttctttgtgcatttaaaaaagatgatctaggccaggcgtggtggctcacacatataatcccagcactttgggaggctgaggttggcagataacttgaggttcaggagttcaagatcagcctggtggccaggcacggtggctcatgcctgtaatcccagcactttgggaggctgaggcaggcggatcactaggtcaggagttccagaccagcctggccaacatggtgaaaccccatctctactaaaaatacaaaaattagctaggcatggtggcacctgcctgtactcccagctactcaggaggctgaggcaggagaatcgcttgaacccaagaggcagaggctgcagtgagccaggattgtgctacagcactccaacctaggcgacagagagagattccatctaaaaaaataaataaataaataaataaataagatgatcttataggaaggggatactacagtctgtaaggacgtaggagtctcaaaaatcatttgagttcaaaagaaatagcatttaataacaattacaatgtaataacaatgataacgagaggtgccaacgtgctagcagccctcactcactcttggcgcctcctcggtctcggtgtccactctggccacgcttgaggagtccttcagcccgctgctgcactgtgggagcccctctctgggctggccaaggccagagccagctccctctgcttgtggggaggtgtggagggcgctgctctgtggcgcctggtcccatcgaccttccaagggctgaggagtgcaggtgcgtggcgcgggactggtaggcagctccacccgcagccctggcgcaggatccactaggcgaagctagctgggctcctgagtcgggtagggacttggagaacttttatgtctagccggaggattgtatatgcaccaatcagcactctatgtctagctcagggattgtaaacgcaccaatcagcactctgtgtctagctcaaggtttgtaaacgtgacaatcagcactctgtgtctagctcagggattgtaaacacaccaagcagcactctgtgtctagctcaaggtttgtaaatgcaccaatcagtgctctgtgtctagctaatctagtggggacttggagaacttttgtgtctagctaaaggattataaatgcaccaatcagcactttgtgtctagctgaaggtttgtaaactcactaatcaatgctctgtgtctagctaatctagtggggacttggagaacttttatgtctagctagaggattgtaaatgcaccaatcagcgctctgtgtctagcttagggatcgtaaacactccaatcagctctctgtaaaacggaccaatcagctgtctgtaaagtggaccaatcagctctcagtaaaatggaccaatcagctctctgtaaaatggaccaatcagcaggatgtgggtggggccagataagggaataaaagcaggctgcccgagccagctgcggcaacccgcttgggtctcttttcatgctgtggaaggtttgttctttcactttttgcaataaatcttgctgctgctgtttgggtccatgcagcatttatgagctgtaacactcaccgcgaaggtctgcaccttcacttctgaggccagtgagaccacgaactcaccaaaaggaacaaacaactccagccacaccatctttaagaactgtaacgccgcgagggtccacagcttcattcttgaagttggcgagaccaagaacccaccagttccggacacaataatatttcatctttgtatagtctttttaatttttcaaaattatttcatcatatgatacttccaatatacaactatccgtaatctatgacacatagaagctgagacctcaaaatgttccagtacagtgaattacaagggagtgtaatttgacacattaaaatctcaaaatgtattttattttgactgttctttgaaaaggcctatttctagagttgatatatatcaagaagatttaagattggcatggaaaacaacaagctgctaatgggaagggaagcctaacaatagtactagcactcagacccaaggaggtgggcttctctttgggttttgccgtgactgtgttagtgttcatccacgcgctctacccttctatgtgggaggattatacctgcccacaatgtgaaactcaggtgtgctcatgtgatatggtccatgaaatgtccatagaagtggagggtgtcacttcctggaagacgttttaatggtcagtacacactttgccattctctttttccctctcctgtgataatagacatagtgggttccaaaagatgacatgacagagctgcagccaaccaataacggacatggaggaagagtgagatctaaacctgagtgttataggtctctgatatttgggaatcatttgttagtgaagcacaacctagactgtcttgactgatacaggtttgctcaaagattattaggaacttggctgtcctgttctccagcattgtcctttcctttttcatgttctcacctaaatgtggtcacaaaatactcttgttgattctccagcgcagagagagcaccaacgttttaaagactttactaaaattatgtctcagaaaactgtgaaacaaacccagggcctagtataattcactgtatttttgcagattcctcaattccatatggaaccccaagataaaaacatcttgatggaagtctagtctttcatgctcctggctaggaatcaaacggctcttaccatatgtggcagacaccacagagatgcaccaatcagctcccctttcaagaaaagactcattgtccatctgtgagggccatctgtgaacttcgcaagtccatctcagcttgagcggaggtcatgctctcctcagagtaacctcagtcagtgactaagcaagaatgtggtgcaagcacctagccatttcttttcaacaggggacttctgtaaaaggtgatctttgctctgaggctgtctgctgggctggcagatacgttgtcagatctgcattgcagtctggcagatcctcctacccaatcctgcattccccttgtttcttcacagatattaccttccaagatattttgtactcctaaattcagctcagcgtctgtttctgtgagtgggaaaagaaacttacataagatctacctacttattgagagtgttctcctagatataaagtcaaagatgagagtgccccatccccttgttcttctggctgttctcagtacctgttccctgtctgtgtttattcactgggcagccttatcatcagaaagacaatcatgcactataatagaacaatatcttataacagccatataacaatataacatacatccttaattctgtcaggattttgaaatgaaatgttctccttgataattttctcaagtgtaaagtgggaataataaaagtaattttctcacagagttgtgagaataattaatagccaaagtttattaagtgttcactttatgtcaggctttacaggcactacagtatttcattttattcaataggtgaggctattggggcaaagaaaggataagtaacatatagctaatgataggctgagtgggaactggggtctacacagagtgacatcacagcccacttacacaattactctctgctactctgtctctcaaagagatctgtcaagaccttagcaacgtgcctgcatggattaagcttaccatttgttggagtaggcaccccacaaatgttaaccactatgattacttattcattttcaaagttgaacaaataaaaaaaaaaccctgaataattcaaatacaaagaaataaaggtccttttaagctacctgttctccagcgttgtcccttcctttttcatgttctcacctaaatgtggtcataaaataagccaagtcaatgagtttggactttatcttttgggcattgaagagttattggagagtattaagaatggactgacatttagattcacagattaaaaaggtgactctatttgtagtgcagtcaatgaaaggaactgatgcataaagtggggtaagggaatggtagaatttgtccagacgaaaagcgaagtctgcctgaactacggtagtggcaacaggaattagaaaaaaaaaattaaataggctaggcgcatgggcttgcgcctgtaatcccagcactttgggaggcggaggcaggcggatcatgaggtcaggagatcgagaccatcctggctaacatggtgaaaccctgtccctactaaaaaaaaacaaaaaacaaaaattaggggggtgcctatagtcgcagctactagggaggctgaggcaggagaatcgtgtgaacctgggaggcggagcttgcagtgagccgtgatcgtgccactgcgctccagcctgggcaacagagcaagactctgtctcaaaaataagaaagaaagagagagagagggagggaggaagggagggagggaggaaggaaggaaggaaggaatcaagtagactagttaattgatttaaagtgtcacactggtttggacacttcatctggatgggcttcagttgatttatttgtgaaaatcttttggatgagatggttgctaaagtggtttttttgtttgttttgttttttccaattggcatctcttaagagggagctggaggtagaaagggtgggggaaagaaggaaacagagtaggtagaattgtaggaataaatatagtgaaaaacttttggaatgactttggtttggaaacttggtgcatttataacattattaagaaaatttttttaggcaaaaatctaaataaaatgcctttaacatccagctttatgttcccctaattttccaatttacttctaaactcccttaaagcaatacatttatctagtcttttgaaagagaatttataacatcttggagctctcaaataaaaagaggagagccaatcatggtggagggtttgttgttgttgttgttgttgttgttgttaagtataagaagcattaagcaagctcccaatgaaaccaagttttctttttaaaaatcctacaatttatgcaaatcccatatgggatttatgcaaattccatacgctttggtagtcagggcaaatagatatttgccataaagagaagtgagttgagtctatcttgcaaacaatatagataattgcagagaaagtaaggaaacaagctgcactttactattttatgctttggcaaattgtgttgcattgttatatacctggcaaaagaaagtgtatcattttggaaattgctgctgagtgtggttattgtgcacaaccacagcagagattttgaagtcatcatggagccgaggtggcagggtcactacgtgttctcactaccagggctatctgttagagtctgctgaatagctggcatcaatttcaggaggcaggaggcagaaaagtgctggactctatcctcatttggcaaagctttgaaggataatggttgagtgaataaaacttctactagcttactttcatttctagaacttcatgttatttctgtgaatattgaattaaacgagaaggctaagaaataattgaattcaaacatatttatcattctaaattttttttggaaagaatttatattttaaagtaatatcagtaaatgtaaatggagcaatgaagattaatgcaattctaaatatttaccctagtgggacaccatcacttcttgcctcaaatactgaaattgtctccttagctcccatttttgcattctgaagtttttctacacaatgtagtcagatttttctgaaatcaaaattggatcacggcactccctatttaaaaacctttggtagattaattaattaactaatgctacatcataactcactaaaacttagtttttcggaatgaaaactttttgttttttttcctcacagtttctgtgggtccacaactccagagtggcttagcttgggggttatggcttgaagtttcatgagattatactcactgtctgtagctacagatatatttgaaggcttgactgaagctagagaatctgcttctagtcattaacatggcggtcaagttgctgatgacaagttgtttttttctccacagggttgcttgagtgtcctcacaacaaggtggctagcttaccccagagtaagtgatatttaaaaagcaaggcagaattcttcactgatttttgtgactaacctcagaacttatttcatcacttctgtcatattctattggtcacataggccagtactgtttcactgtgggaggtgactatacaaggatgtgaaaaacgggaagcaaagattattaggcaccatcttgaaggcttaatatcacagttggttttcatttactttgggataaagttcaaatttttagacactgcttacaaaacctgtcatgatatgacaatttcttacctcttcaacttcatcctgcccctcatgaatcatgttcaagccattaaaaacgtatttcttcagttcttctaatgcactacactgttttcactctcttgttggatcttttttcccatcctttaaattgactcactgttactcactcttcatgtcaagttattagaaattctctttctcaaaagtttccatttgacttccaaatcatggattagtcacttggttttgtgaacccctaacatcttgtctgtcttaattatagcatttattgcacttacttttttataattattattttttcattgtgtaccctagtagattgatatgaaagtaggtgctctgcatatatgtgtgtgtatatgtatatatgtcattctgcctcattgcctatcatgtgcctaaaatgtaggaatatttattgaatgaatgattcaataaatgaatgagagactatcttgactctcactcagtaagtgatatttaccctaattttctaaggtgatggaaaaaaatctaataaactcacctataattacttttttgttagcttatatctctttataaacccaaacagaaaagaacaatctgatatactgatactggggtttggttccatgtgtgataatactggtaatttgttgaatctggagatatagatcctatatttatcttctaatgaacaatgatagagtaatgaaaatgtttttatctttctaggttacaaatcaatactatgacatatgagagtcagtgaaagtcaataaagattttctaccaaactatttttttctctcaaaactgtgaaattacaatactatggttaaaatagactgatccaaaatttttatatcattacatttagtaatgcctacatattattttccatagaccagttttaaagatgaacaaaatattacatagcaaaatatagtgttacttattaactgtacaaaacaaagatcagttgaaaagatttcaatgaattttaaatgctcccattaggtatgtcattttccccttctaacatgccacctaaaataaccagatcactattgacaataaaatatcctatactgcataccatttatagaaatagtagcacttaagaagagtatgtcagtggtaaaatttcagtcaaagatttcaatattttaaaagtattggggtggccgggcatggtggctcatgcctgtaatcccagcacgttaggaagtcgaggcgggtagatcacctgaggtcaggagttcaagaccagcctgggctgggtgtggtggctcacgcctgtaatcccagcacttttggaagccaaggtgggtggatcacaaggtcaggagttcaagatcagcctggcaaacatggtgaaacccctactaaaaatagtatttgaaatctctactaaaaatacaaaaaaattaggcaggtgttatggcacacaccgcaggagaatcacttgaacccaggaggcagaggctgcagtgagccgagaccatgccattgcactccagtctgggtgacaaagtgagactccatccaaaaaggggggaaaaaagtactggggtatctatttctcccaaaatgttaaatggcaagtgagtggagggaaacagaaggggatagttcatgtcccatcttactggtttacaactgggaaagcagagtaagatcttcatgtgggttgatgtgatatctgtatatatcagcagacataacagaatcttcttgttggcctatcctgtttagactaacattatggtattagttcctttggggctcacatttattctctgactgccctctagcaaaacttatggggcagacactttggtaaaaggtcccaaactataatgattaccttatattttgtcagtgcaccattggcattgaacaaaatttagtacattatttaataaccatggtagttcatggcaatccatggccctcttgcatattggcaaagttgaaacatcaagtaatctacattttaaaaaatgtctttgatcctttctcgtttgaaatatggatgtaacaggtgcaatggaaaaggaaggtgtgagagtcctttctataatgtttacataacgtctgtctataggagggacaagacattcccttcgagatttgggggtatttggacatagtcttgcaaattcacaaatatcttatgaaagaaaaaagaattaggaaacacttatggaatatttcaagctataattcagttaatcaaagttttaaattatgtttcatgtacctatgattaaaagagctttaattgattaaacaggggttcattttacttttgttaacttgacacatactacaaaaaattcaagatactaggagggaaaaaataaacactatcaaaagctatgttgtggaccttactctgtttttttcaagtatacaggtagaattttactaaccaataaagaaaagttataaaaaaacatggagaatatagttctttttatatacctgatgccccatcctccagtccctcttaaagagatagagtggtgacacacacttccttcaaaggctgacaaagaatatttgatttcataatgtttaaggtcatttctcagaatacacaggtttgaccattgcctaaatgctaatcattaattcaaaggctatattttattttttaaagaaagtttattatagtttgtgtattttgctattgaaatcaatgtgtaagtgcaagttactgtacacaaatttagaagttataggaggtcaggcacagtggctcacgcctgtaatcccagcactttagaaggccgaggtgggcggatcacgaggcaggcagataaggatggagatggagactctcctggctaacatggtgaaacctcgtctctactaaaaaataatacaaaaaattagctgggggtggtggcacatgcctgtagtctcagctactcgggaggctgaggcaggagaatcacttgaacccaggaggcagaggttgcagtgagccgagatcgcaccactgcgctccagcctgggtgacaaagcaaaaatctgtctttaaaaaaaaaaaaaagaagttataggaaatgacataaatcttcagaaaaatgataaaattacatgtaattcataaacaattacgtcatgctttttaaagttcattttattataactaagcgtaaggtatcttaagtctctggaacaagggtataagcatgtatctatgtattaaatagtaatgaaacatttcacaaacatatagttcaatgttcatattcaaaaacatatattaggatgggaatcacattgtatggctgtgttgtagtggtgtgttagtgtggcgactctgaaaaattactcttacaattaggcgtacataaatatgacataattctctcaacacactttagtaacatggcttttcccccaatgtgcaaggtaaaatagttttcctctgaggtactactttcgtggcaaaactttagtgaccaagaccttttaaatgaaagaaatccataccattgttgttaggagtccatattaagggcctatactggtatcgaagtaacttaagatgttgaccgtgtggtcaattttcttttctcccatcctgatataatgtaatgtggccatttaatgagttctaactcatttactaatgagcatattgtttcctcatcacatgctaggcaaacagaaagtaaacagcatctttttagcaaaaaccttttctggaattttttttttaattgtaataatataggaataaacaacgaaaacctatagcaattaccataaaagttttagtgcatttgtaatatgctaagtatttgatatattccttgtaaaagactatttaagtaaatctttagctgccggtgtttgcttgctgtacagaatcataaactatcaatattcctaaattagcatggtccagtcatccaacttattgcctcagtcactcaattttcaagtttatgtactttcctctcagttatcagatggtgacttttggataaattgttatggcaaaaattttttttaatatcatggtgaatacatgttgatgtgatctgaatatataaaatatcaatatctaaagatcatttagaaaatgtttatttttactacaaaagttatgcatgtttacataagacgttaaaagtaaagtaaaaactcatttcctgtgaccctgacaaaacatcattagcattttattaaaatttatcctagttattttctgtgtttatatatatttttgcctataataatttttatttattttttacaattttctttcctttttttttttttaaagacagagtcttgctctgttgctcaggctggagtacaatggtgcaatcttggctcactgcaattccacctcaggttcaagcaattcacctcccttagcctcctgagtagctgagattacaggtgtgcaccaccacacccagctaatttttgtatttttactagagatgggatttcaccatgttggccagggtggtctcgaactcctgacctcaggtgatctgcctgccttggcctcccaaagtgctgggattataggtgtgagccaccacgcccgacccgttcttacaattttctatttttatttatctctgtagacatctaacactatgtattctaacatcaagcttagtacacagtagacatttaataaatgtgattagttaagtatgttaaatatcagatgctagaatatttatacatatatataatgtatatttttaagggtttacacaattccaggaggcaccattctcattatctacacaaatggcattctcaggagggcacatttatttacatagactgcaatataaatggcctaggaaaatggtgtcttctagatgtacaatgatatggccatggatgtatatttgtgtgtatgtatacatgtatatgtatatacatacatataagtatacgtgtaatagccgcaggtatttcagtccatctataaaaccaaggcaaatgtcctcaaaattaaatgcattttcactcatttattatttattcaacaaatatttatgttcactgaaactgagctgagggctagggaaataatatatcagcaagatagacattgttctatatcctttgaaaatatcataggtgacagtgtacaagagtgttaaaaagagacttctacccatataagatacttaatagctctaacactgcagacagtagtcaggaaataccactgcacttcaaattagagtgccgcaccatctaagccagacttgtaaaagatgacaagagaaattattctggcagtatcacaccctctacacgtagtaagacaaggctgaaaattcatttgaatctggtatttgaaagatataatttcattgaaagaagtcagcatcctgtggcatttgcccttctttctctctagggaagaagaaagcttcttctttccttccatatcaagtgaagctgtctcaaaaaagaccatactgagaacttacttgagtcctcagaaattggaaaagtatcaaagctagattatggtttactaaaataaaataaaaataagcatcttttatttttgtttgtcttttaaaaggtaagaagatagacagcttccctgcttacctggtggcagggcgaggagatactgtctgtattagtctgttctcatactgctacgaagaaatacctgaggctgggtaatttataaagaaaagaggtttaatggactcacagttccacgtggttggggaggcatcaggaggcctgcaatcatggcagaaggcatctcttcacagggcggcaggagagagaatgagtgccgagcgcagtgggggaaagcccctcataaaaccatcaggtctggtgagaattcactcactaccatgagaacagcatgggggaaccgcccccatgatctaatcacctcctctgaggtccctcccccaacacgtagggattataattcagattacaattcaagatgggatttgggtgaggacacagccaaaccataccactgcctttgtcatgaaggacacttcttgtgaggcaggggatgggccatatttcttgtaaatcggatatggttgccacacaagagagagaactgggagaagtcttgaataggactttgtccaagatgtcctgctgaagggatgtagtaaccacagcaaaaggaggctggaaacagtactaaggggcattataagtgtcctgcatttggaggaatcacttcttaggaataacaaatgaggtctctaggggaggattctctgaagaagtcacaagtaccctacaaaagaaaaaacaaacagattttggacatcagccactttagggcgtcaatgacataaggcaactgtgccagtcatttcagctttcctctacttctcaccacttctccatcccacacagaggactcaagagacaatgtagagtaaaaattcaaggcagggaaagaaagaagctgtaatgacttcctgttttatctatttcaagacaaactggaagatagaaggtgagagtgattagctctcagggtttttatatcagactggactgggatttttaagaccatgaggtagcttgaaaagcaatgaactttaattgaaattttatctatcacaggaaagaagctgttgaaaggggaaattgaacaaagtataaaatcatgttcttcttacattttatccagtttgctttattctagtaaccattcacaaagaacaatgataacaaactatcaaaagttctataacatgagaaaaaaaggatgttatgggaacacaggaagagctttgcttccagcgacccaagctactctcctagcaaatcttccactgatgacagtaaagagagagtgatcttggatccctggtaaatcctgcctcagatactgaatgtagaggtgagctctctccaagaggtggatggaaagccagaaatccaggagctaagtaggtacaaacaactcgaggacaatatattgcctgtgtctcaggatgtgcagtggaatatttttagtgtactcaactttcttttgtggtgtctgccaaaaactctcataagcatcccataagggaaagaaagctttaaacacctgtcacattcagaaattgctgagccatcttacaataattccagtcaagaaagaacttaggtgttcttctcacccttttttttcttcctcctctttggccctagaggggagacagaaataacagctaacaggtggcagggaaggggaataaaagagatttttacagttgaacaaaattggaaactcaaattattcatatggtttagggcttttataattactaaattactaaactatatctttgactttaaagtcagccaaatttttccatttcctaataataagaaaaataatgaacaagcatggcccctactatgtgccaaacatgattgtaagaactattacctcctaatcctcataataatgctaaaatgcagaaattcataacactctgcatttcatagggaaaactgaggcacacagttaaatgacttgcccaattttattgggatttaaacccaacgaatctggtaacagagtacatgatcctaatcactactttataagttaaaagagaagataaatgatgtagttttcattaagtgccagacatcgggaacccaacccccactaagtaggtttgaatggagagagggagacaataacaaagttgcttctacggctataattctttgttcaatgtactgattgcttactttgtacttcagctggccgttagaagctactgaagagttttaaaatgatttgttcctatgatgggatttgcttttcagtgtgatcactgtgacttctttgtagagactggtttggaggagtataagagtggaagaaaataggtagatcagaaagactattatgagcggactgctgcctgaacaaagtaatgaaagtgggatggatggaaaagattcaagttaggtagatctatctgtctatctatctatctatctatctatctatctatctatctatctatccattcatccatctaagacagagtaaattggacctaatgattggatatggaggtgagaaaacattaagttataaatttccatgtgtgtatgtgaaactgctaaagtacatcataaaatatcataaagttagagtaaggatcaaattagataattcgtgacaagcgcttaccaccatgaactgtaagtggctaaggaagtttgctgaagtgaaaatagcttgggttctagcaccgtgtgtatatcctggggaaggtgttgtactctctgttcctctggcatcttatctgtgaaatatcagtaccttcctcatggtatacattgagtgaattacgtgaaatgattcttgtgaagagattagcacaattgctgacacactatagatctcaattaatgctagccatcttttactagactgttttcttttcatctacctgacattagttgtatggctttttgaggttaatttctgcatgtcacaaagcacactgttttcctcagaagaagctgatatttcataaagctagtttattgctcttatgcaaatggggcagtactttaagactgttaactactgaaaaaactagtattttgtcatgatgcaagtgaggagggtactgggacaccactccttccccatgggtcagataattagttaagtgggaaaaagttacaaaccacacagtgcactattgtatctagtaggaagtgataaaactattatcaaggattaatattgccctcatctatttgtttaaggcctataacaaagatttcatgggaattttctacatttttattttctaatttttacatatgacctctaatttggttctgaaatgaaatcaacttttagttctttttttatctcaagtgtattacatttttggagatgttatttataatactttgatttttcaaattaataaattgaagatgcaatacagtattcaatttgctgcaaaactctactcttcatacgaaaatagagatagagctatgacctaaagattaatacacagctccatcacagcatagcttgaaatgttaaacagctgatgtacaaaatgatgtgagagtatcagtgaataatacacagaagtgcatactgtaaacaaagcaaacatttctaaattgagagctgtctaattctagaggcaaactcagaatttggatttaagaagataattataggggagaaagaaagtaacaactatgttttcttaaaccaagatagagagtaagaaacatccttaaccaggaagctattgtcttaaactgctgttgttttggcatcattcataatcacttaccaactatttttttgagggtaaatcaggttatcttctgtttataattcttctgagggcaacttaacttcttttctttaacctatcatttctaactaccttcaagtttagccgtatacaacttaaatcacattttgctacactttttagatcttgagattgttttttggctactctgtcatcagtgtaatttttaaaattctatttgctatcggtaggacctggagtttacacatagccagaattaaaatgtattgacaagtgaaaataagttctttgatctcagtggggaaaagggatgcagctctgcactcctgaattctaccactttcatattctgagcctttgaagtttttctttgctttcctgcacatcctttggttcatagtttgtgcttattttttttcctgataaaattgtttgacaggcttagagctgtaaagataggagtgttgtttaataaataaaaataaaaagataattaattgtttctgtaaggtcgaatgcataatccatagagagcttctttctgctgtactcgctccctacgtaactcaactgtgaaaagcagaaacttttcatttttttttttttttttgagacggaatctcgtctgtcgcccaggctggagcgcagtggtgcctgccatctcagctcactgcaagctccgcctcccaggtacatgccattctccggcctcaggctcctgagtagctaggactacaggcgcccgccaccaagcctggctaatttttgttgcatttttagtagagacagggtttcaccatgttagccaggatggtctcgatctcctgacctcgtgatccgcccgcctcagcttcccaaagtgctgggattacaggtgtgagccactgcgcccggcaaaagtaggaccttttctatctccagtgtgaatttaaccacctggcaatatttgaaaggtagagattctgactcagaacgtccggagacttaaactctttttttttttaaacaagtttccagatggtcttcaggggaccacattttgagcagtaaagataaacaggaagaaaggaaagcagaagtattctaaatacattacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaaaaaagaaaaccaccaaatagtgggcaaaggatatgaacagacacttctcaaaagcagacatttatgtggccaataaacaaatgaaaaaagctcataatcactggtcactagagaaatgcaaaccaaaaccacaatgagatactgagaggtgacagcatgctggcagtcctcagagccctcgcttgctctcggcaccccccctgcctgggctcccactttggtggcatttgaggagcccttcagtccccccactgcactgtgggagcccctttctgggctggccaaggctggagcccactccctcagctttcagggaggtgtggagggagaggcaccagcgggaaccggggctgcctgcggtgcttgcaggccagctggagttccgggtgggcgtgggcttggtgggccccgcactggaagcagccagtcagccctgctggcccggggcaatgggggacttagcacccgggccagtggctgcggagggtgtactgagtcccccagcagtgctggcccacctgcgctgtgctcgatttctcgtggggccttagctgccttcccgcggggcagggctcgggacctgcagcccgccatgcctgagcctcccacccactccatgggctcctgtgcagcccaagcctccccgacgagcaccaccccctactccacggcgcccagtcccatcgaccacccaagggctgaggaatgcgagcacacggcgcaggactggcaggcagctccacctgcagccctggtgcgggatccactaggtgaagccagctgggctcctgagtctggtggggacgtggagtctttatatctagttcagggattgtaaatacaccaatcagcaccctgtgtttagctcaaggtttgtgagtgcaccaggcgacactcggtatctagctgctctggtgaggacgtggagaacctttatgtctagctcagggattgtaaatacaccaatcggcactctgtatctagctcaaggtttgtaaatacaccaatcagcaccctgtgtttagctcaaggtttgtgagtgcaccaatcgacactctgtatctagctgctctggtggggccttggagaacctttatgtctagctcaaggattgtaaatacaccaataggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaatctctgtatctaactaatctgatgcagaggcggagaacctttgtatctagctcagggattgtaaacacaccaatcagcaccctgacaaaacaggccacttggctctaccaatcagcaggatgtgggtggggccagataagagaataaaagcaggctgcccgagccagcattggcaaccagctccggtcacccaccaattctggacacaataccatctcatgctagttagatcggcaatcattaaaaagtcaggaaacaacagatgctggagaggatgtggagaaataggaatgcttttacactgttggtgggagtataaattagttcaatgattgtggaagacagtgtggcaattcctcaaggatctagaaccagaaataccatttgacccagcaatcccattactgagtatatacccaaaggattataaatcattctactgcaaacacacatgcacacgtatgtttattgcaacactgttcacaatagtaaagacttggaaccaacccaaatacccatcagtgatagactggataaagaaaatgtggcacatattcactatggaatactatgcagccataaaaaaggatgagttcatgtcctttgcagggatatggatgaaactagaacaatcattctcagtaaactaacacaggaacagaaaaccaaacaccacatgttctcactcataagtgggatttgaacaatgagaattcatgggcacacggaggggaacatcacacaccagggcctttcgggggctggggatctaggggagcaataagattaggagaaatacctaatgtagatgaggggttgatgggtgcagcaaaccatcatggcacgtgtatacctatgtaataaacctgctggttctgcacatgtatcccagaacttaaagtataagaaaaaaaataggccaggcgcagtggctaacacctgtaatcccagcactttgggaggccgaggtgggcagatcatgaggtcaggagatcgagactatcctgcctaacatggtgaaaccccatctctactaaaaatacaaaaaaaaaaaaaaaaattagctgggcatggtggtgggcgcctggagttccagctactccgaaggctgaggcaggacaatggtgtgaacctgggaggcggagcttgcagtgagtggagatcgcgccactgcactccagcctgggcgacagagaaagactccatctaaaaacttaaataaataaagaaaaaaaatatttacctcacagtgatgttagaagggtttgggatatattcacatcatgtagccaagtgcctggccgaagtaagtcctttttttttttttttttttttgagatggagtctcgctctttccaccaggctggagtgcaatggcacgatctcggctcactgcaagctccgcctcccgggttcaagcgattctcctgcctcagtctcccagttagctgggactacagttgcctgccaccacgcccggctaatttttttgtattttttagtagagatggttttcactgtgatagccaggatggtctcaatttatatttcttgacctcgtgatccgcccacctcagcctcccaaagtgctgggattacaggtgtgagccaccgtgcccagccccaagtaagttcttaaaacattttctatcattattataattccaattttattttattattagtttttgagatggagtctctctctgtaacccaggctgagtgcagtggcttgatctcggctcactgcaacctgtgcttcctgggttcaagctgcctcttgcctcagcctcccgagtagctgggattaaaggcacctgccaacccgcccagctcatttttgtatttttagtagagatggggtttcaccatgttggcgaggctcgtctcgaactcctgacctcaagtgatctgcacacttcggcctcccaaagtgctgagattacaggcgtaagccaccgcgcctggcctataattccaattttagcagtatatcttgctaatcaaccaaaaggaacacttaagtgcttatattttatatttactgttagtcatttagaaatgatacaatttgaattatagatgtaattgacaaatttgtactttcattgacctgattggttaagatacttaatcatatgataccacttttcctctttaaacggtaataaccattcattgcaaattactaatatactgacttactcatagttttcactagtcagcactgaatcatactgcatgtgtattttgttctcagcatggaaaagtacatgtcaaatagtaaaccctagtatgccaatcatttagtaacttcaagattactaattaccataatgttgaagtgctaagattatcagggtataatgcattcattatgttaatgattctttatcttatccaagaatcacacattttccctgggagcaaaaagaatcaaaagaaccaactggaagcttttaataaaagtttatgcatttaagcgtgtgattaaccgacaatcatattacaagtgctttattttaaaggaaataataaaaagaaaaaactgtttataacgggtaagattttctttctaaacataattgacatttcactaactgaaattggaattaccaaagaagtgtaagacatgtcttgtgccctcaagggggaagaaatattacatacaaataatgaaactaattatagtctaaactcatagaaaaacaactacttataaagaattaaaaatgggagaaataaggttagataggagtagtcacagaagtgatgaaagagacgttaactcaaatttgaaagataagtacaggtggatagagtgtagaaatgaaaaacagctactcagaacaaagtatctctttttcttttttggaagaacatagtactaagcatcagaaaatttgaatttaaagttgaatttaaattgactgtacattccttgaaatgtgttctctcatttgtagaatgggagatttagaaaagaggtttccctaactactctatgcttctttaactgtaaaattttaggcctagctatatagggcaggaaatagaagggcacatgcagagcacaggtattagggcctggtagtaaacatggttgtgtgcagagcatgggtcaaactatacggccttcagaacctagtacttgagatggaatcagtacctgctgctaaggatggtaataagaaggaatttcacatgagatcaggattatgatgcggtttaggacaagcaatccagtggatataaaaagtaagatacaagacagatatgacaatattggaaaggctgtgtaacatgcagattgactctgaattgtcagtgaaagtggatgacatcaccatccaagcagttgaaatgggctctgtggggaaatgtcagagctgtacagaaaaaaaaataggtgcccagaattcataacaggaaactcagttgtttggggggcttaggatttgatttttatttctaagcctcttttataagggcatcaatttcacttatgggggttctggcctcatgatccaatcacttcccaaaggctccatctcttaataccaaaatgttggggattaagtttccacatgaattttgaggggacaccaacattcagaacatgaacagggacttccatttggagagattttgaagagtaacactcctggcctttcctccagcccggattttctcctctcctatggataaagagtgacttatctgattggaaattatagctcctttcttgctcttgttataattagataagcattctggtctactctttatcatccagtaagtagcctgcccctgtgtggatggcatgtggctggccagcttagcctctctgggatttagatactaatttagataatcatactaataataaagagctgactctctgctctttgttgttcagggtaaaatcttaggaaacccactgtgtttgcatatgaaagccaggttctataatccatgctacgccttctgtctgtctcatttgcttctgaagtctgagggaaagatgggtgttattttgcactgaattaccacaaaggatcaaattgttgaattgaatgtagaaggacagagagcttacccagtctcaaattttaccaatagcttcaaggatgcaagcactcaagaaacatggacaaaaaagagagtggttggggacatcttttatggcttgccaggtcttcctttgcttcaagagaaatgcattctaacccagaggaatagaatgtttgcagatcacctcagctaatagagatttttaggttatgaaacaagtttatttcacagccaaattgttatagggcttatataaccatttccagggagctgtgcttcaaaaattcacagactctcggtttgtatactatagaaaatgccaaaccagggatatcctgtctagatcattctatagataagaatggtcttccctgtaaatacctttagtttatttaccaggaagtgcctcatcagcatgtttataaagattacttaggtagcttgcttctttctttggcatgtctcttggtcatcagggtgagagagagaaagaaagataaaccacaggcacattgctttaacttcttcctccccagacccattaaatttccacagactggaatagggaagtgtaggagtgaaaacagacataggtctgcttctagcattaagccaagtaactatttttacttgacatgagtggaaatagtataaggaaaatattgtcttgggaaaaatagctcactgggacgttatagaagagtttaagggtgaataaatggagatgcaatgactagtcagaaagcatgatttagtgagtctgagcgttactgtggtagcaatgacaatggggaggaaggagtaaaacacaaaggtattttaaagaaagaaatgacagaaattggtaactttagcattaaggatagaagaaagataagactaaaatgttaccctggaatttctagtgagggagacaatatttaaaatgctaaaattaaaataaaccatgtatttccagagtaggtcaaagtcatttaaaaaaaggataaactgggccgggtgcagtggctcatgcctgtaatcccagcactttgggaggctgaggcaggtggatcacctgaggtccggagttcgagaccatcctggccaacatggtgaaaccctgtctctactaaaaatacaaaaattagccgggtgtggtggcgagtgcctgtagtcccagctacttgggaggctgaggcaggagaattgcttgaactcggcaatggaggttgcagtgagccgaaaaagcaccactgcactccagcctgggtgacagagtgagactctgtctcaaaaaaaaaaaaaaaaaaaaaaaaagaaaaaaggataaactaagtttaattgatgagtatgaaaacatgccagatcatcccaaaggatgtattagggaaaagcagaatttgtgagtatgtgaaaatttggaaattagttggagaaatctaatagttgatttattcagtcaacaaataggccagtatgcacactctcaatttaaggcatgagagatataatgtgactaaaacgtccaaaaccaaataagactctgctcctttttttttttctttgaggcatagcctggctctgtcgcccaggctggagtgcagtggcttgatcttggctcactgcagtctcaaactccctgagctcaggtgatactcccacctcagcctccctagcagctgggacctcaggtgtgtaccatcatgcccagctaatttttgtagagacagggttttgtcactttgcccaggctggtctggaactcctgagctcaagtgatccagctgcttaggcctctcaaagggctggtattacaggcatgaaccactgcactgagccaactctctggtctttgttattcaattgctgtgtgcctcactaatctgattcttagtactcccaaactctgaccttagtgatataaccatattctaaattcatcatcatggaatgcccatccatcctcatttctgttctgtctagccaaacctgcagttggagtcactacaaaactggtggcacagaattccaacaaaggacttccccatagcatcccaagatggggctgattgagattccaaagaaggaggtactagatgccaggaaaatcaatcccaagcatttattaggggaatttacataaagaagagggtgcggcgtgtcttagcaacagtgagaaaagagatattccacctagatatgtctgcaatgaggggatggagttaatggagttgacttgagtgtttaagaagtttggctcagggccaaagctagtttctatgtatgtaacaacatggctgatcttttagtgttttccaacagcaacctaaatagctttatcaatttctgagaaggttcaagactgaaggggaagacatagctggctgggtcacagagcagttaggtcactgtgtttctgggtcaggacattgaaagaaggcagggggaaagtgggggaccctacaatctgtcacccagagaccatgtcaagagagatctctttttcggcatttctcaacatctgtagtatttacagtcaatgctctgcccacgttcccttactcctacagtgcatgccagcctaatacccaactgccaatataataggcaaggagatactgaggacttcctctccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatatcatacaggaatattggttttctagacaattgcctttactgtttcaatcaattaatcatttgtgctgggcattacaaattaagtagtaactgaaatatacaatgcaaaagaacctcccttcctggagattaattctgcagaagagactggcagtttttttaaaaaaaagtttaaaaataatttaatggtgatatgtgctgtggagaaaaatatataaatcaatggagtgtgacaggacctgctaatgttggtttgagtgcttgatatcaattttaaataaggtggtcaagaaaaaaaatcaatgagaagataattgagcaaaaacaggaagccagtgaaagggtgatccatgacagtgcctgcactaagggtacaccaagcaaggagaactggtacaaaggcgctgacgtggaaatgtttctacatagcaattgcgttagtgtgacatggagaggaataaatgagaaaaggagtgttgggagataagggaagaaaagtagcaatggggctgaagctattccaaggattttggtttttaagctgagtgataagggatacctctaaggatgctaggcaatggaatgacatgaattgacttacattttactatgatctaactggctaacatgtaaagaacataaaagggaggtgctttagtcagattagatgaatgactttttattttattttattttattttgagacggaatttcactcttgtcgcccaggttggagtgcaatggcgtgatctcagctcactgcaacctccgtctcctgggttcaagcgattcttcttcttcagcctcctgagtagctgggattacaggcacccgccaccactctcggttaatttttgtatttttagtggagacgaggtttcactacgttggtcaggctggtctcaaactcctgacctcaggtgatctgcctgcctcggcctcccaaagtgcttggattacagacgtgaaccactgcacccggccaaatgacagttcttaaatctcactggcttaatgcaataatcattttttctcttatttatatacctaaatgaatgtgtttggcagagaggaattctgttccaagtagttggtgagagattcagcttgtggagcttgtggcttccttagagtctcagcccccagagtgtctactgcctccttctacctttctgcagtcaggggaagagaaacgaaaagcacttgagcagcagtggttattattttcaccagtaactcacaggcaagaactcaatcatatgctgtacttagcagcaaaggaaactgggagatgccgtctaaatctgtgttcaggaggaaaaggaaatgggttttagagaacacgttatagtctctgccacagggaataaggacagaaacagaatgctacttaggaagatgttgctttatacaaaaaggagatgatggtggccaggcccggtggctcacgcctgtaatcccagcactttgggaggccgaagcgggcggatcacctgaggtcaggagatcgagaccatcctggctaacacggtgaaaccctgtctctactaaaaatacgaaaaattagccgggcgtggtggtgggtgcctgtagtcccagctgctcggcaggctgaggcaggagaatggcacgaactcgggaggcagagcttgcggtgagctgagattgcaccactgcactccagcctgggcgacagagtgagactccgtctcaaaaaaaaaaaaaaaaaaaaaaaaaaaaaaaaaaaaaaaaaaaaagatgatggaatgatggcagccttgaccacagtgcttgcatgggtataaggagaatgatgtactggaaaatgtcccaaactatttattttttgatggggatagtaacattaataggtgatcaatgaaaaattgtttcagaagtaaaatacgattaggaaatgctggatttctctacaaaagatttcttgcaacatttattaggcttgaggatctttgttattttgttgtaaaaatataaaatatgcggttatcaaaatcatcaggaattttttaatagacaatatcacatagctaatattccaaagaatattctttaagaagacaagtgaattattggatagaagatagggtctggtttttgacacgtacttcctgtgtgactctggatgactctttaacctctttgagatttacttccctcaattctagaatggacacactaccttttagattgctcaccttacagggctatacaaagctaataaaatgtacatataagcactgtaagcatcagtgagtattattataagacttagcgtggcaacaaaggagcagagcaaactgagatgcttagtttttgccaggaggagcctgaatgtcagccatcaaggagtcttatcaggtagcattatcttgacagtgacccaatggccctcagtcctttgcctctggaattgatcaaactatatttacagagcctaactacatctgtcagcttataaacaacattgaaataagaatttctaccgattaatgtaaagttgtctagggacaactgtgctgatgttccctatttattataacttattttcaaaatgaggatatttgggaatggcaagcaaagacatttgtttagtaaacaccaaagatcagagagcaaaaacatcagatttttgtggaaggtattctctttaggccttggtgagaacagactaacatcagtcctcagctaggcagtgaccaagtcctctatatttaatgtctagatgaactctctatcactggactgagaggatgctccttttgtaaattaaacaaaatgagcaactctttacgtgcagacactcttgctccaaattagagagaggaccagtgatttgattttcatttataaatcatggtctgtttccacttatggttccttgcaattacctcaggtctctcagaaatatccagtggcctaaatcactcattcacagttgattaagctcgtccactttgcagattttagcagtttaaccatcagaggaatcccatttctaatataaaagacattgagtcaatctcactcattgtaacaccaactagggaaagactcagttaaggaagaaactgcagtggctgtggttgatggcaaagtttatgaaacatatcataagtattgtatagtgaataaagaagaagtttgggatcaaaatacaattatagggaaatcagtagcatatttttaccataagagcagctgattttgtatcctgccctttgtgggataattggattgtcttgacttttttattccatctcttccacttaattttgctgaatataactctagattgataggtttttctttcaatactttcaataactcacttcactctcttgtttatatggtttctgactagaaatctatgctaattcttattatcgtttctctatagataaggcattatttcccctatgggttctttcaaatatttttctgtctttggttttctaaagtttaaatatgatgtagttctcctacttggtgttctctgagcttcctgaatatttggtttagtgtttgtcattaatttggaggaagttctagccattatttcttccaatgttctcctactctgttctctcttcttcttcaggtattccaattaggcatgtgttatgccttttgattgttccttagctcctcaatgttgtgttgttttgtttgtttgttttacttgtttgttactttgcacttcgggttgggaagtttctaatgaccaatttttaggctcactgattttttcctttactgtgccaagactactaatgagtccatcaaaggcattcttcatttctattacatttttttatttttttatggtttcttagagttttcatctctctgcttacattatccttctatttttgcatattttctagttttccactagagtccttaatatattatacacagttaatttaagttccctgtctgataattccaacatctacattatatctgagttttttttttttttttttttgagttggagttttgctcttgttgcccaggctggagtgtagtggcgcgatctcagctcactgcaacctctgcctcccaggtccaagtgattctcctgcctcagcctcctgagtagctaggattacaggcacccactaacatgcctggctaattctttttgtatttttagtagagacggggtttcaccatgttgggcaggctggtcttgaactcctgacatcaggtgatccatccacctcggcctcccaaattgctgggattacaggcgtgagccaccatgtccagctgtttttttttttttttttcttttccaacttttaagttcaggggtacatgtgcaggatgtgcagatttgttacataggtaaatgtgtgccatggtggtttgctgcacagatcatcccatcacccaggtattaagcccatcttccattggctcttcttcctgatcctgcccctcttcccaccccctgccctccaacacgtcccagtgtgtgtgttgttctccacaatgtatccatgtgttctcataatttagttaccacttttctgttcctgtgttagtttgctaagtataatgtcctccagctccatccatgtccctgcaaaagatatgatctcattcctttttatggctgcatagtattccatagtgtatatgtactacattttctttatccactcttgatggttgtcttttcactccgttggtagtttattttgctatgcaggagctctttaggttaattagattccatttgtcaatttttgcttttgttgcaatggcttttgatgtttttgtcatgaaatctttacctgtgcctatgttctgaatggtatctcctagattttcttctagggtttatatagtttttggttttacatttaagtcttttatccatcttgagttgatttttgttgatggtgtaaggaagggatccagtatcaattttctgcatatggctagccagttttcccagcaccatttattaaatagggaatccttttcccattgcttgtttttgtcagacttgttaaagatcagatggttgtagatgagtggtcttatttctgggttctctgttctgtttcattggtcaatgtgtctgttcatccatcttggcaagccaaatcacaaatgaactcccattcacgattgccccccccgcaaaaaaaatgcccaggaatacaggtaacaaagaaagtgaaggagggatgtcctcaaggagaactacaagccactgctcaaaagatccactattaccctagattactgtagccctgttttggttactatagccctatagtatagtttgagattgcatagtgtgatgcttccagctttgttctttttgcttatgattgccttggctattcaggctcttttttgtttccacatgaattttaagatagttttttctaattctgtgaaaaatgtcatggtagtttaatggggatagcattgaatgaatctgtaaattgttttggggactatggccattttcacaatatcaactcttcctatccatgagcatggaataatgtttttccatttgcttgtgttatctgtgattttttttgagcagtgatttatagttctccttgaagataagcacttaggttgagttcatgtctttgttattgtgaatagtgctgcagtgaacatatgcatgcacatgtctttataataggattatttctatttttgtgtgtatatacccagtaatgggattgctgggttgaatagtatttctgcccctaggtctttgaggaattgccacactgtcttccagattaattgaactaatttacactcccaccaacagtgtaagagttttcctttttctcacaacctcaccagcatctgttgttttttgactttttactaatagccattctgactggtgtgagatggtatctcattgtggttttgatttacatttctgtaatgctcactgatgttgagctgtttttcatatatttattggctgcgagtatgtctgttcatgtaaagggttcatgtccttcacctactttgtaatggggttgttttttttttcttgtaaatttaagttccttatagatgctgaatattagacctttgtcagatggatagactgcagaaattttctctcattctgtaggttccacattttttgttgtgacaggaatgctggaaggggttgaaatgggaacagttttcttcctccagttgggaggaggaatatcccaataaaggtgggggaaagtgattttccttggagaacagacctgagtgtatttcacaatgattatttcttcatttcttctgccagagttatgaagggattttttttttttttttttttggtgtgtgtcttcatgagaacatcgtggggattctgaaagtaaagcaaacaaaaatgtaaaggcctccccaagactatggcctccaagactttcttgtatttggtttctagttagtttccaagctagtccatccttaacctccagtactttatcaacattaccattttgtggtgtcctcatcaatttatggttccagtggcttctgtttcaagtgagacttctgttgtgtttctcttgtctccagatttaagggtgatggtttgcctagtgacttcagttctctgataggttcaagaaaagttcatggtttttagtttgttcaactttttcttattttaaggatggagcaacttgcaagctcttggcatattagagttaaaaccagaagtcctttattctgttttatagccacttttatattcctttttttggaaatgagtttctagagaaagaaaggagtccgttactaaacctgaaacttactagatttagaagttcacatcacactgagactcactgtgattctctgtgaatataacatctgtcacttctctgtctaaattctggggaaagtccagtttaggcctactcttgtggcgtgcatttatgcccctgggtatgatttaggttacctaacagttttcattcttgatcgagtgatgggaggaaagaattgcaaggactgtaaaatgaaactggccatgagcaggacccagcaagaaaagagataaatgctagatggaaactgccatttgcccacaattctaacatcttaaattcagttcttagctattgggtgtcagtttttagaagtgaaaaactaacactcttctctccccaccaaaccaagagaaaaaagcattgagacatttcttgatagtcactataaaaaataaagataaactgagcaaagattaagtatttttccttcttccaaaataagataaaacttttattataaaatatgctgctaaatatggacatgctctttgaaaaaataacagaaatcatatgcttgcagtagatttatagaatcaagtttttagaattggaatgtattttgaaggtgagtgtctttttaataacttttaaataactaattttatccagttgcaataaaggggttatatgcaaatacaccagaatgctatgggttcttctttctcattctttcattttatgtagacttggacatgtttttttttggtatgaacatgaatttctttagttttcagtggcatttattataagccagacaatatgctatttatttttttgaattatttttaaacttttgaaaagtagcatatccaataaattctgtaattataaaataaaatgatggctttgtacttcatatgatgtgacaattgttaatctccatcgcctgtttcagtaggtctcaaccttttattcattattgtcccctaaggtgcctttctagatatttttttttcctaattactccctctcccataaaattttattactattgcagatatactccatatctgcttatgtactgcagcccttgagaagtccaaaaacactgtaatatctcctaatttaccccttccccataaaccagttttcacctcttgaacatgctattatcctagttgagaatgcatgccctatttgattaataataatggttatcttttataaatcaccaaactaaatatgtaggtgctggttctagagtcacattatttaggttagtattctggagcaactctttaccagatttgtgattgtgaattatttattaaactcaaagttcctcaattttctcaattcaaaataaaaataatagcacccgaattggtgaaagtaatactgacagttgtaacaaacatccccaaatgcaggatgtttcaaatcctatagaagagtatttctcagtaatataaattccaaacagaatgttactgagtgtcaggttagctctagtccaggtgctggcttcttccaccatgcgattcatcaactgaagctcatattgtttcccaggttgcactgggagttggtatccagccattagtcaagacaagataagggaaaattgcaaaataatgaaaagcctttaggggccagtgtggaagtgatacatactagttttagccacgttcctctcaccagaatttaggtccagctatgattgccacacttaagtaaaagaggggaatgggtgggaaatatgttccatctctgtgtttaggaaagataggagatgaatttcattaatagctagtcagtctctgccatggcagttatttcatagcattgtgaagattattaaactatttgaaagatatattatgtctagaattgtctagcactacaactgggatgttttgaatattatggatggggcataaaatgtaagtttagataccgtcattatacagatgagggaaatgacaggcagagataccactatcctaatgaggatgactggagatgagggaattgatatttatggagattaagaatttgctcaatgtcactgaggtagaattttaatacagcttaataaaaatttaaaacccatttgtttcctctcatttcactgtgcttactctattcaataatttaattagttacttttgctttttaaaaggcactgtcattctgttttccatgataactcaaggtttctttaatagagtgaataaataattatatcattttataaaatgttttgggattatcataataaagataatgatgatgacatcaattcttgagttcctaattgctgtaggttcagatttttttttctttttttgagatggagtctcactctgtcacccaggctggagtgcagtggtgtgatctcggctcactgtaaacttcaccttccaggttattctcccatttcagccttccaagtagctggcattacatgcacccaccaccacacccggctaatttttgtatttttagtagagacagggtttcgccatgttggccaggctggtctcaaactcctgacctcagatgatccacctgcctcggcctcccaaagtgtttggattacaggttcagattttaataagatgacaactgaagtgtgtttcacaggggtaataaaaatagagatcttaataccaaattaagaaataaatttctccaagcatatagaaattaatctaattgatgtgtgcatatatttttaaataatttttttttttttttgagacagagtttcacttttgttccccaagctgcagtgcaatggcgagatctcggcttgctgcaacctctgcctcctcggttcaagtgattctcctgcctcagccttccaagtagctgggattacaggcgcgcaccaccatgcccagctaattttttgtatttttagtagaaacggggtttcaccatgttagccaggctggtcttgaacgcctgacctcaggtgatctgcccacctcggccccccaaagtgatgggattacaggcgtcagccaccatgcccagcccaatgctgttgatcttttcaactaactcatgttagcagccctattaaggcagccaacattttatcagtttcaaatttattcactatgtcactaagatgatggttcttgatttatttttattaatttttatttctatagaaaatctatgaattgtgattgcagttttatggctgataactttctagaaaaaattatgatatacaacaaaacttaacgaatatcagcaaaaaggggaatctacaccttcacactattctattcacgtttgcactttcttccaattttctttgtgcatacgtgtttgcagttatagcatactatactctttatattttttgttgtttgctaatgtaattctgtatttctacggagtcttcaaaattatcacttttaatggcttcaagacattctctatgctgttatataattggtaacatttaaccgtttagtaccaactttttttctccttactttttctttttcttttcttttttttttttgagacggagtctcgctctgtcgcctaggctggagtgcagtggcgcgatctcggctcactgcaagctccgcctcccaggttcacgccattctcctgcctcagcctcccgagtagctgggactataggcgcccgccaccacgcccggctaatttttttgtatttttagtagagacggggtttcatcgtgttagccaggatggtctcgatctcctgaccttgtgatcagcccgcctcggcctcccaaagtgctgggattacaggcgtgagccaccgcgcctggcctctcattactttttcttacatgtatactttcttcttaacattagtaaatgtaggttgagaagttattttcgatttttgtcagcatgacattttgccccagttgtgtctctttttctgtctatagttgctacctatcaatatttttaaaaaaattctgcccctcttttaagccataattatcactcattcattcattgaatttcttaagtgtttctcttcattgtagttttaaatttttctctttctaaacactttatagttttctaaaaactttagcattcaaataatatcctggttttattgccttacagtgcaagataattcatattgaacagcttgttattttactgactgtaaattgattacattctcaaatctcattattgaacattttgtagagccagtatagttaagtatagtagtccgtctttacatgggggatacatttcaagacccccagtggatgcctgaaattgtagatagtactgaaccctaccctatatatgctatgttttccctaaacatacatacttatgataaaatttaatttataaattaggcaaggtaggagattaatgaccagttattcagaagatagagcatatgagagtgatgactgataaacctgtaaaagattttccacattccttaaaatataatgcctttaaggatatgaaactaatttatttcataacagtagctacattactattcttggcatatgaaaaattgaatgttgagaagtaccactataaaattttaaaaatgagaagtcatggcaaatatataccttataacttatatcaatacagaggtgccataagacattaaaaattatcattgctttctgatattagtttactattattttattgtttttgttattattgtcagtttagcatagttaaaaatatactgtatgaaaaatatgatagttataatgctgttcaccaattatttccaactctccgttcttttttaacacatggtaggattgcactttttaggggctccatttggggagatagggctttaagacaggttctgtccagtgggtttggaacagacatatcttctggccagatttcattgccagtatgacattctcaagctcattttcttctgccacaggtagccacgttacagagagtgactgttctgctcatattgatcttgatatgcatataggataaacaggaaataagtctttgcttacttttacttaaacaactgtgatttggggattgttaacatagcaaaatcaatcatcttctgctcatgacagaaaagtcagtttttgttttatttgggcaatttgctcatctaatatttgctcatcttattattatcctagtagcaatttataacaaatggttcatgaagagttctgatttcagattatttatttcccacgtagcctcagtaggataatgtggtttggttaatttggccccctattacttgtacttcaacaggttaattttataactacttattttataatgtaggtttcattgcttttattcagaattaaaatgtgtctttgcatagtaatatttcatttacaggataaatattcattgaataaattctcaaatgcacatctgttacctttgaaaaagttctttcttccctaagtttcatttagttcttaccttacttagatagatatccacaagtttatcatgaattctttaaaaataaactcttaatctaggcatacttatttagtggagcatagttcagcatatcatttatggaaaaaattgttttgacactaaattacaatattccctaatttaaaatctctgctttttcttttttttcctcctgagacggagtcttgctttgtcgcccaggctggagcacaatggtgggatctcggctcactgcaacctctccctcccaggttcaagtgattctcctgcctcagcctcctgagtagctgggaccacaggcatgggccaccacggccagctaatttttgtgtttttagtagaggtggggttttaccatgttggccaggttggtctcaaactcctgacctcaggctatctgcctgcctcgacctcccaaagtgctgggaccaaaagcgtgagccactgtgcctggccaaaatctctgcatatcctttgaaaaattaaatataaatataacttgtattaatatatttgaatttcaaatacatttggaagcacttagtttttagggcaacaatactatgaattcttttggaaagccaagatttattttgtccctttattcttaagaataaagattttataaaatgactcctttccttagactgaaaaatcatattacattacacattacatatatacctaaaaatgaagttaaatttaatatcatgttacatcagagatgtagctgtaagataatttataattacaaattatttttagtaatgtctcctaaattagagctaagagtggtaaaataatcaatataatctctattctgaggtttaaacagatgactccaggaatataaaatctgaggtagacacttcattagttgagtgaagtttctgtaacaaactgtaaagaaaggttgatgtcttatgaaatgtgaaaggttgatgtcttatgaaatgggagtggaccagaaaggaacagctgctcactaccaaaaagaggtgagtgaaggctctgcctgtaaagagggccacattttcttttaagaagtcaattttaagtcttctggtagattgcgttgtagttcaggccatcatcatttgcctcactctcatcatgcttactgaaatgagcaaatgaataaactccagggggaagtcccgtatcagcaaggcatcatatgccacagacttctactagttatagggcatatacactgtgtaaagtgaaaataacaagggtaacttactaacctcctcagtgagaggctgtggcaaagtcagtaagaggaagagaaagggtaactgttggctgaacacccaagagtgtggggtaaagatggggcgtgaaggtgaagctgggctatggacaaagaaagaccaattacttggaacccatttcactatcatttattgacagcattctaaccatccccatcagtgactgctgaggcaatagaaaccactttcaaacagattaaaacagaaattaactgttctttcaacctatgtttccttaaaatatatcatgccatagtgtgagtttttaaagtttggggaattttagggctaaaacagcaggtgctgagcattaagttattcaactattaatttaacgcctcataactttagttaatgtgacaactaaaagaaattaaaatataataaatgtttcttaaggagaaatcttattaatctttattaaaggtaagggtaaagtaagaatatatgataaaaatctgaataaaataaaaaatactagttaagcgcatgtctacaggcaccactttaaacattttctatgtataagtatatttaataatacattattgttattatttccatttcaaaaataaaggaagttaaggacagacagattgggtgatatgctgactcctatatgttggaatttgaattaaatccaatcagtattctctacctccccaagtctgagtatgctccattgccttcaaaaaccagaagcaaatatctgttaggatcataattgtaaatgagttaaccttacctgttgaaagactaaggaaaaaaaagtaaaccgctgagtaaaataaaatgatacacagagatgataaattaaagtttagtcaaagttatattaatcaagtacagataaaagaaagcagagattataatgttgatttcagattttaaaaaataattcatagcaaactaaaattgaatgtttccaagaaggccatttttattgcagtgtaaaatcttagggattttacaatgactaaacattacattagtcattttatatatgtgccaaatagcttgataggtatattgtaaattcagctttataaatttagagattatattattaactcaaattggatttgcaattgttatatctacctgttgaattaaacctgtatcattttgagttgttctcttttttccttgaactctcttgtctaatatttatagagttacactaggtttctttggcttcatatgtgcatggttattatttttcattcttttttcaacctttctgtgtaattgtgttgtagaagtcttttgtaagtggcttatagttttgtttttttaatctagttctcatttgtttttaattggagcattaaatcaatttatagttgatgtaataccaatgtgtttgggtttaaatctgccatctggttttgtacttgctgttctgtgtttagtattttttttttactctcttttcttggtttcctttttattacaaaagcattttcaattaaattttttccctaagaattttggaacttacagattgtttactaattttggagacagtacagattctgtcttatatacttctagttgaatattaataaattcatttgtcttccctttcaagaatacaaggacattagtatagtccatttgcacctcttctgactgacatgttactattgtatattttaatttcattctgttatgatactaacaagacattatcttattgttctgttcaattactagtttataaatttactcacgtatttaccatacccactgatcacctcacataaaattataaatacctctacaggtacactcttgatccctcctgtcttattttgcttatttcttttttttttttttttttttttgagacgaagtttcggtcttgtcgcccaggctggagtgcgtggcgcaatctcgcctcactgcaacctccacctcccgggtgcaagcaattctccagtctcagcttctcgagtagctgggattacaggcgcccaccaccacgcctggctaatttttgtattttttagtacagacagcgtttcaccatgttggccaggctggtcctgaacccctgacctcaggtgatccacccgtctcggccttccaagtaatcctgagtagctgggattacaggcgtgagccaccgtgctcggctgcttatttcttaattctacaaatttgccagtatttaacatgccgtattgttgtttttttgagacggagtctcgctctgtcgcccaggctggagtgcagtggtgagatctccactcactgcgagctccacctcccgcgttcacgccattctcctgcctcagcctcccgagtagctgggactacaggcgcccgccaccacgcccggctaattttttgtatttttggtagagacagggtttcactgtgttagcgaggatggtctctatctcctgacctcgtgatccacccgcgtcagcctcccaaagtgctgggattacaggcgtgagccaccgcgcccggctgtattgttgttttttaaaaaattattttagtgtttattgtatctcctcttccaactaaaatgtatgttctgaatacactgacattcatggattttttcctagtgcttagaacaatgcctggcccctataggaagcaccaattatatatttattgagtgaaagaatgaatttattcttaagtgtcttacactccatcctgagatcaacttccttctgtccaaagtatatcttttatgttccctttgtgaagatttgctgatgtgctcccttattttttccctagaaatatcttatttcatcctaaaaaatgtttttcagcatacaggaatgcttttattatttaatattaagacatttaagatattaattctctgacacctgacttccattattgctgttgagcagtctgctgtcagtcaaactgtccctcctttgtggtaaatttgtctgtcttctcgggctactactaaaaacttcttttcacattctatactcttcattttcacagtgttgtatttgttgcgcatttcttttttaattaacttgtttttgggttcattagatctcgtcttgtcttctatcacttctagaaaattctcagccatagcatcttcaaatacttgtctctgtcccattttcccactgttctccttttaaactttaaatgtgttagaactcaatctgttcttcatgtattttaacttcctttttagatttttcatctctgcttctgctgattcttattcctgctttttctgcttcgtggtaccttgcctcttgcatgcttagttatattttagtgtgagcatctctttttccttgggaaattatccatgggaatatttgaggctagaatgaaggtgtattcattccttcagaggatttacttttgctacctcccagagcactccctatatgagagtagtttatggaggttgaaggatgttttgtctgctcagttgatatgtattaatatttggacagctctgaaccaaagcagctttttctttttttcagcttccttgggttgtcaatgaagtaggtgcacatatttctgggtcgcatgtgccctctgaggatacagttatataattgagaatctcctccttgattttccatgttggctggaaactggattttactttatttctctcttaccaccccacagtcatcccaagcttcctgcccaggttatcagtctgtgatcatggaagcttgagctctccaagcttggcagttatctaagaataaggaattctgtctttactcttttttttgtcaggtctttagtgagatatttatacatgtaatcacaaaataatatattatcattacctagtttttaatactttttagctagagactccatctgacaatggaatcatccatagtatctttgtgtcattgttctctacaaataatgattttaaatcaatgggaagtattaggaactgtttaataataaaacactgggagaagtggttaatcattaagggatggaggaagactttgagaaggaaaaaggctgataactatgtgatttgaatctaattcatttcacactgcaactggatacatagtttggcatatggtggtttaaataccatacatataaggtgccattagatacacctttaccacttccatattaacatttctggtgactcacaagaacatctgtaacaaaattctggcattcatagattttcaaacaaaaatacatgtttacttttaattccattttgcctatttttaaagttttatactcatttatggattttgggtattgtatgacatacgttgatttttcttcatttgaagatcaaacataaattcacctacacaacttttccaaaactgttatggtttcacgttttcaacttctatttgtgaattagctttttctttttttctaaaaagttaaccagttatacaatgcaattaattaaatgcagatgtctatgattttaaaaaactatctatactacataaattaatttgatctatttctgatacattcatattttaaatatgtagctatttattttttttcttttgagatgaagttttgttcttgttgcccaggctggagcgcaatggaatgatcttggctcactgcaacctctgcctcccgggttcaagcaattctcctgcctcagcctcccgagtagctgggattacaggtgcctgccaccatgcctggctaatttttgtatatttagtagagacggagtttcaccatgttgactaggctggtcttgaactcctgacttcaggtgatccactcacctcgacctcccaaagtgctgagagtacaggcgtgagccactgcacctggcccaactatttcatacttattaaatatcatgattttatatttaagttatagatatattcatacttttaagaaaaatagtatatctgcattttccaaaattgttatatttaaaaatagctttgaattttgcgtacatgtttcacttccttattggtatgtctttagtatatggtgctttattcaaatgccataattataaaaatatcttataataatcaactttaaaaagggacatcggtttgattttgaaaaatcacttcttgaccttaaatactagaatgtaataataaaagagattatttgaaatggtgaactgagtacataaaatttgatggtacacttttaacacagatttttctattgttcatgtttaacttaagaaaggtggtaggtttcatctctttatgtcttgatttctcgtacaattgcttcatgctgttatgctaagatcagaattacagatctttcctggctgaaatgaatgatcaacatttaattgactaagttcctcattgtttaagatgctttgacttgtggacgtcagatgcagggaaacagatttactgaaattctgacccctggcatattttttgtcatagacacatagatattacttgaaaccaaatatgtatttttcatcatactttatccattaagccactgaagtcttttggaatattgtcttttatttaagtgccatccatctaaagccgcctgaagttgcagagttctgcaattactgacagtaatactctctgaaaaactatgttaatccagtcttatgccacttaacctcattttggtcaatgatgaaccacatatactatagtgtcccataagattataacagagctgaaaaattcctatcacctagtgacactgtagccgttatgatgtgttagtgcaaggcaatactctgtggttgtggtgatgcttatgtaaataaacctactgcaccgccagttatataaaagtatagcacagtccgggtgcggtggctcatgcctgtaatcccagcactttgggaggctgaggcaggcagatcacccgaggtcaggagttcgagaccagcctggccaatatggcaaaaaccctgtctctaccaaaaatacaaaaattagctgggcgtggtggtgcgtgcctgtagtcccagttactagggtggctgaggcaggagaatcacttgaacccaggaggcagaagttgcagtgagccaagatcgcaccactgcactccagcctgggcgacagagcaagactccatttcaaaaaaagaagaaaagaaaaagtatagcacatatgattgtgtacaatacgtaatacctgatagtgataatagatgactgttcctggtttatgtatttactgtactttttatcattattttagagtgtactccttctacttatcaaaaaaaagttaactgtaaatcagtctcaggtcctttaagaagtattccataagaaggtattgtcataaaaggagataacagctccatgcatgttattgcccccaaagaccttccgggggacaagatgtggatgtagaagacagtgatattgatgaccctgaccttgtgtaggcctaggctaagtatgtgcttgtgtcttagcttttaacaaaaaagttcaagcagtaaaagataacagtttttaaaaatacaaaaagtcttataaaagaaatctataaagaaaatattctgtatagctgtacatgtttgtgtcttaacctaagtgttatttcaaaagaacaaaacagattttaaaaaatttatgaagtaaaaatatagaaagctaaggttaatttattacttaataaaatattttttataaatttagagtagcctaagtgtacagtgtttataaagtcgatagtaatgtacactagcgtcctaggccttcacatttactcgccactcactcactttcttacctagatcaaattgcagtcctgtaggcaccattcatagtaagtgctcaatatgggtataccattcttatctttatactgtattttttgcacaaattttctgtgttcagatacacaaatagttaccattatgttactatcgctacaatattcggtatggtaacatgctatacaggtttgtaggctaggagcaacaggctagaccatatagcctaggtgtggggtaggccctgctatctaggtttgtataagtacactcaatgatgttcgaagaaggataccatctcagaatacatcaccgtcttgataccatctcagaatacatcaccgtctttaagggatacatgactatggtttagcagaaagatcatttatttgtctgtaacgtttgaatcagttcatctgatgatcaaaatcttgccacaataaaacatattctgtcattcagaagtatgctattgagacagctgaactttcacctttgctttccatataaaactcagggttctatagcaattaatttattcaagttggacgattattgttaataatacccttgtctttaaaaaagttattgacttaatccttttggattatttaaaaatgtatcaattcttttttttcttccagtatccattataaacttacagcacagttcatgaatttcaggttacaaaaaatagacatagagttgttaacagcatagttcatgaatttcaggttacgaaaaatagagttgttttcctcaagaatattttatgaaatacttttaaaaggaacatattcctaaatgaaaaaatatttcattgtgcatgtttcagaagcacttttattcaggtatgattaatacatagaactggaatgaacatttgttcatattctttcagataaaacacaaataggagtatatacatgtctttaaaaagatataagtaaatttgcattaaaagtttatgttcttttccaagtctatattttctctttttattaagttgaaaaaaaatgaagaaataattaataagttttatttcattagttctttgtaaaatattattagaatatgtaaaaatagctcatgctactgaaagttattaattggatatgtttactgtgtttatttttatgtatatcattcattaacatataaataagaaaggaaatctgaaagtaagcgtaaggactattatacataatcttgtgtaatttcccaaattcagaaatcaatacatgtgatataattactaatacctagatgatcaatttaattcttttttagatatgtaatataaatagaaaatttcttagggcttaagtaaaaaacaacagtgttttagtttttttctgtgtgaaaaaatactttcatttgcctcattctttacctgttaaaaagcctctcagggtggggcgtggtggcacacgtctgtaatcctagcactttgagaggcctaggcagggggatcatgaggtcaggagatcgagaccatcctggccaacaaggtgaaaccctgtctctattaaaaatacaaaagttagctgggcatggtggcgggcgcctgtagtcccagctactcaggaggctgaggcaggagcattgcttgaacccgggaggcggaggttgcagtgagccgagatcgcgccactgtactacaccctgggtgacagagtgagactctcagaaaaacaaaaacagaaacaaaaacaaaacaaaacaaaaaacactcagaaaaactttatttgctcccacttattttctactttttcttcttttgctattatatttatatttatgtttaatggtcatttatatttaatataaatctatttatataattgtatttaatggccattttatatttttctgtattctcccagttaacatatcctggcagcataaatgaaatttgatgatttcattatcagttatccaaacaagctttcctatccctgacctgtgaatctgtgctaggtggggtagattagaagcttcaggatcttgtaagggtgacgtgacaagggcagataactgatggtcctgatagcacccagagaaaagctacgttaaatctctgtcctccatatagctgaagtagtgtctagtatcagtttatggttcttcacttgaaatgagaatatgttgtatactatagatttaaataaaacaaacttagatttaaactgcttaagctaaagatcttggctatttagctataatttttagtgaaaatatcctagtttattgaatcttacctagatattctttttataagtttgattttattttgttctccttctttcctttttgtcatttctttacttaggctataaatttattttaaagactgagttttctcttgaccaattctttccataagttcacctgttttttatatgacttacactataagagcctatgtagacactcaataaatgtgttttattttgtagcagaatccatgacttattatcagtaaaaccctggttgaggtacttttaatcttgttttccacacctaaacctatctagccctgttgcattgtatcccgaggcccagcattattcaatattttgtgtatttacagtaagccaagtggagtacttattgtatcctggaaataataactatgtcgactaataggcatcaaaataagaattaatttttactttgcaggacaagtactccaagaaacctgagttgttaaggtggtaaacacagaaagcactatacaaagtatttgtaaagattaacattgctacagttatgcaagcacatatttgccttaacaagattagtaatgccagctgcctgcattcaaagagacaatttaacttcaattttaatattacctgaaacagtgtaaaatgacaagagttacatcgaaatatgtatcacaatttcaaatgaagaaattaaagcatacctttatgttatctgctgtgacttttataaatgaatgaaatggaatatatgaatttttattatagaaagctatttgtccaaaattaaaataatattttattacaatatagtttttactgatgtttttacaagtattgtattctctttgatggtaggttctcttgttggtaaattccaatcgattaaaaattcatgttcctttgtttaggcgttggtcatagtggatggtgaattgagtcacttcctcacctctctctattcaaccttttgtgctgcacaggctgtttcctaggaccacttgaagcttgagttctgttcataatttgggttctgccaattagatgcacttgagtaaaatgtggaaggtggaaagcagtctaggctatgtttctaaggtttttctgctggcagactcctgatagaattatctgatatctgtagagtgtcttaccagaataatgcttcccttaatatgggttgcatcctcatcataacagcttcctaatcatggccagcttctggaccaccgatgatacattaactccttgggtcatctagttctgtgaccctcacagttgttctgttaaatgcaatgtaaagtctgttttcagccttcaatatgattcagaaagttatttaaaatttcataatgcattttttatgtttatactacaaaaatgtagttggtctctgcatttaattgatacaattaacaataatatattttaaattttatttacttcaattgttaatttttttttttactaaagaaaatgtacttatatggtaaatgttataaattttatttactatagttgctgcctctacatttatttttagggctgacatagttatttaaaacctggtcataacctagttaaaatttctcctccacgtatggttgcttgcaatatagcccacttgttcctcatcccactgaccctaaactcaacataccccacagctgctaatcacgagaaaacctagtgttcaatattagaataatgtaaataagttctcccttcacacgtgttttctttaaaccagctaatccacaacctctgagggaaagcctaagtggtaacactcataggccttaataatggtgtagccacccaggttctctccatcgtttcctgctcactgggtgaactccctgccacctccagtcttaccgtcagcctcctgttgtcaccccaacctctctggaatctgtgagtaataaatatcttctattttctgcactgtggcttcacttccttattgtgtctcccctgacgcacacgcacgcctgaacttaaccttatattcagccagagctcttttgggcagtggctgtcttgacaagaataaacaagggtatctgctgtataaacaagtttcctgtgaaaggacgacctggtcacagtgagatacttaggcattaggccatcatcaggataaagaaatagcccaaaaaaggcatgctacaaactctcaggcccagtttttttactttccaggtcagaacagggctggagcttatggccagtcttgagagagaccacaaaaccaaattggaaacaattcataacaaattaaatcaaaactgtaaactaaaccgaaaaagtaaaggtgatacctataattaaaggtagcaatttattggccccactactcccactccaaattgccgtagctagaaacaattgctttttaatttttctgggttttgttattttggtggttacttcatatctctgaataacacacgtattccaacaatcatgattttctcatgcgagacatattccgttgatttttctgctagactagataaggactttgtcttcttaaccttcttcccagctcctctccccatagccacccaatgtagttatatcaccattttaatttctttattatgtttttaatttaaataatatgtacttttatcacctttccatcagctctagaaatatgatttttgactcccctctttgtaagatattatcagtgctaatcttccctgacctttctctcctctaccattctttcctccacttctgtgtttcttctgtagttataataaatagtacattttctttctcttgaaaacttctaaaatgcttaaggttttaagctttctttaaacatagtgagatcggaaaataaaggccttatcgaattactcatgattttatcttttctcatggtcatttaatgcctgatctttcaaaagtttcactttcttttactgacattcctctgttgccttggttttgtatttgctgccttcttactctttttctctgctttgtattttgtgaagcacaaaaagctacacagtacactaaaacacaactaattatacttcacattaatgaataggctaatgcttttccggtgtggtgggggagtttccaaaacctagattaggaagactatcaatttgttgactattcagttagcagtagaataagggaacagtatagagagactccagttccctttcctagccaatgaataaaagcttacaaaccatcgtcttatgttcatagattgttttccctaaatattttacatgtatttatatatactgaagttcattagtcaattctatgctaactcaaaaagttattattttttcaatttttttcttttttgagacggagtctcgctctgtcacccaggctggagtgcagtggcgtgatctcagctcactgcaagctccacctcccaggttcatgccattctcctgcctcagcctcccgagtagctgggactacaggtgcccgtcaccacgcccggctaattttttgtatttttagtagagatggggtttcactttgttagccaggatggtcttgatttcctgacctcgtgatccgcctgcctcggcctcccaaagtgctgggattacacgtgtgagctgctgcgcccagcctattttttcaatcttatgctatttatcttactactttctttctcataagtgcataggaaaatttgacactgctgagaaatcactgaactgtttgtgggataccaccagattatttatggttctataagatatttctcaggccaggccttttataaagcaattttaatatatgtatgaattattatatgtcatgtaattattctataattttagaatgtatattcagattaagacattagtttcatgtaatactttcaggcatgctgaagtcccagtagctacaggtagggaagaagcaggaaactgtaaacaggtggacccaggatcaggtacctcacatagctctaggactagtactacagagagtaatagtagtatagtcaacactgtacagtgtggatgtaatatggcagcaggttcttccaggacaggtgaggatacttgcagattgactggtaccatcactgcaattgtagatggcatgaatgacttagacctaactaggaacatgaagacatgtgtggtcttaggaaaaagggttgagtagatatggccagattatcaggaatcaggaaaatgctctaccttcataagaatgataaatcacagtcaagaaacaaaaggataattccagttgcatgttcagcaagccgtgacataggttagaagcaaagtctgcagctcactggacacagagatatcttgagagttaattctaacctagtatttatcaaaaggtgatctattataactctctggaatcctggtcaaaaactaagataattaggcctgttccaactcttagacttcagatcaaatccaataatctctgtgaacctccctgagtgatccttatgaatcttaaaatttgagaaccacatctttagacataccagatactaagtttagaacagaaagacaaatttgaggcattttatttcacttgcttactaccctttaccaaaatattgaggctagttttcttaatttactcttgtcaatgtggacaaaggcctgaaaacactgtgcttatagtttgaaagcatttatatttgcagtgatgtggagctggaaaatgaggatttgctcatttttatttatttttctatactagttgagtgttataataaaatataaaaactcattttagcttcatcttagtctaatgtgcttttcatgacaagtacttaaagattatgtctagtcagtgtagcttcataattgatgtaaaacaatgcagaaacatattaaacatatgacagcttatgagatctaaatttgtaaacttcataaatattaaaaaactttcatattttaaactttcatattttaaaataaatatgaaacctacgatagtcttacattagtcaaaatgaaataaaattaatgtatcacagcccaatgactagtttcttctcattcacctgatgaatgcaagaaagcctgttagttggagtaaaatcatctggtgtgtgctcagctgcatttaactgtagaggccttaagacatgttaagcaatgtgattttgatttcacctgctgactttccgaaggcaacttattataagaaacagttgaatagtgatatcatgctgttggcacttgagctttctgctggaggttgcaatctaatctttgcaaacctgtaattactatttcctaagtaattctaggtttccattattgaatctctaaatgtctaaaaggtactgagatgtaatatacaaaaaggcatagggatcaaatgataacaacaaactctttgtgtcagtaatactcaatttcgatgtttttgatgttataatgacatgttactggcaagaatatttggtgcattttgcaggttcagtgtatttttttatgttggtgttatgaagtctttgaaataaaaagatgttttattccagggttatcaatccatgcatcacagtttagagaaataagtgaaagatagtgattctactttgaaatttaaatgtttgtctctggttattcaagttaagtattttaaaatagttttgactgatatcatgttatatagaaaatgtgaagtcataggtgtctgtgtaatggaatatgaaaaacattgtttattaaaaaaataaaatcctggtagagacatcatttctcctttgaaatatatagataagtgatccactaaaaaagtaaacatctcaaacacaaagtttaattctgcttgtgagaatatgccatacattgcactttttttgtgaaagataaactactcttttttatcatttcattttaatgtgtttcatgtactgtcctaggcacaaggaatagaatcgtaacaaggacagggtttgcttttgtagagcatagattctaatggagaagatagaaagttaaaaagcaaacagaaatttcaagctgatgataatgatgactgagatgatagctgtcacagtgaagatgataggcagtggactttagtagatattagaaagatatacccaagagcactgcatgagatatgtaactaatagagaggaatctgtaataactcaagaaaataaagttctgtgaccaaattattcagacatatatgataaaatattataaaatagtagaaaagaatatttgcagtccctgtggctgcatttaaccatctaaatatatcaatatctatatacctatatatgaaaatccctatctaatgaaatagtttaaaaatcttcccaagattatgcagctacttaaatggctgagtaggactagatctgcagacccctgaggccagcctcagatatcagtcagagtgaacataacaaatcaaagtagtgtccttccacagaggagttaaaatatttaaacataagtaattttagcaatccaataggtgttaaaaaaaagaaaaaagtctatgggccaggcacgatggctcatgcatgtaatcctagcactttgggaggccgaggcaggtggatcacctgaggtcaggagttcaagaccagcctggccaacgtggtaaaaccccgtctcaaaaaaataaataaataaataaaaattagccaggtgtggtggcatcctcctgtagtcccagctattcggaaggctgaggcaggagaattgcttgaacctaggaggcagaggttgcatgcagtgagctgagatcacaccactgcactccagcctaggtgacagaaaataaaaatctatgcccagataaatctttagactaattgagcaaggcctttgcttatacatctttggtgtaccataggtttggatttgtagctgtagactttaacttttgcttgtctatagccactgcattacaaagatgcaaataccagacttttccaaacatgttaatatgggatctctgggagcgggaaccccctaaatggctaatgtataccaggccaattaaaatttaacggcctaggatatgtgtgggtatgcatgtgtatttatttaaaaagacactcaaatagtttttttttatatgaagaaagtaaagctttgacactgaaattaaatgatgtaataactgttatattcagctaatatctcaatgatggctttgaggcagttgatagtagatagcttttttaaagaagtgtttttgaatgtttagcatatgaaacccttatggtgttgtctttatagagcaaagagggaataaagaaatggaatgtaaaaaatcctaaatattccacataaaaaagcttactagaattaataaatgtattcagcaaagttgcaggacacaaaatcaatatgcaaatatcagttgtgatttcatatactaacataaatctgaaacggaaatttttaaaaattgggttaaaatagcatcaaaaatacatagaaatataaacttaacaggagactaaagacttgttctctgaaaactacaaacatttctaaagaaaataaagatggtaataaatagacatatatattcatgaattagatgacttaatattgttgtccatactacttaaagctatccacaggttaaataccatccatatcaaaatacccatagctgttttttttttctgaaatagaaaaagcaattctaaaattcatatgcaaccgcagagaaccaaaaagagcccaaacaatctaaagaacaagctggaggtcctgcacttcctgacttcaaaggatattacaaaattacagtagttaaaacattatggagaaatagttatagaaatatggtggagtaggaagcaccaggaatctgtcttcccacctagagaacaattgtactggcagaatctgtctgatatataactattttggatttttgacatctactaaaggcttgcaacttctaggggaaagcttgcatggcgaattatgattaatttcagtcaatttcagcacttaaccacagtagtagctacccatttcccacagtcacccctgtagcaggcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggtgagtggttattgttgcacctctatccattattgcaagcccctccctgctggctgaagtgacttccagaagattaaaagggccagtgcccttctcctactttatttttctgtttttccccctttgacagctagacattaaaaagtagggcattcaaagtaactgcacatatggtgacaatcagaaaatgactaagttactaagtgtaaacttaaggactgtcttttctaagcctgtgccttgcctttcctttggcacaggcttagaaaagacagtctttaagtttacacttcagactgattcttggcacagagatagcctacaacagaatcctcttatgacaatataaaaagcaaaatcattgactgaagtaaccgcaaactctcagtaagagggagaatctaatttttagagttactatgttattagatccaaaatcacaattcatacaaaaaattaagaaactatgtcttgtccaaaggaaaatatgaaatccctaaaatgacttgatggtggatctgctacagagggactttaaaataattgtgttaaatgatcaaagaactacaggaagatatagagaaagtcaagaaaatgatatatgaacaaaatgaaaaaaattcaatggataggaaacctcacaagaagttaaaaaaaattgggagctgaaaagtacaacaacttaaataaaaaatttactagagcgattcaaaggaagatttgagcaagcaaaggaaacagtcagtaaacttgaagataggacaatggaaatcaaggaacagaaggaaaaagaattgaaaaaagtaaacagagtctaagggacctgtgtgacacaatcaaggagtcacaggaggagaggagaaagagaagagaaaacttgaagaaacaacggatagaacctttccaaatctgataaaagacattaatataaacattcaagaaatccaacagaattcaaggaagatgaactcaaaaagacataaactgaaatacattataatcaaagctttaaaaggtggagacaaagatagaatcttaaaagcagcagaaaaacatcaatatattacttataaggaataatcagtaagattatcagtatatttctcaccagaaacgttgcaggccagaaggcagtgggctgacattcgaagtgctaaagaaaaacaaaaacagaaaacattatcaaacaagaatcttatatccagccaaactgtccttaaagtgagggcgaaattaagacatccccaggaaaacaacagttgggagagcttgttaccattggacctgacttgcaagaaatcctcctgcagagtgaaatgagaagacactagacagtaacttgaagttgtgtaaagaaataaagatcttaataaaggaaaatacatagaaaattataaaagcttatattattgtaacaatactttttaactgcacttttcgtgttctacatgctttaagaggttaatatatatatatttaaatttgtataaaagttcatattatgctttgtaactccaattttgttttgtacataatttaagagactaatgaatttaaaatacttacatgtttatatttttgtataatacataaagatataattttgtgacatcaaaaattgagagggtgggggaatggagcttttgaaggagccgagtttttatatattattgcagttatggtggtacaaatttaaattagaatgttatatatgcaggatctaaaatataatccctatggtaaccaccaagaaaatagctatatacaaggaaatgagaaagaaatttaagcaaatcactaaagaaaataaaatagacaactaaatataaaagatagtaatgcaggaaatgtagggaaacatctataagctataacgaattcaaatagtggctgggcgcagtggctcacacctgcaatccctgcgctttgggaggccgaggtgggtggatcatgaagtcaggagatcgaaaccatcctggccaacatggtgaaaccctgtctctactaaaaatacaaaaaatagctaggtgtggtggcacatgcctatagtcccagatactcatgaggctgagggaggagaatcacttgaacccaggaggcggaggctgcagtgatccaagattgtgccatggcactccatcctgggtgacaaagcaagactctgtctcaaaaaaagaaaaaaaaaagaattcaaaaatagtaaaatgacagaagtagcttccttcttttcagaaattacttataaattgattaaatgagctaatcaaaagactggcaaaatagatttttttaaaaaagatctatgtgtgtacaagagactcattttagatccaaagatgcaaatagattgaaggtagagggacagaaaaagatttctcaggcaaataaccaaacaagagcagggtagctatactgagaacagacaaaatagactttaatcaaaaagtttacaaaaggcaaagaaggacattctatattaataaaaggtttaatacagtaagaagttataacaagtataaacatttatgaacctagtaacagatcactaaattatatgaagaaataacttacataatggaagggaatgatacacagttccacagtaatagttgaagatgaataaatcactctcaataatggctagaaaaaaaaaacaaagataaataagaaaatgcaatacattaaaaaaaaaacaattagacctaactctgtgcaacaacagcgtacacattcttctcaagtgtacatggtacattttccaaaatagactatatgttacttcataaattaagtctcattagattgaaaagatagttatagaaagtatcttctctgatcctaagaagattgtcttagttcattttttgctgttataacaaaatgccacacactggataatttatataaaaatgttttttcctcacagttttggaggatgaggaatccagaagcatggtgccaacatttggcaagggacatcctatggcagaaggcattagatggcaagaaacagagaaagagacagacatcaggggctgaacttgtttataactaccccgctacttcaataatgacagtagtagttttagtccttatggcaggatttatgggaggactctgcctgtatgacccactcaccccttatttggctccatctcctaacactgttgcattggagattaagttttcaacatatgaattttagggggacatattcaaaccatagcaaggatgaagttagaaatcaatataaataaaaccagaaaaagttacaaaactttggaatttaaacaatacactcttaaacaatgaacgttatcaaagagaaattgtaagggaaattcgaaaatacttggagatgaaggaaaatgaaaacaatatatcaaaacatatgggatgaggaaacagtgctaagggggaaatttatagctataagttcttaaagatctcaagtcaacaacctagctttacaatgtatggaactagaaaaataacaaattaaacctaaagctagcacaagaaaggaaataataaaaattcgaccagagataaacaagatagtgaatagaaaaacaacagaataaaccaatgaacccaagacttggttctttaaaaagatgaacaaaatttacaaaactttagctaaataaactaataaaaaatgagagaaaagattcaagtaacaaagtcagaaatagaaaaagggacattcaggctgggcacggtggctcacgcctgtaatctcagcactttgggaggctgaggcaggtggatcacgagatcaggagatgagatcatcctggctaacatggtgaaaccccatctgtactaaaactacaaaaacaaaaaattagctgggcgtggtggcgggcgcctgtagtcccagttactcaggaggctgaggcaggagaatggcatgaacccgggaggcagaggttgcagtgagccgagatcgtgccactgcattccagcctgggtgacagagtgagattccgtgtcaaaaaacaaaaataaaaacaaaaaaacaaaacaaaaaaaaaccctacagaccaatatctcttacgaatattgaggcaaaaatgctcaaaaaatactagaaaacagaattctgcaacatattaatgtatgataagccacaatcaagtgggatttcttcttggaatgcaagggtgactcaacatagcaaagtcgatcaatgaaatacaccacattaagagaacaaagaagaaaaaacacacatgattatctcaattgcagaagaaaaagtatttgacaaaatgcttagagtagtcaaaactgtaaagccaaaaggtagaccagtggcttccagggactgggaggaagggagaatgaggagttactgtttaaggggaatagagtttcagtttataaaataaaaagagtgatggagatgaataatggtaatgtggttgtacaacattatgaacacatttaatagcactgaactgtacacttaaaataggctgataaattatatgttatgttcattttaccacgataaaaaatggagaaaacaacaaaaaacaaacagtatggtactagaataaagacagctatataaaccaatgaaacagaaaacagaacctagaaataaacccacacatatgcaatcaaattatcttcaacaagggggctaagaacacacaatggagaaataatagttgtttcaacaaatgaatttggaaaaactggttaccctcatgtaaaagaatgaaattgaacccttaccttgcaccatacacaaaaataaacagtactaaaaattttaacaaagacctgaaactataaatcctatttaagaaaacttaggggaaaattttataacatttgtcttggcaatgattgcttggataaggcaccaaaagcgtaggcaacaaaggcagagataataagtcgaactacaccaaactaaaaagcttctgtacaacaaaggaagcaatccaacagagtgaaaatgcagtccacggaatgggggaaagtatttgcaagttgcaaatcttataaggggtcaatctttaaaatatggaaagaactcctacaactcaatagttaaaaaaaccaaataaccttatttaaaaatgggcaaagaacttgactagacatttctccaaagacataaaaatgttcaacaggtgtatgtaaaggtgctcaccatcactaatcaccagagaaatgcaagtcaaaaccacaaaatatatcacctcacacatgttaggatggctgttatcaaaataacagaaaataaaaattgtaaggatatagagaaatctgaatccttgagttgtgttagtgtgaatgtaaaatagtgtagcctcaatggaaaactgtttggaggttcctcaaaaaaatcaaaaacagaactatcatctgatccagcagtcccacttctgggtatttagcactaagaattgaaattaggatattgaagagatatttgtattcctatgttcattgcagtattatttataatagctaaaaattacaatgatacaatgtggatgaaccttaagggcattatgttaagtgaaataaaccagttatagaaagaaaaatactgcatgatctcacttatattaggtattcaagtagtcaaactcatagaagcagaaacttgaatagtggttttcagaggctggggagagttgctgttcaattggtgtagagtttcagttatgcaacattaaaaagttctaggtatttgctttacaacaatgtgcatatagttaacaatactatactgtgtgcttaaaaattttaaagggtggatctcattttttttttaccacgataaaaaggaaaagaaaaatgaactggaagtttggaatagaatatcagctgtgatgcaatatgatattgtggaaagaccgttcgttgcactcatgatgccaagatctggatgaccgtcttgctctcatccttatgaactattttacctggcacaagttacttaagctcattgactattttaggactattgtgagaagcaaatgaaataaactttgaagcagcagcttttaatatgagaaggactaatgagcgaggtttgcacagttgggcttcaggaggtgtgtgaaccaactaaaataaaacacaaatgtgaagggtgggtgtggattcatttccatagctctctcttttcagagtcacaagtgaatctctaagataccctcaaagactcaggactattgctcctaagtgttacacaaatattagttagatatcttgtgagttaattaagttattcagaaagatggtgatttagaaaaatgctgactatgtaaacgagattttaaaatgatgactaagtttttttttctctttttcttcatttctccaccactttgccttttaggagtaattttctttcagtttttgaggtagaacccaaatgaatgcttggaattttttttcttttttcatttgttttgttccccatactactttgcagtgctttatcagcatgggtgacattaggaacattcagggggaaaaaaaaaacctgagtaaattaaaattgtcagttgctggatgagaataaactacaaaagacaataaataggcagtgaactagatatagtgtccttggacttacattttgcaacgtagtagatgatatattgtattccacatattttttttaaactctctgaaaaatagagaatctagaaaagaaataacttctaggaacttcttttatttatatagctaaattgtttcatttttctggctggcttttctccgaattcagttctggtgttactatcttgaatcaaagcaaaatatttactactactgagagaacatgatattattccccaaaagctaatattaatgaaaagaatatggaaaagattatgaaactataaaatattaagttataagtgatattttaattatatgaagtatgtaatatattcaatattataattcattgccatcttgaaatcatttataattattacattttaacactttgtttctcaaagaatgctcattatgagaaggatattttatgcataaaagtctgaaagcacatcatgtcaattataaatgcttgactcaagcaagagtcagtgctcttctgtcacatgaaatgtgcctttctcatcattgcaggccttttccacttccggccactgaatcacatggaaaataaacaacaaggtcaacaaaatacaaaaattaacattaaaacagaggccgggcacgatggctcatgcctgtaatcccagcactttgggaagtgcccgaggcgggcggatcacaaggtcaggagaccgagaccatcctggccaacacggtgaaaccacgtctatactaaaaatacaaaaattagctgggcgtggtggtgcatgtctgtaatcccagctactcgggagactgaggcaggcgaattgcttgaacccgggagtcggaggttgcagtgagccgagatcacaccactgcactccagcctggtgacagagtgagactctgtctcaaaacaaatcaaaacaaaacaaaaaaagattaaaacagaaatttcagtgatttattttttcatcaggcttagaagaatggagatagaaaaagcaagcagattcccaattatggaatgccttctatgtcctcttgagtctatatgtgtatattcccagttagggaatccacttacctttttctgtctgcattcttacattccttacatttattcattcacaatgtcacgtgtgtgtgtgtgtgtgtgttatttacttgtttcttctatctcaaattcttccagtatatactcattcttcttcctccaaccttgttttaaaaatatgcttcttttaaaattaagacatttataggaatcacattaactttcaattaattgctttgttcctaacactgaagtactaggggggttctgtttttggtaatgacagaggtatggttgtgctggaagttgatgcttttgtagttggaaatgtttaggagatagaacaaacttaagcagctatgtagataggtttaggacaataggattagggaaacagatccagatcccggttcctcagtaaacgagaacaggccagagtcaaacaagaatgaatgtaacattgacctggaactgaccttggactgaaaggtataggaggacttctgtttcatatactgagagcttcgtggctttaacgctacatttcagtcttatggaagaatacactgtgtcttgggaattccgtattcaaggctctaaataagaaactggcttccacatggacttttataaaatgccatgtattgtatgattccatttacttgaaatctccaaaaccagaaagtgcatagaaatagaaagtagtttagtggttaccctcaggtaaagaacaggagaaagggagtgactgttgagaatacaggtttctttcttaggtgacaacaatgttctggagttagatagtggtcatggttgtacaaccttgtgactctactataaaacatgaattgtacacttttaaatggtgaatttattaaattatatcttaataaaaatacatctagtcacaggttgggagctctatgcagtgatctctgtcagcagctcagctgaaattaaaaaagagctgaactttcaggtgtcagggagctgatgaaagccacaagtcgaaaatgaaagttaagcctttaatcacttactgctatgctgtaagcatgattcaaaccagagaaatctctgacagctcagatatgggggtggtctcagtgtcgagaaagcaccaaacaaaaaggctctagtagttttatgagccttagattagggatggggagcagaagaggctaggaatggaaaagtgaagtacaggctactgagtcagagtggtgaaaagtgtcttcgagatgtgccacacttcacagtgaggaggtctcagcagagacacatgggctaggtatgcaaatatgcaaagagaatagctagctagagaggactgaattctggcctgcagcttcctttcaacactgtgatttattacctgagcacaaagtctgggttggagagggtagctttctcctgcgaggcctgccgggtaaaaccttaggaattacccatggtcaggcctgaaaaatcatggataggttttcagtcaggagccagactcctcaatctccatatcaccagttgtttttgtggacatagccaggcatacgtttatcatcccttacattcactgattggattaccatgtaggtcatcatgtcattcttcaaaggaaaaggttctcttcgttatcttccaggtgggaaattaattcatacattgttgggcttgtctttaccatcaatgatttaagttgtcttaacacgcattatatgttctattatccaagtattaattttctatcatataattatcactgaatatttaatacatacccataccacgcagtagggtatcatgtaataaatgctctcccttttagagtaaggaatgaaaatcagtagtgtaggtaggaatattagaaagtaaattaaggctgggtgcagtggctcacacctgtaatcctagcactttgggaagctgaaatgagaggatcacttgagcccaggagttccaggtcaacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcaggcatgtataaataagcaattatagtatagtgtaacaaatattctgatgagagaaatggcagtgtgtcaaagtgctgcactggaacagctcttaactcagtttggcaatggtgggtaagtttgactgctttttaagatcttatccccaaattatgtaaagaaaataaaaaaggaggcaataagaaggaaagggtatctagtgaagaggaaagaacatgggcacacacctacaggtaaaggtgtactctggggtctaaacagattttaatatggtttgagcataaagtattgggggtaaaggactgatgaaagcaggagctagaaaaaagagataagaatgcaataaaggcaggctttctaagctatattataggaaaaatttgtcactaaacagggcaatgacataatcaaatttacatttcataatgagcctttctaacaccagtgccaagagtggattgcagatgagcaagagtgtagacagaaaagttactctgaaagctctgttgtgaattcaggcaatattgtagagttctaacttagactagtagacttcacaagacagcactatatatgaatacaagtaaatctttagaatttaatatttacgaggacaggtgactgggtatggaaggtgtggaaagagatctaaattttgaatttggacaactagttggaaaatgataccatttgttccaaaatggaacaaagggaaaataataggtctcagatgatgaaaataaatttcgaatatgttgaatttgcaatgtttgtgagaaatccaaatggaaatatccaatcacatatctgggtgtgtggctcaggagaaagatctgagttgtggctataaatttgtaaatcatcagcctataaggcataagaaatgtatgtcaatagatgtggccatgctggacaagtatgtatcagagaggaatgcctagaacaatgcccatctgaacacaaaaactttagaaaagagaagggggtaagtcaggagaaggctataacatagagaatccataagaaaaggtctgagaggtaagagggaaaccagaaaagtagtgtcaggaaatcccaggaaagagatggttggttatgagaaagaattagttgatgatattataaaaagggtgaggtcaggtaggaaaaggatgggaaagaaactagttcacttagcattaaagaagtattggtagcctaggcaagagcactttcactaacatgcttggattaaatccaaacatgagttgaatgaggaattggggtggataaagtcaactctaagttaaatgtttggggatacatttattaattttatattaccaattctatcttgaggaatttctcctccttttatatatcagtgagttgtagagatctctttctagtatagtgaaaatttccatagaagttgaaggtagtacatccttagttcatttgcggtagaatatggacttgaagacagccttactcagactttgaattgacagttggtataaagaagtagtgccaacagcatatcttttctggcagtggcattggtgacagcgttatcagattaggtggtataccagagtcagaagtccaagctgtggcacgtgcttctcagtaccagtatcagaaacaagggcagaggaatcctcatctactagttacctggcatgcttttgaacatagttctgatttttataaattctcttgattcctgctgatttccccagcctggctttgcaggatccctggaaattgctcactacctaatatcttttaaatatgtctctttctgtttaattaaaattcaatttctattgcttctgctaaaaaattttgactgatacacaatacaacaaaatgcacagacgtgtacagtttgatcatctttgacaaattcatatacccatatacagtttgatcatctttaacaaattcatatacccatcaaacccctatcaagacatggaacattgctatcaactcacaaagtgtgcccaataagccactgcaccctgaagcaaccagcatctgatttttactaccatagattaattttgcaggttctaaaacttcatataaatagaagcacacaatatgtactgttttgtccctggcttctttaactcagcatgaagatttgaagatttgtccatgttgttgcttatatcaatgctctgtgtatttattttactgagttttatttcaatatatgaatatatcacagtttatttatatatgtgtattaataggcacctggttgtttatttccagcttggggctattaggaatgaaagtgctataaactttcttgtacaaggttttgtgatgatttatttttttcttatttttttgtttttacggatatgtcatttttattggataaatacctagaagtggaattgctaggcatcatgataggtgcatgtttaacgttttaagaaattaagaagcattgttttctaagttgtataattttttgctctcatcagcatgccttttcattttcatcttctcaacactgtaattttaggatcagattatatatttttaaatttaatttaattttaagttccagggtacatatgcaggacatgcaggtttgttacatggggaaacatgtcccatggtggtttgctgcacctatcaatccatcacataggtattaagccccatatgcattaactctttatcctgataatatgcttcccctaacacccccttgacaggccccagtgtgtgttattcatctccttgtgttcatgtgttctcactgttcagctcccacttataagtgagaagatgtggtgtttggtcttctgttcctgtgttagtttgctgagggataataccttcaagctccatccatgtccctgcaacagacatgatctagttcctttttatggcttcatagtattccatagtgtatatgtaccacattttctttatccagtctatcattgatgggcatttggttgattccctgtgtttgctattttgaatagtgctgcagtgaacacatgcgtgcaagtgtctttataatagaatgatttatattcctttgggtatatactctgtaatgggattgctgggtcaaatggtttttctggttctaggtctatgaggaatcaccactctgtcttccataatggttgaactaatttacattccctccaaaagtaaaagtgttcctatttctccacagcttcaccaggatctgatgtttttgactttttaattatcaccattctgactgacatgaaatggtatctaattgttgttttgttttacatttctctaatgatcaatgatgctgagttttttttcgtatgtttgctggatgcatgaatgtcttcttttgaaaagtgtctattcatgtcctttgtccactttttaatgtttttttccttgtaaatttgtttaagttccttgtagattctggatattagacatttatcaaatggttagatcacaaaaactttctcctattctgtaggttgtctgttcactctgatgatggtttcttttgctgtgcagaaactcttttttttaattagatcccatttgtcaatttttgcttttgttgcaattgcttctggtgttttcatcataaaatctttgcccatgcctatatcctgaaaggtattgcctagattttcttctagggtttttatagttttgggttttacatttaagtctttaatccatcttgaattaatttttatgtgtggtgtaaagaaggggtccagtttcaattttctgtatatggctagtcagtttttccaccatttattaaatagggaatcctttccccattgcttgttttcatcaggtttgttgaagatcagatgatcatagacgtgcagtcttatttctgagatctctattctgttcctttgaattatgtgtcagttttggtaccagtaccatgctgtttggttactgtagccttgtaatatagtttgaagtcaggtagcataatgcctccagctttgttctttttgcttaggattatcttggatatacaggctctttttttgtttcatatgagttttaaagtattttttttctaattctgtgaagaatgtcaatggtagtttaatgggaatagcattgaatctataaattactttgggcactttggccattttcaaaacattgattcttcctgtctgagcatggaatgtttttccatttgtgtcctcttatttccttgagcagtggtttgtagttctcattgaagaggtccttcactttccttgttatctgtattcctaggtattttattctctttgtagcaattgtgaatgggagttaattcatgatttggctctctgcttgtctattgttggtgtagaggaaagcttatgatttttgcacattgattttgtaccctgagaccaccctcaacatgccagatcttgactatctcagaagctaagcaggattgggcctggttagtacttggatggaagcagatattttttactttttttcttcagtgatttgaacattttgtatcctatgtagcaaataatcttctaacataaggtcaaaactatttttcctgtgtttttgcctagaagttttttaattttagcttttatgtttaggttcttcctcattgaattgctgtagtactcttgcgaaaagagtactactatatatatgtgggtttatttctattccattgactggttagtgcatccttttaccaatataacatctttctgattagtataactttataataagccttaatgtcaggtagattaattctcctaaatttgttttctttcttatcaagtttgtttgggctactttagaatcaacttgtctatttctataaaaaagcctatgcattttggttagaattgagttgaacctgtacatcaatttgaggaaaactgacatctaacaatattgtcttccaatctatgaacatgaggtatttgaggtattctcctattccttttagcataattttataatttcactgtaatggttttatatatctttcattaaattggtccctaataattttttgagatgcttttatatacaatatgttctattttacttattctttttttttcaattttttcattcatatggtttgtttttcactaaagcctttaacatattaatcacaattattttaaagtctttgataattttgatatatgcatcatatcttgatatcatttggtttatcccttttagagttctttttatcatttttttaatttagtgtcttataattttgtttttaatgatggacatcatgtcttagtttcaggcagtttctacggaattctgttttatagatgagattttctcagcatttgtgagttttttcccacaaggcattcacacactcccttgaatctgagcaaagtcatttaggagagattttctgtgctctttcaagggaaggtgactttaaaacaaattgatgcataagaaaacttcatatttatggcatatagagtgaaatttcattacatgtatacaatgtgtgattatcagttcatgtaactagtatatccatcacctttcctgcatcagatgacgtttgctcatggcataatggtagtgtatcctttcctgggaatggtgtttctttttgttttaatttggaaatttttctttctttcctttccttttttgatggagtctttctctgtcgcccaggatggagtgtgcagtggcatgatctcggcttactgcaacctctgcctcccaggttcaagcagttctctatctcagcctcctgagtagctgggattacaggcacctgccaccacgcctggctaatttttgtatttttagtagagatagagtttcaccatcttggccaggctggtcctgaactcctgaccttgtgatccacccgcctcagcctcccaaagtgctgggattacaggcatgagccaccaagcctggcctaatttggaaatttctattgacctctcttcaagatagactcttgtctatctggtcctcaaataatccaaccaaaagaatttcttatattcattatcatatattatatttctaacatttccttttagcttgtttttatagcattcattgctcttttagaatcctctgtctgttcactcctattttctattcctattttttaccgcaatgtgtggtaaatggtgtaatacatttatcatagctattttgatgttctggttagataattctaatatctgggatatcttttggtctctttatcttgactatttttcttttgcctattggttatgtgtcagtttcttagggctgctgtaacaaattaccatacactgggtggattaaagcaacagaaatttattttctttcagttctgtaggttagaagtttaaaatcaaggtgttgacagggacataatccttacgaaaactctatgagagttctttcttgtcttttctagcttcttccagtttgcttataatctttcatgtttttgtcttgtagatgcatcactccaatccttaatcttcacatggcatttttcgtgtgtctgtctgcatgtggtcatcttcttttaaggacatcagtcttattgatttaggggtctaccctatttcctgtgatctcatattaagcaattttatatgcaatggtgttatttccaaataagttcatattctgagttaatgggggttaggatttcaacatattctttacaggggagacaattcagttcctaaaagagttctggtttcttgtttcttctctggtaccatcacttttaaaaataaaataccagatatttgtgtaaagaaacacttaacactgaagtcaataatacctgtgccctagataggagatggctcaatttcttcgaggccagtagtgtggcaggctgactcaacctatattttatctggacctaattttgttgaagctttagttagattcacttctcaggcttcaaatggtctaaaagcagaatcacaaatttttccttagtacgtgcatgaagtatgcatgctggagggttttctcatatctcctactcagctcccattcttcagcaggcccagtgtacctgtgtctcaggttggatctgtctcggcactactgtattgtttctaaattttctcaagacttgtcaaaaagagtttgttagtgagctcagattctcagagtacaactattttcttctagccggcatttatgacgacttgctccttttcctgctgctctgccaaagacgaaagcatcctgagtctcttctagattgaatgccttacattttagattttgttttaaaaattttctttgcatcctcagttctttgctgggctttataaatcataattgtatataccattttgtatttctttgtaattgaagtgctcttgcaacttttctaaatcactttattgtagtataattaatatataaaaatacatgtttaatgtatacaactaagtttgaagatatgcatatagctgtgaaattattactacattctattttataaacacagctatcacctccaaaagtttcctctcactctcctaatttgttattacctattttgtgataacaacacttaacataagatctatctaccctcttaacaagtttccaagtacacagtacagtattgctatctataggcactgtgctgtatagtagatcttcaggacttattcatcttacataactgaaacactgtacactttgactgatgcctcactgttttcccatcccctcagtccctgctacttaccattctactctccgcttttatgagtttggctattttagattcttcatataagtgttataacatagtatttgttcttcttgcaactttctacatctttataagtagaagtcactgatatcctttttaaaggtcttttcataattatcctttaccttagatttattaagtggaagctgcattttttggttttatttgtgtataccattacaactaagaaacacaatgtacaaactctcagtcaaatttattgaactggagattgttagtaaacccctaataaattagctccaaatagctatgattgctttctttccaagggttgtgtatttgccacattggcataaatgtaaactagataaagaaagcattataaattattttgtgtgtagttacatataattcaaggtctcagtaggcaaagtaaccccttcccaacatcccaaaatatctacatcccaatcattgggatttatgttacctcatatggcaaaggaactttgtgacagtgattaagttagagccctgatttgtagagattatcctggattatgttggtggacccagtctaatcataggagcccttaaaagtggataaatttattctggcttctgttcatgggagatgtgattgcaggagggagagagacacaacattgctggctttgacaattgggagagggctataagctaaggaatgtgggtgatcactagaagttggaaacagcaaggaaatggattctccaccagagcactcagaaaaacatgaagctcttctgggtccttgatttaagttcagtgagacccatgtctgactgctaatctatagaagtggaagataacaaatctgtgttgtttgaaaccaagtttgcggtaatttgctacagcagcaatagaaaactagtaaaaggccagaacaacaacaaaaaattctgaatatcaatttgtaaaagttgtgagggtgaaattttaaaaagtttttttttcttattctcccatgtttagttcgctaggttagttttataagaaataaaatagaaagctggaaaagacattgacttttttacagacattacttttagagactaatatagagaaataaatttggtttcaaatttgaagatcacaagaaaaggagatctcataatatcttaccagcgttctatgccaccccccccccaccccaggacccgagcattattcttaatataacacatacatgttcttaataagattaacataattttagcaaaaaatttcataagaaggaaatgttgatgggtctataatagtggaaaaaaaggtaaacttagagttatgtaagattaaaaaaagaaacaaaagtaactgactttttgaaatactgtacattaaccgtagttattaaaatgtcataggtttctttgttacttcacaattgagaacattatactatttttccctttttcatgtatatcatttgaaaaatatttcctaaagaaactattgtttttcctacttaaattcaactattctgacaatatattaatactaaccccaaatcttctggtcattcttcagcaagtgtccagtttgtaggaatttttttttttttttttttttttttttgagacgtagtctcattctgtcgctcaggctggagtgcagtggtgcaatctcggcttactgcaacctccacctcccaggttcaagagattctcccacctcagcttcctgagtagctgggattacagtcatgtaccacaacgcccaactaatttttttttttgagatggagtctcgctctgtctcccaggctggagtgcagtggcgcgatctccccttactgcaagctccgcctcccgggttcacgccattctcctgcctcagcctccccagcagctggattacaggcgcccgcctccacgcctggctaattttttaagtatttttagtagagacggggtttcaccttgttcgccgggatggtctcgatctcctgaccttgtgatccgcccgcctcggcctcccaaagtgttgggattacaggcgtgagccgcccaactaatttttgtatttttaggagagatagggtttcaccgtgttggccaggctggtcttgaactcctgacctcaagtgatctgcctgcctcggcctctcaaagtgctgggattacagacttgagccactgggcctggcctgtaagaacaatttaattgcactccagttgtgcctaattcaattgcactccaagttttttttacaggcaatccaattatactctaaaatatcatcttcctgaagagcaaagaattaggatccttgaaaaacttgctcttttagttttgctcttgagattataataaatttcttaggaaaggtgctagataataaatttctggatatgtaaaaatactgtatgtataagctgtccaacccaggaaatctaaatatatagaatgaacgttatactgtttaatattaaagtgtttgattcttaaatatcctgatactagatgagaattagataagtacatgtactacaaatcacacgatgattgtcatttccacaaggttgcttaacatctttaattagtctatctgaattcttagtttaacatatatacttaactataaaagttaaaataagaaagtcatacctagacttttttgacactattttgagaattgacacctgaaaacctgctattgaggataaaagaaaggggaacacacttaaaaaatagacttaattactaaagtcaaataatctttgattctttataataggggcaaaaatttttatacctttcactttcccagggcagtatgtagtatgctttattacggaccatatcaaccctagtgctttcatctctattatatcttcatccatcttttcaaataactctatcctaggttttgtcataactctcagtacccaatccactggccataagtcaagagcttaccaactctcatactcttagtacacattttcttcttttccatggtatattatctttctctcccttctgttctgtccctacttggctaaatccatcagtcatcacttcaaccaacctctgccactatctctagttctttggccccactgatctatcttcattaatgtagctgtttaccaagcaaacttctcttatgcaactggaaagccttgagttaatattaatgaatttttttcagttccatgtctgcagtgattctcagcaagccttctttggccccttaattatttacgttttcttcatactagcaatttcaaagtatttctgctccccataaactaatgacatagccaccatatttcattttattctcatcccatcacttaattcttcaaaagtaaagttaaaattgccttgagtgaagttactcaacttcccaccactaaacctgcacaaatgccttcatctatttcaatcctttccagttttccctttaacttttcacactttaaagagatgtattctttcctacttaatgtttcttgagaatattgctactccataagttttctttgtttttagttatacctccaacttctttttttccagatgtcctttattgagttcttaaatacgtctgtttcttctacattagaattgataacagtagtagtataatcaaaccaaaccttcaactccacattccatttttagatctgtaatatttaatatggcttaagctgcaaattagagtaaccttaacctaaaatgaatttaaaaattttaaaaaaattgtgcttgcctaacaggatttccaggaagtcagtgttccaactctattccttttgtgatatgttcagttctgccctcttctatattttggttttgttattcatggtcaaagatggctgccattcacagctaaagcaacatctgctttgttaatatcaagaaagagggagaggtaaccgctccttcaactataaaaaaaattatcattccctgaatagggtcatctggtgccctaggatcagtagtagtcatgagatgttgagatgattgacatatctggagcctgtaccagtcattggcaagaggaatggaattgctgtgatcaacttagcctactcaggattcttacctggagctcttggtagggataacatctcctgaatcataacgatgatgtaagggaagtctgaatacttaaaaattgaaacgtgttattttatcccagtaaggaagaaagtggaatacttgataagccaccagtggtgtctattacatgaagaagcaaagggaatgaagtaaacttaagtgcataaaaatgacttctcagaaaagtacagatccagatcctatggatacccaaattaattcctaatttattgcttaaaatagctactaggcatgctgactcctgtttcaccctgtcagagggactttgaataaaatggtactagattattaattatggggactagtcatgtacttcatgctctctcaaagcaatgtctagatctgtccttgctttggctgctcttcagccagctctggggtctggcctcatcctgcactccaccctcccaaccttttagtgagaggtacttttaccatctgcaaaggtaaaagagatacctttactatcacatggcatcacatttgccacatgatgtctctatcaaattcaaattaacctacccttaagggtaactgttgcactatctttagtctttctgattccaggtctcttcccatttttctctgacttgtgtgaaatatatacactttccttatatttccaggcatcttctcctcttggggaattgtacctttttctcttattattcctattttctggacctaatgttttttcaactatgtggaatctggtgttagtttcaagtagaaccttcctatgtatgctagtttaccaaagcaggtccaaacatttttcttttctttcttttttttttttttttttggtggtgagcgggggtgaatctcaactatcttagggaattccttttgactttggatttaagaactgagggaaagcatttagctctttgtgtatttgcaaaggagaataatttatgtactattacctttgtttccttcttattttcccaactttgagaactctattttgtttcctgaaactgcctgtatgctttttttgccagagaagtcatcttataaatacttggctatctataatttggcaatgataaaactaaaacagaaaatagcacacacataataataaagggtggtttggtcacaatcaatttctaatagtatacattaccactagctgtatatcatattccacatgatactattggtagtccacagaagactagacatttgctttacctgaaggcccatgtcaagtcattgtcagaaaaagccctgaaaaataatataggcttttacaaaattgccttctgaagtggtggcaacagagttacattacagacattatatgttactcagcaaaactcctttaaggtcttccttggttgagcatgtcttcctcttggttcctccattcctcaagccttccatcttcatagttcctacctccccttttttaggcggatgcctctgccttctgagaagctatctgttagtgtttgtctaagtcttctccattatggagagggaaaaactatgaaaacttatatagaatatttttgtccacatcacccaatgagaaataatttgctttttatagaaggcattaatagatataagatatattaccttgataaaataaaaagaaaagcaaaaagttgatgccctctcctaatcccccccaggtttcttcctgccttcttaatgctttcatgtgtagctctgctatctagagtgctcattctcctaacccctcccctgcccatactttccccatggaaggaaagaataccttcctttattccttacaaatgactaaaaagtctttagtcctgctcacaacagtatttaaattcaaacggaaagcggtattttacattaaggagaaaaatctttaatttaggacttttgcatatccactctgtacctagggaaggactgtgcactgggtaaattttctagaacttctgaaatcacattacgtggacaactttgtatttgcagtttggtcatgaagaagactgctcttgaatgtgttcattgaagagctttttccttctgtgattgtcttttggagcatgaaagtcaaaataccaaagaatgataaaacttaatcaaaatttaaattactgtttaagatctccaaaatccttttggaaaataatttcatagtacattttataactagagcaaaaagagctaatagaggcacgttttctatagcaataactacctcctctgtgttttcacctcttcagaggctaataacactgtcaaattgatggaaaccttcctgcttactgaattatagcacctccatttacattagcataatatatgccaaaaatgaaatactatctcatttcaaagtctgtgggtttattttattacttgtagttgatatttcttgtactctaaactgtaatagtcttcagttttttttttttaaataataaaaaaaggaaggaaagaaagagggatggaaagatgaagggaaggaagaaactgttttttagtgttcttcctcccatggtagataattaataaaaacattgatactaaacaatgatgtaaaagattatatggaaacagggaaatctcaaaaagaaaccaaatatttatatagtgaggtatggtacctaatggaagagcatttaagaagaattatgtagttataatagtcgtatagatatgtagtaccaaatgtaacaacttaacatgattacttcagcaactttcaatgaagtatttgtttcaaatattctttgatccctttcaaaaagaaattacatagctgttattcaataaagataatcgaggtaggtggaactgaaggttgaaattacaggaatctatattggtcataacacagaatttttgaaagcttcacaacaacccaaacaagtggttatggtaggttttaccacattttacagatgagaaactgaaggccagggaattcactgataaaagtatgagagggaactggcagtgggacattgactcctactctaactttagtgaaattctcactatgccatacttttattttttgcagatagatgttctaaaagtaagaattaaatattctcatgtttgtaatttttctcaagcaaactttcattatctcatttaactctgggtgcttctgtaaaagagttctaagaactgtgggagctttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgctgtgtttggttttttgttcttgcgatagtttactgagaatgatggtttccaatttcatccatgtccctacaaaggacatgaactcatcattttttatggctgcatagtattccatggtgtatatgtgccacattttcttaatgtgcacatgtaccctaaaacttagagtataataaaaaaaaaaaaaaaaatcttaatgacttaggaagaatcagagtgaagattttgaagcctttttatatataccatgagttatacagtcaatacatttttgaaggcagagtatctatatctattattttttttaagaacacattgttttacacaattattttacttccagaaacctatgccacagaagacttaacaccctggacaaaaaaatatatacgtatgaggaattttgcataattgtccatagtgaaaatttggcaacaaccaaaatctcacccccaaataaatgattaaagaaaaatatatttatacagtttatgttgtacagttacacaatggaattagctagttctaatgaaaatgaaagattttcttcagaatacagttagtgaaaattgccagttggagaacatatacaacactacttttggggaaaaaaatatgtaggtgtatgtaaatagtgaaaatattttaggcatgggattttggtaatcttcataatctacatgttaggagtgaagttttggtaatcttatgtagtctacatttgtacatttttgtattatgaagagaaactacagagaagtttgcattgtcatctcattaatataatttttaaaatttaaaaaggcttctctgagattgcaagaggtgagtgactttgccacaggtttttagaaaagtagatgactacacgcttaacatgttgttgaggtcatctatgcatcagcaatgggaggttcaggtattatctggtgtccttctagttctaagactctgtgatgctgagagatgggagagatatgaaatctgctgtgctgaaatggaagggcttagcttactcgtggcactccaactgcaatttagaatttcttatctcactccttcttcctggaccgaatcattctcactgtcccatcatattttaaggaataccattaggaagtcactaaagatttcactttttaagatttcactttttctagcacaactagaaacaatgtgatggatttgagttcttaatttaaaaattgtatgcttcatatagttatctagtccaaaaatattttacattgtatgtttataactaaagtgtatcttgttctccctccaccttgtgtagtttatcagtaaaaccaataaagcctactgaattaacagacatataatatcacttacaataaaagtaaatgtactttttacttacagtaaaacaatacaattttacttacgataaaattgtatcacttacagtaaaagtaaatttgtaataggaaaactggaaaataaatgcacagcaattatttctaaaaaaaaaaaaaaaaaaaaaaaaaaagaactgtgagagctccgtgatagaactatatgctgtttgctctctaagagattccaatataatggaaagaaaagagaagcacatgtcctaaagttcttacacctccattgtactggaaacttgtgcaactcttgaacaagtttattattttttttttgtagctaatgtccctacttttatgctcccttgagattttttgtatggtgctatttatgatatccacatgtattaagattatttgtaattatgtttcaaaattattttcaatcatgtcttggacttgtggaatgtgaagattagttcctattcatcctagttctataaggctaagtgtagtgcttacaacacagtaaatgttcagtacatgcttgtgtttggtatatatttattattagaaaggtctatacctctcatataaaattcaagcaatatggacgtatataatgtaaacagttaaactttacatgtctttcacccactcctactgctctcaggtaaccatcgttagcattttgattcagaactacttagactttttttacatggacaaatacgatgtgatttttgaattcataagttaaattcataagacgcactgagaatcaaaaatattctataagctgaagacattatataaaattaaaatattattttatgattttaaactacttcaactgtgttctgtagaaagaaaacaattgaacaggatgatcttaaaactttgatagttgtatagattatcaatagtattttacatgttacaccaaaaatattcatttcatattaacattctaatttatcaggacaacacactaaattttagttttctcattatcagacatcactttattttcacatacattggaatattattggtcaaacttttactctagtaagagctgacatttctatttattaggttctaaactagtgatttataaggtatttctgctttgcagagtattcccattcagtaatggaaataatccttggtcctttgagttaacatttgaaagtacataattaataaatgaacattaagaactttatatctatatttactattcttcaaaagaagtttagccaggcgcagtggctcacacctgtaatcccagcactttgggaggccgaggcgggaggatcaagagactgagaacatcctggccaacatggtgaaaccccgtctctactaacaatacaaaaattagctgggcatggtggcacttgcctatagtcccagctacttgggaggctgaggtaggggaatcacttgaacccgggaggcggagtttgcagtgagccgagatcacaccattgcactccagcctcggcgacaagagcaaaactccgtctaaaaaaaaaaaaagaattttatatatagacagcaattcaaatgtattttttagttttctttatttctatttcattaatgtgcttgactattgatagtcttgattaaggatataatatttactctatttctctgacttaaagaggaaatatatgctcctcattctctatgctacttagtgattttaatttttctcaaggaaactttcatcgtcccatttaacatttgcgcttctgtcgtaaaagaatgctaagaactatgggagctccgtggtagaattatatgctgtttgctctcagagagcttgttagaattttggagtttaagtggtgactttgacctaaaggctgaacatcaaattacaaatgttattacactttagtgagtattagaagaaagaaaaaaatggtacattattgagaattaatgaattatgattgaactaaatggattttagctagccatacagaaactgtgaggttaaaaacatggatttttctgtttcataaaacaacttataattatttgctatcatttaaaattttggactataaataaataaactattaccatgtaatttaattaaacttggtatgacaaacactttgtggcctcagatagaagatgatgtagagctatgcaaactgtgtattcataaaacatatggcagaaaagctctatgaataatagttgactaagagcttaacatatgtctaataatgtgttcagcatagattaatgggaaataaatatattgaaacaatatatttgatatttaaaaactgatttgagctgtgttctaattacctcattgtgccttaatttaatagtgtataaaaactgggaataatacaataaatttattgaggaatttgcaattagtaatagttactagagttaaaacaattctaataatttcatgtggaaagtgataaaaatgatataagtggtatggaaacaaatgaaggttatttattagtaaaattgattaccaacatttttgtgtgaaaggtctaagaaaatttacataatcaatattaagtttaatgtctcatatccaagtcgagtactagtagttaaatagcgttaggaaaaatagctaatgtatgctgggcttaatactgaggtgatgggttgataggtgcagcaaatcaccatgacacacgtttacctatgtaacaaatctgcacatcctgcacacgtaccctggaacttaaaataataataaagaaaatttaaaaaatacaagacttcatacttttctgaggataaagaagtagaagttgatgagtgataatggtattgatgctttctatttgcttttgaaactataagatataaataaatagaccaagagctactaagctactatttactgaatttttaccttattctaagtaattttcatatattagcttctttcatgacttgggtttagatgtgtgtgagaaactgaatgaaatataatatagctacaataccaaattcaagagaaatttggtgaggtgagcttggagataggaaggctgtagattttggatagccatgtaagtcatgtgccctttattttatgggcagtgggaaagcattgtgggttataagtatcaaattacattataggataaaatataattaaatgatttttaaattatatgaacaattcagatttgttttattattaaattggaaaacatcttaaaatttttacagtaacctcatgataggtggaaaaggaatagaaatttatacattgtttttaggagtggcagttgatacaacaatttttggatggcaatattatactatgaaataaaattttaaaatcacatactcttttacataggaatacaacttctaggaattaaaaatctggatactatcacaaaaatttatcgtgaaaactatatatttgaagatgtccaaaaatcctagaagagcatgtcactacttgagaaagactaacatatatgtgcaaataataagaaagaatcataagagctggtgttgttgataggacaattggcactcttaggcactattggattgaatcatcattatattcacacagaataatttaacctttatgaaagatttaggtttgactcagcagtttcgatcactcattctaagaaatttattggattccaatccaaaaatttaagtacaaatgtgctattgtaatgttgtttatcatagcaactaaaaattaagagttaaataaattataatacattaagcagctgaattttatatagtcaatataagtatttatagaagtaaatggtcataataacctataaaaaggaaataagctacacaatcacatttatacaaatctcatatgagtaagtcatatatacatatgtatataaatataaacattatgaaaacttatgctaagctattggtaatggtaaccctgtgatgatggaattttaggggttgttattgtttttgtggtagtgtttatctctacttccttttctttctgtgcaagattctttgttatttatttaattagaaacactaagaaaattatttacataaattctatatctcatagccaatatccacagtgtttttccttttaggagactcataaattcttcccctagaggagcctgatatgctaaatttcacaggaaggccttagaatagactacatcactgggacctttggtataggctgacttaatccctctgttcaaaacttgcttcaaatattgcctagaatatactcaattattaataaatgctgaaaggaataagacaacatctaaacccatctctcagctcttatatttgtttttgtttgcttgttttatggatgtgacattgatgatatacttgtgtgacgtctttatgagtgattctcaaattattgtgcaatttccataggtagaatctttccatttatattaattctaagtagtataattccttctctctgtttttatagcatcatttgctttataaagatagatgaaaaacaggagtctgaacgtttttcctgttttctctgtcactgaaagaagaatgtcagtatacttaaagataagcaattgaatgcaaataatttggaagaaccattttaatcaccataattgtactgaagcacttaaaaatgcatgtatggaattgaaaaatagattaaaaatcctttcaataagtgtactcatttatttaattactttgaagttggaagtaaaaccatcctttctgtaggctatagtatttcactttgggttaacaacttagtaagatgaacaccatttttgacagttagtgtgggtcttgatgttttatcagcattttaataaatttgacttcagtcatttatgtgctttatcattgagattttccaatatcttattccaataagaatgactaatagttatgctcatttaaaaagtaatattgcaatgctgagaatgatcattgcctttatgttcagatttatctgagagtatgtgtggcatctttcctgaaaaatacacacaaggtgattattttgttggagacattgtttgaagaccaatttatgtgttatcttttatttgaaaagcagcttaaaaagacaaaccattccagcacaacattcaacatttgacagttcggctcagtgataaccttattcactcacacgatgtaatggttatttttgttgcaaaggaaccctccctggttttcttgtatctccattatactttgtccgtaagctctatgatgctagaatttccaaatagattgatttttcaactaaaattgaatgtatctacttattcactttcaaacccaaaatatactcacctatttttgcctcaaattctttttaaagcagggaagttaaaaataatttgtaaatccctaatttctccaattttcggtaacgatatcattatcatccaatgtattttgagtcaaaactgtggtattatttttattcttcacttttctagatctttcttaaccacttatattaattaaaatctgcccttcaaaaatgatctctcatcttttttgtcccctcagtattattcaacttgattattgctattttagttaccttctaattccacaacatcatccactcccttgttctttccccagtggagtacctttgttctatggccaaaattattctcataaattaatcatgaattttattattaagcatcactgatgattcatcactgcctataaaataagatgcaattttttggcattcaagactctccacgatagtttccaaaattatcttttcagctctataatttcacttctataaacttttaactcctcatctccaactctcaactctcaacacttatttaggttcaagtccagtggatcatttatcattctctgaacattttctttgtaaagaactgccgtcactagcttcaatgttctccataactcagaccgttataaccaaaagcatatttttggtgtaatattatatctttcatgaaggtttaatggattatttttcttttttttgttaatttctacctcttctgtacttatattttcattaatatatttaaaatattaatattagtcttctaacagttattataatatttgttttggtctgttttattttgtgggtgaaaaacaccaattatatacaatgtgagcataccagtattgtgtatatatgtacatatgcatcctcaagcatctatgtgtatggtctaagtgtgtgcatgtgtgtatatgcatagaggtagaataatgaaggtagcttaagatgtaagaggtaatctttgcctgtataatgattttgtcatgggccaattctgattatgtcacatcagttgaagatgcacatcaagatgtctgaaataactttcttctgcctgttctgacctttgttgtctcactttaactcatcatccagctgctgcctgagtattttgctttaatctattctctactcagctaaattagaaatactattttagatgaaaatagcacataagtatccactgagaaatccctggtggtttaattatcactgattttttttagaagcaatttgaaatggtctccaattgtggttaatttagcaatgagttttcagtggtgtggacatagtaataagtgttaaaatattaaacaagccttcattttgattgccaaatttcttttagagcaaaactaatatagaaatccttacagtcaaggcttctttacaaatccaaacctggaatgtgtgtgtgggtttgtttttaaccttgcagtgaaaaaataaattcctcattaaagaaaactaaagtttgaaaaaaaaaacataaatcctttgcatataccccttatttttgaatcatgaggcatttttggtaaaagtggaaagcaaataatgtcacttatctttagtataacttctttttttatacaaagaaaatagttttaaggaataaaatggtacatcagattcaactcctgactagataatcataatatttacggaagactatttgacaacagcttaaaggatacacaaaataagagcattaaaccatgtaaaagggattagactagtgttctctcagcagtggtcagagttgcataaatctgaaacttgaatgggagaagaaatgtgtgcattctaatcctaaacatgaaaaatattcattctgaaatctacgttaaatacttcaaataaaaaagtatttataatatccatatgggttttctaaaatatattcttccaaaatataagtcaagcatggttaagacaggcccttatcatttaatggaaaggattaggagtgagtataaaaatgttttaagtcacgttttgcaaagtttattctgtggaaagtaagtcctacaaggtacttaatggaaaaaggtgttcatgaataaatgttttaaatattttgtacatattatgtcatcctgtattgaagttaaagcattcattaacatattaaagactgagtattttgcaacacattggaagccaacttttctcaaaattatttcagaacaagatagcttcccaagccaaatgtgtctttcttttttcttaaaacaccaagccagtattcatcgagacaaattctcagaaatgttgtttaaaagtgttaccaattaaaaacaaaacaaaactttacaggtttgtttgttacagaaaacagaattgaagtaagaactactttgcaatggctcatagtattaagtacataaaataaaagtgccaaggaatcccatagcttttgctgacggaagcaaatcgcactcactgtactgactgtgcaatattccatttgacttcattgaagttctgttttctcataaaggagcaacagttgtgcctccctcagtgtgttgaaaggatcatatacagctatttgttttaacagccctaaagtgctacaaaattttcaacttacatttgcctcacactgcctaataagcttgatttttcatgtcagttcaatttccccagtctgaaatgactattgtaaacatgttctcctctcacttctcttaggacactctagcagcattgttcatcaaacagcattgcttcctaattttcagtgaaaatgagtatcttttttttttttttttttttttttggagaccgggtctcactctcttgcccaggctggagtgcagtggcttgatcctggctcactgcaacctccgcctcctgggttcaagcgattctcctgcctcagcctcccgagtagctggaattacaggcatgagccactgtgcccagccgaaaatgagaatcttctgggcagtcctcagtgtctagctgccacatctctaaaactggcctccatcttgccagtgcttctcatctgagtgaaatgttggtgttcttttcttcaatcccaggaggtctgaatcccacgtctccaacactctaagatctttaagtaatttttccttctttagtattttctttttttttgagatgaagtctcactcttgtccccaggctggagtgcaatggcgtgatctcacctcactgcaatctctgcctcctgggttcaagcgattctcctgcctcagcctcccaaatagctgggattacaggcgcctgccaccgcgcccagctaatttttgttatttttagtacagacggggtttcaccatgttggtcaggctggtcttgagctcctgacctcaggtgatccacccgcctcggcctctcaaagtgctgggattacagatgtgagccaccgcgcggccttatctagtattttcattgagtttttctcctttagattcttactgtcaatattttgttattcctatcaaactaagataaacagtaccccaaacatacaaagcaacaaaacatgcaaacctttatcctgtacccgtcagctaccatcatacctcttacctctcaatgtcaaaaaattttaaaagagttataggtacatgccactccttctgcttaccttccagttactctgaataaataaattgccagtctggtttctgcacatacaagttactctcaaatttagttttaaatagctagctaccagtttgtttctatgtgacaactttaatatcctttgaaaaatacttatgaaaaactgacttcaagtgtctagttttctgtaagttacaaagatatatagtctacctacatctattgtaagcactagtaataattcaaaatgaaattctctaaaagatgttaaatgaataaagtaagatttattcccaaaatcagaatctcagagacaaggtaatgttaatgttgcctctttgaaatgctagtttcttcgctctgtggtccagtttggatatcccagaagtcataaagtataacgtcttaatacctccaagtatccattatctacctatataatttattaatgggccgtgcataaatgagacacttctcagtggattatgaatatatattgcttctcagatgtcttaggttgatttcctttttaaataaccagtacatttgaatttaaccacgtcttttgttcacaaacatcatcaaattcttaaatcttacattcaaatccaaactttagaaacttttcaaccttttacaaagtataataaagactgctcactgcatcagtgaaatgtgttttaagtccaggatgtattaaattaaagttcaagctttgtccttaactgtttattttttagaactctcttaatatcggagagtagttctcctgttgtattctaaaaagactcgctgaatttgaaataaaaattattttaattacagcaacaaaaaagtcaatattttcagcagttttttctgtatgagtttattcaagaagtgagtttttattggacataacttatatgcacattgtacagttttaatatataaatgactgtttaaatcctaacagtggcctaatttcataagtagtattttgaaacaaagtatctaggctctctgtaaatagtaagggctattaagaatagattccttttctgcatgttccctttcctggtctttttgggtactttgctttgactttttcctttcccttatgttgattatatcatttgttttaaacttttcttcccgaaatacttatctccaaaggcagatattgagatggggacaaaaaatgttgttggactggtagctaaagaacaaactatagttcagagaatatacttgaaatctcacaagataggtacattttgtttagtaactttgttatttagtaacttttacagcattatcactttgatcttaacaataactcttcgaaaaatacactaaaactatgccctgcatccagcaaatgagaaaacaaatttggataagataaacatctaagatggcagttgataagagacatagaattagaacacagatctgtcttaaatttcatgctctgattttcctgaaattaataaatggcatgaatctaaagctttagattacctaaaatttatttaaatttggctttagaatgttaatttattctctactggaccactattaaaattaatatgcattctctgaacatgtagcaaatgatgatgaaagactctgaagataattgagccgatgagaataaaaacctgtgcaaacttttaaaaattattgataagccccatttcagtatatcattatagataattgaaagttcattctcaaagtgtaagaaagttctgttcaatgtggtagttgtgagataaactctgtaaatcttactagtaatgagatgttatgtttagcaatgattaagaattgttattggcaaattctggaaaagaaattattttcatgatatgtttgtatctgtagattaatatatataagctatttacacagtactcagtatgtgaaattgtaatgtaattgacaaatacacaaaaaggttactaataccactagtcatttctacacttttatgtcttcccatcagtggcaaactaaatccttatgctttcaacatttttctacttagcatcaatatatccttcacacacaaaacattctgccttcaaaaaatacgccaatcctttaattagaaattacagacaattttctgtttgttcattcttgttcatatttctgacacttggtgatacggtctggatctttgtcaccacctaaatctcatgatcagttgtaatcctcagtgttagaggtggggcctggtgggaggtgattagatcatgagggtggatctttcatgaatggtttagcaccatcccctcagtgctgttctcatgttggtgagttctcacgagatctggttgtttaaaagtgtgtagcatctttcccctctgtcttgctcctactctagccacataaaacgtacctgcttttccttcaccttccacagtgattttaagtttcctgaggactccgcagaagcagaagccactatgctttctgtacagcctgcagaaccatgagccagatagcctctattcattataaattacccagcctcaagtgtttctttatagcagtgaaagaatggactaatacactttgtattccagatcatgaattgtgttttgaaggaaaaaagtcacataattataagaattttggaggatacgatatatcttaataaaacatctaatctattcaactccccccaaaatggttaaaaatttttattacagatctttcgtgggattctcaaatatttttgcatttttatttatatattatagtaatttaatttccataaaatttgcccattttaattctacaatgtaaggatttttagtaagtttacagaattgtgcaactatcttctcaacctaattttactctattgccattacccccgaaaaaagtccatacctattctgactttcaaccccaggaaacatctaatctactttctatctctctatatttgtctcttctggacatttaatgtaaataatttgtgttttttaatgtctgaattatttcattgagcataacgtcttcaaagttcattcacgttgtaacatttatcagtacttcatttctttttatgactgaataatattccattctatggatatacagtcatgtgccacctaatactttggtaaaggacagactgtatgtaggatgatgatcccataatattataatagagctgaaaattttccattgcttagtgatgtcatagctgtccttaagttgtagcacaatgcattacttatgtgttagtggtgatgctggtgtcaacaaacctgctgcacttctaatcataaaaaagtatagcacataaaattatgtacaatacataatacttgataataaataaagttactggtttatatatttactgtattatttattattattttaagtgtacttctacttattaaaaaaaagttaactataaaatagtctcaggcaggtccttcaggaggaatttcagaagaagatatggttattatgggtgatgacagctgcatgcatgttatttctcctaaagaccttttagtgagagaagatgtggatgtggaagaaagtgatattgatgatcctgacacgctgtgtaggcctgagctaatgtgtacatcttaagtttttaacaaaaaaattaaaattaaaaaaaaaaacattaaaatagaatcaaccttatagaataagaatataaggaaaatattttgtacagctgtacaatgtatgttttaagctaactgttaatataagacatccgtaaagttaaaaaattaaacagtttataaagtaaaaatgttacagtaagctaaggttaatttatcattgaacaaaattttttaaaaagaaaatttagtttagcctaagtatatagtatttataaagtctacagtaatgtacagtagtgtcctaggccttcacattcactcaccactgactcactgtctcacccagggcaacttacaatcctgtagttttcattcatagtgccgagaaaatgtgtatcatttttatctttatgctggatttttagcattacttttctatgtttagatatgtttagacacacaaataccattgtgttacaatgcctatagtatacaagacaataacatattgtacatatttgtagcctagaagcaataggctagaccatataacctaggtgtgtagtaagctataccatctaggtttgtgtaagtacactctattgatatactcacagtgacaaaactgtccaaggacacgtttctcagatcatattcccatcattaaacaatgaatggctgtgtaccacattttgtttattcattcactaattgttgaggaattgggcttttcccagtttgggggcattgtgaataagctgctgtgagcatttatgtacaagtctttgtgtagacatctgctttcatttctcttgggtagataactaggagtagagctgctgtcttatagggttaactgtgtttagcatatgagaaactggcagacagttttcaaactgcctatagcattttgcattcctttcagcaatgtatgagtgttccaccttctctcattctcatcaacatttgctgtctttcttttgattatatttcaatagatgtgaacggggcatggcattgtggccattacttgcattcccctaatgactactcctgagtaccttctcatgtgcttattgcccagtcatatatcttctttggaaaaatgttcaattcccttaaccatttgttgaattatttactcttttgttattgacttgtaagcgttctttatatattttagatataaatcccttatcagacttatgacttgcaaatattttctcccattctatggcattttttgtttgtttgtttgttttgagatgaagtctcactgttgcccaggctggaatgcagtggcacaatcttggctcactacaacctctgcctcccaggttcaagtgattctcctgcctcagcctcgctagtagctgggattacaggtgcccatcaccacacctggctaatttttgtttttttttatagagatggggtttcaccatgatgggcaggctggtcttgaacttctgatctcaagtgatcctcccaccttggcctcccagaatgttggtattaacagatgtgagccactgcacccggcctctgtggaatgttttgaagcataaaacttttaaattctgatgaagcctagtgtattgtttatttatcacttgtacttttaatacaatctaatgagtcagggagtgacccaagattatgaaaatttactccaatgttttctgttttataaccttacctcttatgtttaggtccgtgatccatttttatttaattttcctgtatgctgtgaaataagggtagaaatttatatttttacaatggatgcccaattgtctcagcaccatttcttaaaaagactattcctttcctattaaaatttcctagcatatttgttaaaaaatcaatagatcataaatgtaagagtttattactgggttcttaattatattccatttatttacatgtctgtcatcatgccagtaccctattccttactgtaggtttgtaataagttttgaaatggggaaatgtaattcctccaaatttgttattttttaaggtttctttggcaatttggcatctttgtatttatgtagacattttaggatcagcttgtaagtttttgcaaaaccaaaaaagcagagattttgatagagattccattgaatctatagaccaatttgtagagtattgccatcttaacaatattaagtcttctgatacatgaacataggatgctattccatgtatttaggtcttgtttaatttctttcagcaatgttttatagtttcgagtataaatttttcacttattttattaaatttattcctaaatattttattcttctggaatctattgtggatggaattattttcctaatttcattttcagtctgttcattgctaatgtataaaaatgcaatttatttttacatgttgattttaatcctatgacattgctgaatcaaatattttatgagagtttagaaaagcccaccctaaatacataatgataacattacagaaaacttagggggaaatctgtgagccaaccatcttgttaaaataattctgacattctgatgtaatttttttattttaacaaatttttgcacaactttgtaggatacatgtataacacaatacaatgtgccttctgtttttacatttattattgtattttatgtgtttttctataacagttttatagaaaatataacataaatgattacttgtcagagaagtaaacttgttataggacttatcagaatccataattgaggatatcaagccaaattgttttgtataaaagtgtttcagaataaatatatgggttccggggtcagaaatatggaagtcaatatcaataggaaacatataactactataacaacaacaaaatcagcaatgctattgtgaatagtgctgcgataaacatgcatgtgcagtgtctacccaaatgcccatcagtgatagactggattgaaaaaaaaaaaaaaaagaaaaaactgttttcagctctcacactgtctgttttactgtcttttaaaagttctttagttcacctatggctttcttaaattatgatgttgacagaatactttgacctgtataaagtatgggagactattgacctccttgttctggagattcattattttatttgctgcaatcttagcttctatgcagcaatattacagtctcagtttatacttattttgtgatcacctaatatcctggtttttatactcattaaatgttgttaaatcatgcttctgccatatttcttgtgtactttccttcatcttgtctccctatatttccctccctttctccttccctccctccctccctccctctctccctctctccctctctccctctctccctctctccctttcttcttttctttcttttgtctcactcttttgtccaggctggagtgtgggggcacaatcatagctcactgtaatctcaaactcctgggtttgagcgatcctcccaccttagcctccttgagtatctaggactacacgtgcacaccaccatgctcgtttgttttgattttttaaaaatttttatatggacagggactcactaagttgccgaggctggcatttattcttcctatgttttattgtgttgactttatcccacagtagtgtattctttaaaaatatctcttgacttatataaactaaaattaaataataaaaatagtcttggaagcaaaccagcctacaggtatactacatccaaaaatttctaaatctcataccaaatttgtagtgatgctttgtataaacataacgtcccaattctgcttgaactgttactacacttccacataatacagtagagtacgctgtgccaatattatgctatgctttctaccaagtgtcatgtgttttgccgcagcagaaaagattttagtcaaatcaaaaagcaatgaaactcaagaactttaccattatatttctagctttattctctcattgatgctatatttttgaaactttgatatcccatcattatcaccaatagcataaaaacaataatgccaatactacaaataataaaaatgtattattgaaatgtatatggattaaaacaaatgtgcaacatttgtaagtgttcatatgtcttcagatcttttctggcagacctggaaaatagttattgtcaaatcaacaatgaaaacaataataaactattaaatagaggagtgaggaaggagctttgcgtgtgtgtgtgcgtgcgcgcgtgcccacatgtgtttttggtggaataaatactttctctatttcctaatttatgattctactaatcaggtgtcttcaaaacaataatgtattccttggcaatacaaatctgaaagctgtcagtaaattctgtcatttatttccattgttttcaccacgtactaaaagatagaaagaacaagactataggagattgacagattgtccaggcatatgccacattagttccacagtcaaatatatattttgcaaatcataaggcacacagtcttttcaggattacacaatgaggcacagatctttacacactgtccaaacaaatgtcttccaagccaagtagacctatgtgctaaggttgatttcaaaaagagtacggtaaagaaaataagccaagataggagatcacaggagaaaatggaggttgacagatgaagcacaatggtaggaacagagactctgagatggaactttgagaatgctgaattttcaatctcaaactcatttacttatggtcataagccactgaatttacgtgtcaatatgagaagggatgaaagtattccaagcttggaaaaataactaagtttctgacgattgttgtgggaaccaattgtataatgtgaataagaattagtttatttgataagtttgagtttgctctattcatttataaaatcaggatgaaacactttataaacgccaagtcacattataagttatatataagacataggcatttacttaatcatagtgtcatttgaggcaaattacctacaacattttcaggtcaccatcacacaaataatgtctgaaaagaacctgagaaaagcccacttttttgtttgaatttattttctgttacaaggaaaagcttgagattatacagttgtttttaagttacttgagatggttttgaagaaatggacttgatgagagatgataaggggaggaatgttttagttcttgccatgtccctctctgattatctcctctgtggtcagaagatagggactggggtgaagatggcaatctggccaaagaggaggtgttagagactcattgcccttctttaccattttgcctaaaaccagccctccatctgattaacagaatatctgagaaagcaaatgtttacttaaaacccaaatgattcatgtctctatctatctatctatctatctatctatctatctatctatctatctatctacacatacctggagttcagtgtcttatcatgatctgattgtataacccaataattttctgagatagccaactattttttccagagacaatgtgagaaagaatagtttcttttgagaaaagttaaaaaaagcacctaccctaattctgaagacaaagaccataataaatgcttttaatattgtaccaaatgaaccaacatctgattccctaagaggaataacattaagagtattcatgatttaaaaaaggaacaaaggtgttaagaagaataaaatatataaactgtgattactcagagtttaatttgtacatttttgtgtggtgaattattcaaactctaacttctgtctctctctttttttaatcttaatgtcttcctttcaccacttgttatcacttccagaaaaaaaaagtagactaaaattgcaaaatagaagaaaatatagaaattatcaggggctgaagttactatagaagaagataaaaattattctgggcagctaccataactgaataggtagtaattggtctcatctggattatacttcagggcagtgtacgtaggaatcttttggagttttttttttgtataacctatatctgtctatgaagtagatatatctttataatatctgtgtgagtagaaataagtgaataacagaaaatttgagtaagccaggtaattccaagaaatgtatgtatcctacaagtaggacaatggacagataacctttaatagtcaattatagacatgagatagaaagtcccctggaatatggcaagatgacagattggacataatttgtaaaaggcagagatgtcccattccttgagagtgcataactcaagattaccctactaaaatgtaatgagagaataatgaggcatcataaatagaggagtgagacaaaatatcttgtgacaaagatttgatgttctttatcctaagggggaaaatacagaggtgagaagggagtgagagacagattttaccttggaattgtatcataagctagacttcccattgtctttctgtctcttctgagagactataagtaagctcaaaaatcaaagcctccagatagatttttttaaaagaaaaaaacgtttgaaaaaagaaggaaaacaaaacaaagcaaaatatatgaatagttccagggctcccaatccagagccgcgaggtgttcactaggttcttacctccaatttttgtcttctagcaccaaaagactactgaaaattttactctgtttttcagtggctttctctttaactttttttaaaaatgtattatgtatgtatatatttagaggaaggatctcgctctgtcacccaggctggagcacggtggtgccatcctagctcactgcagcctcaaactcctgggctccagggatcctcccacctcagtatatacaaaaataaacaaacaaatcagccagacttcatggcacaggccttgagtctctaactttttagctttgatcctttgcatctcagaattagaaaattccttgaggggagatccactgctaaatactaaattcatatccctgggcttttcctctttccagcctctccaactcttaatttttagtttctttgtcagtattgaattacaatttatatgatataaatgtttattgatgacctattatagatcaagtagtgggccacgtactaggggaaaattgggcacaaaaaaacagatgaggtcttggccctcatacaatttaaaatctgctagaggactcagacatagtcaagtaattacacaaacaaaagaagccgaatgagtggaaggaagtacatggtgccacaaacccatgccttaggtgattttaacttggttggggaggtaggcagaagattctcttaggaaataattctttatctctgactaaggatgggcaaggggtaagtaaggaaggagggctactaaagaacattataagggccgggcactgtggctggcgcctgtaatcccagcactttgggaggccgaggcgggcagatcacaaggtcaagagatcgagaccgtcctggctaacacggtgaaaccctgtctctactaaaaatacaaaaaattagttgggcgtggtggcaggcgcctgtagtcccagctacccgggaggctgaggcaggagaatggcgtgaaccctggaggcggagcttgcagtgagccgagatcgcgccactgcagtccagcttgggcgacagagcgagactccgtctcaactaactaactaactaactaactaactaactaactaactaactaactaagattacgagacaggaagcacagaagcataagccctgtgcgggatggtgagaataagaaaccaagagaagacggatgtgcctgaaaggagagagctctgggaaatttgacacgtgatgaggccagataggatgctggaggccaattcacgtcgtgcctcttaagccaaactaagaagcgttatcttcatcctcagagcaacggaagccattcaaagactttaagaagggaagaacataatgagaatggcttattggaaattttagctggctgtaatgtagctaatgggctgtagctcattacatattataataccaatgttactgttgaggagtataaatgtcaaagagattgtcaaatgtatttatggccacagagctaataagtaatggagttggaactcaagctcagaattctacttcctgacctggggcttctccctttaatcagagttgtctgatatgaaagaagaagagcacacatagaaagggctcccaggtaaacaccagcagtttgatttgattgtcagatgacaccaagaaaggagaggccagtcttggggtctatattttcaaactgggagaaaaagagagaaagaccagattggtggagaaactgatgtggcatgtgaggaatagaatactaggtatgtctaccctaaaggaaagaatatgtgggcggtgaaaacatggcaactgtcttcaaatagtgaagaatatgaatttatttgacagggcttcagagaaccaaccaaggccaatagagataagatacagggaagtaccttttaggtttttagaagagttatctgaggaggggtgttgtcgaaactgtagcagagttttcctattattgaaattatataagcagagctggataaccacttataataatagtgtagaaaatattcatcttttgggcagagaaacaaaccttctgatgtctgagagcccttccaactcctccattctgtgattctctgacacataattacacataacctttcaaatttcttaaagagaagatcccaatataaaaatacagtaaaatgtctataatgcaaataaacttgctcagagttcaaactatttttaaattttaaaatattttcatatagcaatggttgttataatgcctaaggcatggtaaaaagccaagttgtaggcagtgtagcaaattataaataccaggttgtatagtaaaacgtcattccttttaaaagcttactttagatataatggttattaattcttgaaaattagatatgctggaaatcgctttatatgtagcatatatggataaaattattattaggttttatgtataacttgattgctgatataaaattgatggtttctttgtcagcatgcaacattattaatgtgctcagcacacacatatcaatgttccaataaatactagagagcatcatcccactaaaacaaaaacaaaaacacctgtaaatgtttaagtttttcaagtgaaagatgatacttgcaatgtgggagattattttagaattgcttagtgaggcctggtttacaggcttgataagaattatgaatataacttttaattctgccaccagatggcagaagtagccattacttaggtaaatgtttacagttaaagtgctttaatatgttttacattattagattaaaccaaaacaaacaatttggatatttgtaatagcgtgtaacatgttttgtaatggtaaagatggaaaatattagcttaaatgagattttggaattaaattaatcataatgtttatgtatcccctgagaatagtatttttctttaataaaaaaactctcacaaggaattcccactgatatgttttaatgaatgcagtaaatatcttaattaattatttatacattaataattcctatatcttcctaaaggtagtcattggactcaatattggggtaaatttaaaagcattatgcacatgctgagtacaaaccaaagactaaagatattatatagttattgagttaaggcatggatgattttttaaaaagattacaaatgttacaaacgaaatacaatcacatgtacctaatacaaagttatttgcctttaataagttaaaaaataaaattaatttgtctagtctctagacaattttaaaacatcaatccaaagggatacatgtgtttctttactaaacagtaaatgccatggctaattaatgcgtgttttcaaagatcacggatacattagctgttttccatatcaattcacatttttgttgtgttgttttgttcagtcctttaaaaaaatctacttccttacatcccactgactctttaaccttctacatctggcttatcctaactatgacaaagaaaatagttttatccagtaaatttgactcttctttaccaactaacacactattttggtcctaaactctcagtattatgtgacaaagattactgtgtttttcttcttaaaacaggatctttccttgactcatttgcttccatactccttcatgtttttctttgcactgctttttagtctatttggagggggagattcttgtcctcgactccacctgcagatgtcagaaatcataggaccacttgttttcttttttttttcccctcaacatttccctacatagtgccattcattctgtcacctcccaatgttatctctatgatgaagcttcccaagtgcctatcccagcccacttctctctactgacctctagacttgtacatccaattgcctccttgaacaaagtctcttttattctagtacattccctttcttcatgagactgacttgatgaatgggctaggcacaatgttttaccttccagcaaaagtgtcgaaaatgtgctaaagtaaaaaccacacaacctattttcttgtcaagtgggaaaaagtaattgtacaggagaatggccacactatcatcagtttcatccagaagcaagatatttataaagggctttgaaaacttctgcttagggcagtaataactatatagttaaggtgtgccttaatttacagagtagacatattaggactaaagataagcttgagctaaattgtgttaattcataatgcattaattcataaagttctttgcagtgaagattcttggtttacactggttgttttatactgaaagacctgtcaacttaaatatgactgtgatgtatattttctatttattgtttcacctagctagtgacctatgataggccttggtgccaaatattctgcccaaatgaaaacaagatgcaatacagactcactttaaattagaatcaagaaacacggaaagaatgagacactggacaatgagatctacccatgtaaagttatggattaaattactgaagaggccatgagtaaagccacgtatgaatgaggctgttctataaggaagaatagtgtttgttaaaatgagtacctgctatgtgctgagtattgttctgagcacttgtttgcaggtaaacaagaacatttaccaagtaaggtgcatgttaacaagtaaacacattcaaaattttgtggaagaacattttaggcagcataaacaacaaatgcaaagatcctaaggcagaaactaaaaaacgaaagaacagccactcgtttacaagcaaacgagaacatttactggaaaacacaccttaaagaggaaagaatggtatagctatagtttagtgagtgagaggttatcagagaccgggggtataggaggatgagctcaatttctaaatcaaaaccagtaaagatttttaagaagaagttcatgtgatgtgatatgtgactactttggctgttgtatggaccatgggttgcaagcctaaggctaggaggatatctcagtgggaaacaaaagaaagcaatatgtattttttgcctcaaatatggcaaataggaaagattatgagtaggccaagtagatgacaggatccatgtagtactgttttgcttttgtttatattttttagaactgaggtatctttcatgtatatgtaggctaaaataaaggagaattagataaggagagttaaagaagcagagatagaagagtaaagatacagaaaagtgtctaatgatctaagatccttgttgaggtgtctacaattaaatttaagaagtgctggctcttgtcaggccccatgttctattggagttgtctcaagttgggctagaaattggaaaaaaaatgcacatcatagattaatggtagagttttattgaaaaaaggagaatctggcatgactgggatcagcaagacaaagatgtaaaagggcctcttgactcattatcattctacagtgcagcatgccaggagcagggcatctgctggacatgcatgttttcattttggtgaaagaatacctcacctctgtgtgtctccccattaacagagcaagcatgagaagtggccttgacagtaagggaatacattggatttatgtcatcgggaaatctggattttgtgtgcttgccaattattaggaattctctggggaagctagatattctctatctaaggaaataggaatctgaaaggtctgagagattctctgattcaccctggctaagagaagaagtctttggttctgtggaaaggtggacttgggtatgtactgtaagttggaaaaaggaaaaactcacccaggtcctagcaagctcattgtccatgcaacccacaggaaacatctaaggtcatttttagatatttctgctaataacacagtagctctaaatgaaaaaagaggtactacatccaatactagagaaaataattatataacaattaaggtatttgtggtgagaaggtgacaggagaggaggaatgtaaataactgatgttctcaattttcccaatgaaaacaagcagcaaggttacttgctgagaatgggagaggttgtgtgggaatattgtggaagtttaaaattacaattaaaaagagaagctaagaaaaagtgaaaagattgatgaacaattccaagggcccacatgatgcacttttatttagggggagacatggtttatcaatgttaatggtattgacatgcatgtgtttatatgtagatgtgcatgttttcctttaacaacattaactctgtttctagaaatcaggtgggaggctatataattgatttatatttggaatttttctagttgtatgtggtagaaggatgggattcatggtattcataattgaggaagctggtgagaggttagtttagatgataaaccatacaccatggcacccacgcatcgtacgaaaaggatagaagccctaagggggctgacaggtcaagaggaaagtattcatcaaaaagataatattctctctgtttaagaagttccatggatcagaagagtaagagagaaggatagttagaggcttttgtcagactatggaatgctggtatttacattgttttaaatagagccatttaaggtgataaatagaatataacattattattttgttgccaaagtagactgagaatagcatggacattaagaaggtccaggattttctggtttaagagtattggataattcatttacatgaatcctgaagccttctaaaattatagtgggagttctgatggaaagaaagagtatgaggtctcccaaattttggcaagtttaagtaatttattgaaaattcaaatgattgtagtggcaaggaagtagactcatatgacattatggcatgactcttcagagaagataagacattataagagatgacagttatccaagagaatgcagtcacccctcttccaccatatccaagtggtacaaatgtgaggacaggtgtcacctccttaaagaaagaaaaatctgctcagctaatacataagataatttgaagatatagaggacaattcagaagagtttgagggaaggaagtcaatacagcaggaggaacaagcagcaaagtgtatcaaaagaatgagagctctggggaaagactggtctttagtttcgtggtgcggaagtactagggtggggagcagaactaactacctagctcaaatattttgatattggtctaagttatttggttgcagaactggctgagggtctcaggtaatatctggctgtgttaaaatgtgtaatagataatatttcaaagttgtggcaattgtctgttttgcagaaagaccattccgatttggaacagtgaataggctcctggtgaagccaggactactgtgaggattgtggtgtagctgtttgatccttcttctgggttgtgtggaatgtggaaaacaagggtgtagtagtgatgaagggagggtctcctggaaaatttgttttcatattgacttttattaaattttaaaaggaagcaatagttaatatatacacttttacaaataattaaaatatacattaatattcagtttttacacttctgcttatttttaaacaaagatttctctctttgtttaacagtaagaacattaaggttggtgtctaatgtagctcttggaaatacaaaatctctttcatttattaatgactataattaaggtacacatttgctaagaccaataattaggttccataatgaacatactacagtaatcgttagctgtgacataaaacatgacaagatgagggtttgcttccctttctctttccctccagtttatattctctctaataaaactcttaaatcttctgtgtctgtgtatgtgtgtgttttgcacctaatatggaagactggtgtgctggcaggatggtgaggagagccaatggtctcatttaatgaaattggaagcttctctcttcttttgtttttcttctctattcctcaccatgtttcttctatacccctgtacatttcactgccaaccgacaaggcaatgagatgaaaaatacaacagagactagccagaaagagaataaggagcattgtcccaaccgtctgctgagaaagaaatgcattcttcccagctacggcattcagtcaggttagtggttgagaactgaaattatttttgctggtataatttatatattttctttatgatcctaacataaaatcagcactatggataagattgctgagacagatagctttaatatggtaagaaaaggaaaggcaagcagtgaggggtcaatcctggaaactgcaccaaggtggctggatgacacgggtacactcagctgcaggcgacctgagggagttcaggcaagcagagaacacagaaagagataatacataatcacagtttcaggggtaggaaatcttcaacaagagctaaaatgggcctagcaacaggagttagaagcatggtaaagaggaggtggagaacagagatggtgagattcaggctgccaggaagacagttttcagttgttacaggaacctgataagtgaactctggtcttacagaaaactgttaggacaaagtagaatcacagaatgagaggaacttaggtgcttgaaatcatgtcaaggcaaagtaccagagaaaaagagaaggaccaggatactggaataagtatggaataacttaagaagaactgggactcaggagtagagcaaagttttaagggcctatattatactgaattgcttttgcaaatgaaaccagagtgtggcagaggaagctatttgtctctgacctgatgcaggtctaagttagtagttggaggctaagagactcagctttaggttaatcggcaaagataaggacaggaaatctaataggttattacaaccaaaatatctttttaaaaagtgattagaattgagtttgaaataaaggtgattggatgattacctggtagcagatgtatgtttatttgtgggaggagggtgcagggcagtgcattagttcatgagagaagagactgcaacttacagtgttttggttccagaacatgctaggattttttttctctcctggtatctggaacatttggtatccaaataattttaattctgtttaacttaatagctaactttgggtttattcattcatacaacaaatatttagcattttttgttttattacatgtaactaggcaagtcctatcatctctaggaaactgggacgagtacttaaaactaaacatgttttgtttctttgctttgatgcattgtttcatatgttatcttttttttttgagtttcagataacctgaaagaaggttatgaggtttgtatgtgaaaaaataaagaataggatttttaaaagattaagaaacagccttcaattcatagtctaaatttgggtaagaaaagaaatgaaagttataaaattgacttcattccatgacttaaaatttcctttgagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttcaaagagaggcagggcacacctttagcagagcaatggagaaagagatggaaaccattaaaatgggtaagaagcaaagaataaacattttaatgaaatctcaaaggtcaaatgtaggctagtgtagcagaatagaatccctaggagtactggacataaggcacaaaagcacctccaccctccacaccagataatttccacagatttccaccatgtgctcaaaagaaaagatggagggcaggcgggagaccacagaggacaggcaagatactccacatgcttgtcacacccacctctcattgaagcaaaagctatcttctgctagaggaggacaggaagcactcctgtgccctggtccaggggaaaggtctgctgctattgggggacaggtagaagcaaaaattgtctgccaatgaaagaggagcaagaaacatgcccagttcagattcctgtgctgatacagaagcagaggcggtctgctgctactggagaaggaacttaaagggaaaaattcctttgagttcaaattctccagttttggaaattttatgcaaatggactcccatgagataaaacaaacaaaaaacacaaactctctccccaccatggcaagaagcacccacaacacacacacatcaaaaaatacaaaacagagtttagctgacatgaagaggcaggaaagaaattctgagaagcccatactctgaggttcagatgcacaggcctgtctaggatcggggctttgaaaagcagcagtcacaagcctgagacacagagggagaaagtgggtaggaggagacggaggtagggagagagagagatcggtagggtgagagagagactgaaagagagatgaattgattgattttaagaaatttactgacatttttatgggaacagtcctaaatttgcagatcaggctgacggggtagaaattcagggaaaagttcatgttacagtcttcagtacaaaatctgcaggctggaaacacaggcatggtttctaattctgcagtgttgaggaagaattgctgctgctttgggaaacctcagtctttactcttaagacattcagctggttggctgaggcccacctaattatggagggtgatctgctttactcaatgtctaccaatttaaatgttaattacatctaaaaatatacctttataacaacatctagatctgtatttcaccaaacaattgggcactatagtctagacaagttaacatgtaaaattaaccatcacaatggtcagtatcagaaaggatacttcagaaaaattattaagaataatagcccaagtgaagtggctcatgcctataatcccagtactttgggaagccaaggcgggcggatcatgaggtcaggagtttgagaacagcctggccaacatagtaaaaccctgcctctactaaaaatacaaaaattacctgggcatagtggcacacgcctgtaatcccagctactcaggaggctgaggcaggagaattgcttgaacctgggaggcggaggttgcagtgagccgagatcgcaccactgcactccagcctggtgacacaatgaggctctgtctcaaaacaataataataataataataaagagggacattacatgaagataagggggttaacttttcaagagaacataacagccttaaatatatatatatatatatccatagcttctaaatacatgaagcaaaaaccaatagaactgaaaggagaaatccataaatatacaattatagtaggagactttaacaattctcacccaataatcagcagaatatataaacagacgattcaaaaaatataaaaaacctgaatagaactatcaaccaacttaacctaattagcatttatagtacactccaacctacaataacagaataaataatcaagatattctgggcaatcaagtttcaataaatttaaaaagattgaaacaactgaaacatgcatgaatatgtttgcatcctgagagcattttattaagttaaagaagacagcaacaaatggctacatactatatgatttcattaatatgacattctagaaaaggaaaatctactgggacagaaaggttgccaggagccagatttgcagggaaggtaattgactgaaaagaacacaagggaatttggggaatgatggaaatgtcctatactatgattctagggtagttacaggactgtgtgaatttgtccaaacttactaagctatacatttataaagtatgaattttgttcaggtaaattacatctcaataaatgtgatttcttaagataaattcctttgagttcaaattctccaattgtggaaattttatacaattagactcccatgagattttttaataaaacaaaaccacaatagtgggttatcaaatacccaggtggtactcagggccaaagggtatccctttgggcccctttgtatgaaagccttgtccttcctttaactaccataatggcacatgttcactaactagatcaatttttatctcaaagtaaccacaaatgaaatgttttttaaaatattagatatgttcattaatttttacttattatacgtataacaattatttataatttggttctcattacctagagcacatttgtaacttttttcaatagtagaaataaatttacatgatattgactcataattgagggctataccttattttcatcaaaaatatacttagttggactgtaggctaattggaacaaagaattaggcagctcacatactcattaaatattctattgaagattaatatgcagaaatacacacaaaatattcaagctagatagattttcatgaagtaaacctagatcaagaaacaaaacattgtcatctcctggaatccttattttgcctccttgcagtagctaccaactccccatatcaaaggttcctgctgtttttgaaactttcataaatggaatcatacagtatatacttttttgtatgtgatttttaaaatagtattttgtgtgagttacatccatatcattacatgccgttgtagtttggtcactgtcttggctgtataagaatgcttttatatgaatgactacaatcattttcccattctgttgatgaccctattgattttgttttcagtttgcactagttcacagcttatagctatgaacattcttgaatatttcttttggttaaaatgcataggcatttctgatgggcgtgcttctaagaatgtaatagctagatcgtaggacatgcacatatatttagctttactctgtaatttttttcaaataaaatttatttttctaaatatgtcatttgtaataaagtgctaaattttcggcattaaaagatgataaattattacaaacaataccactatctatctgcttgacatcttatgagatacttatgccaatatccagaacatattttatatcttggtgtgataaaaagatagcctttacacatgtctcttatgcacatgattcctaaggcatattgttttctaggcctccagtgacacataactttgacagtgcatgataacaatgctatgttcatggattaaaaatatgcataatttcatattttattccccttaggaaatgttatcactgaacttacagtgaatgtagttgtcagtattccacctgtgaagcccaatattactgtaataaatgctctagaaatatgataattgacttctctgagtgccaagaagaatcagtagtcaaactagggcctgcaagaatgagcttcccctacagcaatgtaataaaattttccagggtcttagatggagtattttcttatagagcctgatattttaaaaggcaaacttataaaacagataaaaggaattatttttgtttatttaataggtaaaattacacagtacactataataatagttatataatgttccaaaaataatttgtcagtacatataatagtttttatttatttcttgatatttaacttactactttgtacaaagcatgcatatatatatatatatgcttatatatatatacttatatatatgatatatatatatatatatcacagtcagaatggctactattaaaaagttaaaaaacagcagatgctggtgagactaacagagaaaagatgctggtgagactaacagagaaacactatatacactgttagtgggaaagtaaattagtttagccaccgtggacagaagtttggagatttctcaaataatttcaaactaccatttgatgcagtaatctcactactgggtatatgcccaaaggaaaataaactgttctacccaaaagatatatatatacttttatgtttattgcagcactatttacaataggaaagacatagaatcaacctaggtgcccatcaacagtggattgaataaagaaaatatggtacatatataccatagaatactatacagccatgaaaaagaatgaaatcgtgtcctttgcaactggaggccattattccaagtgaattaacacaggaacagaaaaccaaataccacatgttctcacttataagtggtagctgaacactgggtactcaggggcataaagatggcaacaatagactgggaactactagagatgggaaagagggaggtgggtaagtgttgaaaaactactgggtactatataggctgactacctgggtggtgtgatcagttgtaccctgatcctcagcatcacacaatatacccatgtaataaacttgtacatgttctccctgaccctaaaataaaagttgaaattattaaaaagtaaaggaactggaaggcgttaaatgctgcctaactttgtaagcttctcttgtttcttccccatccccaagcataaagaaggactctctctgcaatttccttatctaagtaaacttctttccatgagaaatgcagtcctttaaagatcccctccataggaatctcatcaaattagcaggaaagtttaatcactggaaaagagaaaactaaaagctgttaccttgcgcagtagatctttcatcagttctttactcctggatattacctggtagagtttatctcataatatgacaaccattgttcacagtaaagttccacccctcaccttcctgccacctccctgggacctcagaggaactttatctcaggtcattgttttcttggctcattcatttctcctaaaaatcatttacttcccctgtaatgtttcctgaagtctctcactttcctgtcccctatgaagagtgtatatgagcctcaaacatctggctctgccttgggtctcatatttgcaggactgccaagtccatgtatatatgaataaactttgtatgccctttttttactactcatctattgttggttcattccagtgaaccctcagagatggtgaaaaggaagcattccctttcctacaaaggcatgcataaataaacatacattatatggtttggttctgtgttcccactcaaatctcatctacaattgtaatccccatgctttaagggaggaacctagtgggaggtgattgtaccatgggggtggttttcctgctgccattctcgtgatagtgagttctcatgagatctgatggtttaaaagtggcagtttcccctgtgctctctctctcctgccaccatgtgaagaaggtgcctgcttcccctttgccttctgccatgattgtaagttttctgaagcctcccccgccatgtgaaattgtgagtcaattaaacctcttctgtttataaattacccagtctcagatagtaacttcatagcagtgtgaaacctgactaagtattaaaagtgtacattcattcatctgtatgtttactcttttaagaaatactagttatgacttttatttcagtgaagtttctcttgaaggagtggaacatttctttataaaatagagctccaaaatgtgtagagatattgaataacattgttattttattcccatgattccttatttaagcaggccctacaaagtatagtatctgaacgcccaattccaatcagagagttttgcatttcttactattttcttcaaatgatattcaagctattttatttcctggaaaatgccaacatgaaaaacgtttggaagtttgaaagacttctctgataaaattctaagctcaaaagtggcactaattactagccaacattttatgtgtccatttgttaacttgtttatttgattattatctgtcttccttttcagaaggtagatgggaactattttatgttcactcttatattctcagttaatatcacaggtgttcaattaatatttgttgtgagagtaaaggaataaatgcacattctttgaaaactttttttttttcccagaagcgtctacttctgtcacccaggctaaagtgcaatggcacaattatagctcactgcagctttgttctcctgggctcaaggaatcttcttgtctcagcctcccaagtagctgggacataggcgtgcaccaccacactcagctaaatttgtttggtcttgttgttttttgtttgattgtttgtttggttggttggttggttttttttttgagacagagtcttgccctgtcactcaggctggagtgcaatggcacaatctcggctcactgcaacctctgcctcccgggttcaaacaattctcctgtttcagtcttccatgtagctgggattacaggtgcctgccaccacacccggctaatttttctaatttttcgtgtttttttttttttttttagtagagacgggttttgccatgttggccaggatggtctcaaactcctgacctcaggtgatccacctgcctcggcctcccaaagtgctgggattacaggcgtgagccaccgttgtttttgcttttatttatttttgagataggatctcactgttttgcccaggctgaagtgcagtagcttgattacagctcattgcagcttcaacttcctgggatccagggacctcctacttccagcctcccaagcagctgagattcctggcgcatggcaccacacccagctaatttttgtattttttgcagagattgggttttgccacgttgcccataaatagatatcaatgcctgtaaatagatgtaaatttatgtttgtatttctttattgatttttggtaaccttttttttgtgtgtgggaaactctttttattttgtcgtagcttacagattcttcagtaaacttgtattctttggtgatgggctccaagtattcaaattaggactggggtgatttttggcagactgcacaggaatagatgcttaaaaagtgctttttcagtttttataagcacaaaaaaggtagaaccttgatttgctgagaatgaagtgtgaaaaactttctaagaacatcatattatttaaattattttatgtctgcatttgtttttgtctacttaatctgttagtgactgcaataaagacttctaaataaattttaaatttgctatatatattttattctatcccatcagagatatatagatttatgatttaatatcataattatgattgtatctttcattaatagtaaatgacatttgtgaccatttttatctttttaatgtaattactaattgtataaaattagtactatcaacctaactttattttgtttacttatatgtataatgcttttatttatttttgcatgtaaataattattaaatgtgtactaagtttgcccattgggcaaggatctgggcataaaatgctccaaaaatataaacaactataagaaattcctttctgaaattctcataaatatttacttatctttttttcctccttaaaattcctgtattgcagttttttaataattaaaatacagacaaattttgttctgccggctattttcttttcctcagtctgtgaattcttgtcttttataggttgattaaatcttgtaggttcattcttctgtcatattgttttctatttttatgaatttgtgaaaagtattaaatttattttctaacttgtccttataaagtgttttcttgccttttattcttctccagtaaattgacaagcttatagcctctaattcttctggcagtttacgttgacaaaatattctttaacctatgttatttcatcaaaagttgaaagcaaaatgatgcaattttaaaattttattttttcataataaacagggattaggttgttattaagttcttttttaaatttttaattgtgtgtatagtaggtatacatatttatagggtacatgggatattttgatacataaatgcataagtaataatcacatcaaagtaaatggggtatccattctttcaagccttcatcttttgtgttacaatcaatttatgtatactattttagttactttaaaaagtacaattaaattctaattgactgtagtcaccatgttgtgttatcaaatatgaaatcctattctttataactaatttttgtaaccattaaacattaacctcttcccccacaaccacactacccttcctagcatctggtaaccatttttctactatctgtctacaagagttcaattattttaacttttagctctcacaaataagtgagaatgtaagaagtttgtctatacctgtcttatttcacttaacataatgacatctgggtccatccatgttgttgcaagtgatgggatctcatttttttgtagctaaatagtactccattttttatatgtaccacattatctttatctattggtctattggtggacacttaggttgcttccaaatcttggctattgtgaacagtgctgcacaaacatgggagtgcagatattttttccatatactgctttcctttgttttgggtatatccctagtagtgggattgctggatcatatggtagttctatctttagcttttaaggaacctccaaactgttctccatagtggttgtactactttacattcccaccaacagtgtatgaggggtcccccttcttcatatccttgccaccatttgttattgtctgtctttttgatataagccattttaactggggtgaaattatatctcattgtagttttgatgtgcatttcatcgatctttttatatgccagtttgccatttgtatatcttcttttgagaaatgtctattcaaatattttgcccatttttttgagtggattattagatttttcctatagagttgtttgagctccttctgtattctggttatttatcctttatcagatacagagtttgcaaatattttctcctattctgttagttgactcttcactgtgttgattgtttcctttactgtgttgaaacctttaatttgatgtgatctgatttgtttacttttgctttgattgcctgtgcttgtggaatattactttagacatctcttttttcctttatttcttctaaaaaaatgagatacatgtacagaacgtgcaggtttgttacgtaagtacacgtgtgccatggtggtttgctgaacctattgacccgtcctctaagttccctctcctcaacccccagcccccaacaggccctggtgtgtattgttccctctctatgcccatgtgttctcaaggttcaactcccacttatgagtgagaatatgcagtgtttcgttttctgttcctgtgttagtttgctgaggatgatggcttccagcttcatccatgtccctgcaaaggacatgatctggttcctttttatggctgcatagtattccatggtgtataagtatcacatttctttatccagtctatcattgatgggaatttgggttgattccatgtctttgctattgtaagtagtgctgcaataaacgtaagtgtgcatgtgtcttatagtagaatgatttatattcctttgagtatatactcagcaatgggttgctgggtcaaatggtatttctggttctagatccttgaggaattgccatactgtcttccacaatggttgaactaatttacattcccaccaaaagtgtaaaagtgttcctatttctccacagccttgccaacatctattgtttccagacttgttaataattgccattctgactggcatgagatggtatctcagggtggttttgatttgcatttctctgatgatcagtgatgttgagttttttgttttgtttttatttgctttgttttgttttgttttttgagacagagttttgctcttgttgcccaggctggagtgcagtggcgtgatctcggctcaccacaatctctgcctcccaagttcaagcgattctcctgcctcagcctcctgagtagctgggattccaggcatgtgccaccatgcccgactaattttgtatttttagtagagatagggtttctccatgtttgtcaggctggtctcagactccagacctcaggtgatctgcccacctgggcctcccaaagtgctcagattacaggtgtgagtcaccacaccacacccggcctgttgagctttttttcatatatttcttggctgtgtaaatgtcttctttcgagaaatgtctgtttatatcatttgcctactttttgatggagttgtttggttttattttgtgtaaacatgtttaagttccttgtaaattacggatgttaggcctttgtcagataggtagattgcaaaaattttctcccattttgtaggctgcttgttcactctaatgatagtttcttttgctgtgcagaagctcttttgtttaattagatccaatttgtcaattttggcttttgttgcaattgcttttggcattttttcatgaagtctttgcccatgcctatgtcctgaatggtattgcctaggttttctactagggtttttatagttttgggttttacatataagtctttaatccatcttgagttaatttttgtatgaagtgtaaggaaggggtccagtttcagttttctgcatctggctagccagttttcccagcaccatttactgaataggagatcctttccccattgtttgtttttgtcaggtttgttgaagatcagatcattatagatgtgtggtgttatttctgaggtctctgttcagctatactacaaggctatggtactggtaccaaaatggacgtaccttagacatctttgcccaatgcaatgacctggagagcttccccaatgttttcttttagcagtttcatagtttgaggtcttaggtttaagtctttaacccatttatattgatttttatttatggcaagagatagtggcctagtttcattgttctgcatatggatattcagttttcccagcactatttatggaagagattttcctttcgcctttgtgtgttcttagcacttgttttcaaaaatgagttcactgtagatatatgtatttgtttctgcattctctattctgttccattggcctatatatctttttatgccagtaccatgctgttttggttactttaggtctgtagtatagtttgaagtcaggtaatgtgattcctctaattttgttcttttagctcagggtagtcttggctattctgggtcttttgtggctgcacataaattttagaattgctttttctttctgggaaagtcattggtattttgatagggattgtataaaatccatagatttctttgggtaatatggacactttaacaatattcttccaatctatgaatatggaatattctttcattttttgtctcctcttcagtttcttgaatcagtgttctagttttcattgtatatgtttcacttctctggttaattcttagatatttaattttatttataactattgtaaatgagattactttcttgatttttttttcaaattctatactgttggcatgtagaaatgtagaaatgctacagatttttgcctgttgattttgtttcctgcaactctactgaatgtatcagttctaatggtgttttggtggagtcttggatttctccaaatataagattatattatctgcaaacaagtataatttgaattctttctttccaattttgaagcactttatttctttatcttgtctgattgctttagctgggacttccagcactatgttgaataacagtggtggcagtgggcatctgtgtcatattctagatctttgagaaaaagctttcagttgttcctcatttagtatactactagctgtgagtctgttgtatatggctttaatatgttgaggtatgttccttctattcccagtttttttaagatttttgtcatgaagagatgttgaattttatcaaatactttttcagcatcaattgaaatgatcatatggtttttttccttcattctgttggtaaaatgcattgcatcgattgatttgcatatgttaaaccatccttgcatccttgggataaatcccacttggtcatgatgagtcatctttgtaatgtattgttgaatttggtttgctagtattttattgaggatttttgcatcagtgttcatcaggaatattagcctgtagttttctttctttctttctttcttttttttttttttttttttttgatgtgtctttgtttcgtttaggtatcatggttaacagtggactcatataatgggttcggaaaaattccctcctcccctatttcttgggatagttttagagggattggtattaggtcttctttaaatgtttggtaacattcagcagtgaagccatcagttcctggcttttctttgctgggagagtttttattatggctttgacctcattacttactattggtctgttcaggttttggatttctttatgggttaatcttggtaggttgtatgtatctaggaacttatccatttcttctaagtttttgaatgtattggcatatagttgttcatagtatcctgtaataatccttttaatttctgtggtattagttgaaataactcttttttcatccctgattttatttatttgggtcttctctcttttttcacagtctggtttaaagtttgttaacttcgtttatctttcaaaaaccaactttttgtttcattaatcttttgtatttttttcctttcaatttcatttatttcttctatgatctttattatttattttattattctaactttgggtttggtttgctcttttgtagttctttaagatacatcatgaggttgtttatgtgtagtttttcttttttgatgtaggcacttatagctataaactttcctcttagtactgttttcactatattccatacattttggtaagtttagtttcaattatcctttgtttcaagaaatttttcaatttccttcttaatcacttccttgacccactgatcattcaggagcatattgtttaatttccatgtgtttgtatagtttccaatattcttcttgttattgaattgtagttttattccattgtgttcagataagatgcttaatattatttcaactttttgaatgtcttaagacttgttttgtgacctaatatatggtctatccttgagaatgatccatatgctgatgaaagaatgtgtattctgcagctgttgcatgaaaagttctgttaatatctgttaggtccatttgttctatagtatggattatcaaatgtttctttgttgattttctgtctgggagatctctctagtgctcaaagtgaggcattgaagtctctagctatttttatattggagtctatctttttatctctaataatatttactttatatagctgggtgctttggtgttgggtgcatatatatcatcatactgaattgatccctttatcattatatgatgactttctttgtcttttcttatggtttttttatgaaatctattagtctggtttctgtcggcatggaataactttttccatccctttattttcttcttatgtgtatctttataggtaaagtgtgtttcttataggcaacagattactgggtcttattttctcatcaatttagccactctatgtcttttaattggagagtttagtccatttatatttaatgttattaatgacctactctggccattttgttttttgttgtctagttgtttcatgtttttctcttctttccttcctctcttccttttattgaaggtgattttctatggtgatttgttttaatttcttgcatcttattttttgtgtactcattgtatgtttttagatttgaggttaccatgaggcttgaaaatatctgataatctattattttaaactaatgacaacttgacactctttgcataaataaactaacaaaaagaaaacttgtataagttctacatatactatgtcttgaaaagttattgtagttattatttttgattagttcatttttctgtttttctacttaacatatgagtaatctacacaccacaattacaatgtgataatattctgtgttttcctgattctttactattaccagtgacctttgtatcttcagatgatttcttattgctcattaacacatttctttctgattgaatgactccctttagcatttcttgtaggacaggtctggtgttgaaattccagagcttttctttgtctgggaaagtctttatttttccttcatgtttggaagggcctggctatactattctaggatattttttttttccttcagcactttaaatatgtcatgccattctcttggtcagtgaggtttccactgaaaagtctgctgccagaggtattggagctccattgcatattatttgtttcttttctcttgctgcttttaggatcttctctttatccttgatctttggaagtttgactattaaatgcactgaggtagtcttctttgggttaaatctccttggtgttgtataactttcttgttcttgaatattggtatttctctctagatttgagaagttcattgttattacccttttgaataaattttctaccccgtctctctctttctctctactacctcttttttaaagccagtgacttagatttgcccttttgagcctattttctaggtcttgtaggtgtgcttattcttttttattctttcttcttttgtctcctctgactgatgttttcaaatagcctgtctttaggctcactaatgctttcttctgttttatccattctgctattaagagactctgatgcattctttcgtatgtcagttgcatttttcaactccagaatttcttcttgatttttctttattatttcaatttctttgttaaatgtatttgataggattctgaattactttctgtgttattttaaatttcttgagtttcatcacaactattttgaattctctttctgaaagaccacatatctctgtctctctgggattgttccatggtgctgtatttagttcctttggtgaggttatgtttttctggattgtcctgatgcttgtggatatacttcagtgtctgggcattgaagagttaggtatttattatcgttttcacagtctgggttggtttgtacctgtccttgttcagaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccaggtagagactcttgttccctttgcttactttctcctgaatagagtccctctctctgtgctgagctgtccacagctggaggatgggtgacacaatcacccctgtggctaccaccactgagactgcactggcttaaacctaaagccagcatagtactggttctcacccaaggcccactgtaaccactacctggctaatgcctacattcagcaaggccctgggctctaacaatcagcagatagcaaagccagccaaattcgcatccttcccttaagagaaacaagttctcctgggctctaactgggtccagagttgctgtctgggagccagggcctagagtcagaaaccttagaaatttccctgaaaccgtaagacaaagttcttcccacttttttcttttgtgaccccagaaagatgagctggtgtcatccaccaccagctcaggcccacagggagtaccaccagggcattgccaatgtgcacataaggctcaagtgtctcatcggtaagcctgtggtgaatgctgctaggcctaggactcgctcttcagggatgtgggctccctgttgcccctggtaggcccagaaaagccatctaagagtcaaggcctgaaattaaggaccctcagagcccacttggtgcccttccccactatggccaagcaagtacctaaggtgtaagtcaaagtcccctttactcttccctctgcttttctcaaacagaaagaatctttctttctagccaccacagctgtgaatgtgctggatcacacctgaaggcagtgcatctcagaatctcacccaagtcccacagtgcatactacttaattactgctgctgaatatttagggcccagggactatttcatcagtaggtaatgaatccttcaaggaccgggtccttcccttcaaggcagcaggttcccttctggcccaagatgtatctagaaatgtcatgcaggaatgacggcctagaataagggcctcatgactttacccagtgcattatcctactgcggctgagatggtatccaagttgcaaaacaatgtcccctttactcttccttctcctctcatgaagtggaaggaaggggtctcttttggagctgtgagctgcactgtctggggttgtaggaggggtggcacaaggactctcttagccaccatggcttgtgtctttactaggtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacaggtactgtaatttcccacctgatttttggttcttataaaggtggtttttttgtgtagttagttgttaaatttggtgttcctgcaggaaggataattggtagaggtttctatttggccatcttgctctgcctttctccagtaagttgttcttttattagtaaattattattttcatgtaaaatgtgtaattcattgtgaaaaattatgagttaatttttgtcttctattttggttccacatttacaccaactacttgacattatcctgtattggattttgctcagtactccctgaatctcatttacttctttcgaaggcccactttcagtccttttccatcacaaatttcccaaatctgaattcttttatgattcctattttgttgactgacaaatatttttatgcatttgtctttcgggacatttgtattataagtgctgtgttttctgaggttttgaatagcttatgacctatacatatcaatgatatatggtagaataagggtctgatttataactctttctcaaaattccttagttgttgctttattttattttaatttattgttgaaaagtgaaacatgactttttttttttttttttttttttgagatggagtcttgctctgtcccccaggttggagtgcagtggcccaatctcagctcactgcaaccttagcctcctgagttcaagcgattctcctgcctcagcctcccgagtagctgggattacaagcactcaccactgcatccagctgatttttgtatttttagtagagacggggtttcaccatcttggccaggctggtctcgaactcctgacctcgtgatccacccacctcggcctcccaaagtgctgggattacaggcatgagccaccacacccggctgaaccatgactttttatctttgattgcagctgatatttctccctgccaaaatgcttttcaattcataattcaggtgtttttttttttttaacctcatattttcagaggattcctttcttacatttgtgtcaaattagatgaagtcctgttaactaacattcaaagttcttcatggttgtcgttgttgtgttggtagtttttgttttattttacattcatttgtttgcttgtttgtattcagctcaggaaaattttcttcatttgtgtcatggattttcatttgtcttcaattctgcatgttcgtttttacaaaagttataacactaaagcctgcaaatccccttcccttatctccttgaactgtctcttcatcctaggagagcttatgtatgccacatcacctgtttggtattgtaatcataaatgacatttagcattttaaaactttacaatattaattaatttaatcctcttaatcatatgttgaatatgtgatgattcttaccccattttataaacagagacataaccaggttttataatttgctcactataatgtgactagtaagagaaaacgcagtcttgctccaaaccccatgctgttgaacactgggctatattgcctctgaaaaggaaatttttgcttttaattctctttatttttttaattttttatttttttgagcactcactctgtcacccaggatggagtgcagtggcacaatcttggctcactgcaacctccttccccccgggttcaagtggttctcctgcctcagcctcgtgagtagctgggattacaggcacttgccacggcgcctggctaatttttgtatttttagtagagatggggtttcatcatcttggccaggctgatcttgaactcctgacctcgtgatccacctcccctgtcctcccaaagtgctgggattacaggcatgagccaccatgcctggcacttttaattcttgttggggctcagaacacgataccccgaagtatggcaccttggcatgctgaatactttgaactgaaggacatcagaaggctttggaatcaatgtctttctgactttctcccgtcttcctgtctctcatccctctttctcccctgaagcaagtgacaaaaacctgaattcctccttctcactatgggtcatagaaagtacagtccctctccctcaaaggaagacataaaacctagaaaggtcactctcttccttctcccttcttccttgaagacctttattccagaggagtccagccctatacctaggagagaggaatcctacacagagaggccaagaagaattggaacagacagtccttgctaggttttcccctcagtctattaccaagagatcaaactattttgtccaatcacatttttacacaactgtccattcttcatcaacctaagcttaaagatagacagttttctttgggcctttggatcttcatttctgaaggccctcacgtatgtaaatcttcgattaaataaatttgccatgcttttctcttggtcacctgacttttaagagagtcagcatgaccaagtgataggcgaggaaaggtatcaaaccattccacctctacactatctctacactatctacaatgcaaattttaattctgctatgaaatttgtatatatgtttcatataatactttttgattcaaatttcctttgaatttcagtcttcaattactgtgctgccttctctttttcatatcgctgtgttcttccttcattttaattattctttctggaaaccacacttttaatatatttttgtatcctaagcattattctaatttctataatatattctcctggctctgtcctccagatattatccttcctcgcttcaaatactgttttctttgtcttgtagactgtaaatgctattgttgcagcaggtgttttctctctgctcattttcaaatgagtagagatccaccagactgtttcctaacatatatagtgtatgaattgtattaaccctggtataaccatattttatacctacaagtggagagcagaggcatgaggcatgtgtgtgaatgtgtgtgtatgtatgtatgtatctatgtatgtgtgtgtgtatatatatatattatatatatattatatataataatatatatattatatataatatatatattatatataatatatataatatatatattatatataatatatataatatatataatatatataatatatatataatatatatattatatatatataaaatctccttgacctaacttgttcagatgtcattttatgtgctcctgttgcactgagataggatcttctacccacgtggctatttctcagaaatgtaaactgatagaccacgtaaaacaaactattttcttttttttccaacttaaatgctcttacttctatatacatctcccatgataaatgtatcacagccatttcctctgtctcttcatagtaattcagacccattagttatatggggaagaaaaggcaataccttttcctctcccatcacagggtcatggcagacactcataacaaaagacagatgatatggtttggctgtgtctgcacccaaatctcaacttgaattttatctcccagaattcccacgtgttgtggaaggggcccagggagaggaaatcgaatcgtgggggctggtccttcctgtgctattcttgtggtagtgaataagtctcatgagctctgatgggtctatcaggggtttctgcttttgcttcttccttgttttctcttgccactgccacgtagaaagtgcctttcaccttccaccatgactctgaggcctccccagccatgtgcagctgtaagtccaattaaacctctttttcttcccattctcaggtatgtccttatcagcagaattaaaacagactaatacaacagtttagcaggagaaaagcataaaaattttatttagcaaagctctacatgacatgggagccttcagaaatgaaaatatgtagacccagggaaaatggtgtgtttttatgctaagtctgatgaaaaaagtagatagttgtgaagaagtggattaaacaaagagggtatgatctaatagtattaaactaagtggagtttagcaagctcagattcttcttatcctgtgtagcatttcttcctccctggtatgggccaagacccatctggaatgaggattgtatgactcactttcaggacagatgagtaagagagtgacctttctaggttttatggcttgctttgtgggaggggagttctagtttctatgattcccctcaggagagaggaattctggggtctatgacatatcttttgggagaaaatgaagtggaaagaggtcagagaaaccttgcttcttaggccctctcaatatcatgtaccgtactttggggtatcattttctgagtcctgacatttacagaatctgaagtaatgcagaaaaaattgttatttaaataacaaaggaatcatattctgtttgccttcagaaatagtaccctttcagaggaagaaggactgatagcttttgtcatctgtttctattcttgtggggttgggcagattaaaatatcttcccagattctttcggtcctaggttcttttattgggtaacattttaggttgcaaaatatatttgaactctatcccagtttcctgatctctggttgtaggttactgttagatttacaatagaatatttgggggagtttctttttctttactttgatagacattttagtgggaaatttaggaaacccaagtccaaagaaattttatcaacacacagacacaaagcttagagattttacataacttgctgcaagtcctaatgctgaaccaagattggaatctagaaatgtctgattctagtgccaggctgtctcctctcttgtatccatgttcgttatgccatttatagcctaaatatcattttcctttttgaaaaacagagttccatgtaagttacagagaattatctttgttttataatctaatataataaatgttaaatcacaatcccacactgcgagcttgtctcataattattctttttgagtggaatagagcttcaagaattgcacaaactactcaaccattgcttttgaatctaataacacttattgtgaactttatgccctggtcacatttctctagaatccatgctaacacattatggtctccctggttggatgtcctgtgtttaatctccctccttctaaggtttcattgtgtactataatcttttttcctatttgtcaagtgattacataatgaaaataatcccaatgggagatttatgctctaaaattttaacctccataattatataataatatgtactgatttggcatgttaatattgtacattctcactggaaaaatactctccaatttggagtttatagaataacaacccataactatgtgaatagttttccagttttcatattttccaatttgtactttattttaatatcaaaaggttatgatttcttattaaaagcagagtaagaatggaagtttgggcatgtatgtgacattttgacagattccattattctgtggtttaaataaaggaaattgaacctatacccatgtttactaaattctttgaaagtaactgtttgtatatgttgataagtggtttctttatatgagacaaattcagtggaaattgagttacccagtgataacattatctgttacctgtcactaaccgtatctagaagcttgagtggacacaatcaactggtaatactaattttatctctaataaccaattcaaactaaaaacttaaggaattttcattattcgcccccccccccatttcctatgtctgagagaataaaaacagttttgtggatatcagatgttataattacttcttataattttttttcctttagaggaatatccaggaatatgttaaactaaaaggaaaagtaaattttacaaagttttaaactaaatacatgagaaatatgctttagtggaaatttttagttctattgtctaagagaggtattgacaaattttcaattaatattttttatcaaactcaactatcaaaaacattgctgttattattttgcatttgcattggttgttatgatgctttagggttactttttattagtcttttatggtggcaaacagctatccaaatgctctttataaaatttttctttgccttttagcaaccctgatttttttaatgagacctttttccaaatcttaatacttttttattttttatttttttatttttttagatagtcttgctcttgttgcccaggctggagtgcaacgatgagatcttggctcctgcaacctctgcctcccaggttcaagcaattctcctgcctcagcacccactgagtagctaggattgcaggcatgtaccaatacacctggctaatttttgtattttcagtagagatggggttttgccatgttggccaggctggtctcaaactcctgacctcaggtgatcccccggtctcagcctcccaaagtgttgggattacaggcatgagccaccaggcccagcccaaatcttagtatctttatgcctccaacagtgccttctctctctctctctctcataaaaataaaacaaaacaaacatgcattgtttctctgggtcagcttcagggacatccctgctatctttgaatttatcagagactcctcattttaattccgcctgctcttgttgccaccatcaattcttttcttttatcatcctgaagattcctagtggcttccctcttttatgaataccatattataggaatgaaccatgaaatatatttatgtatccatataatactcctgtctttctggaggatcaccatgccagataatggttcagtgatgtgctagggcactaaataggagaaaattagaatctatttactatataggccttataccaagtataaaaggaattctttttgttatgtcccaacacatgttaaaagaaacatcatttacagcctgacaacctctatgctcttcataaatgaaaattacaaatgactcccaattatgccaaatggtccttgtgctatgcaagaatcacttttaaacatgcaaaagtcacttttaactcccagaatattttatacaattttaaaatgtattctttcttacagccccggtaaaatgttgctattttgcaactaagacatcgggctattttcatagcagtttaaattaccagcattttattttgcatttttgctgaaggtaaaaaagaatattgtattaggcagaataatgcaccccagcaaatgtccatgccccaaaacccggaatccataaatatgttaccttatatagcaaaaggcacttggtagatgcgattaagttgggaatattaagataaggaggttttcctggattatctgagtaaacccaatgtaatcacaagagtccatataagagaaagagagaggtagacgagtctaggaggtgtgatggcagaagcagggccagagccagagagaaactggaagaagatgctatgccactggctttgaagatgaaggaagggaccatgagccaagaaatgtagttcagaataattaagatgccaaagaggcatattttagggtgaaatattcctgtctccaacgtcatattttggggtggtatgtcctgagcctcatcagtgttttgctgccgttcttacggttgtaagatgtggtactgcatttctaggcatcatattcatgatcagcaaaggaaaaaaaaaagaaagagacaaatgacaaaaataaaaggccaaagagttttgtccttatctctgatttctttttttttgagacagagcctcagtctgttgcccaggctgcagtgcagtggtgtaatcttgactcaccgcaacctctgcctcctgggttcaagcgattctcctgcctcagcttcccaagtagctgggattataggcatgcgccaccactcccagctatttttttgtatttttagtagagacagggtttcaccatgttggccaggctggtcctgaactcctgacctcaggtaatccatccgcctcggccttccaaagtgctgggattacaggcgtgagccactgcgctgggccatctctgactttatatgcaggaaagaatgtacttccccaaaattgtagcctatacctcattgagcagaactctgtcacatcaagagacaaagttataacagatttaaagatcttaattagcttttatttatgattctagaattgggcaatacctttttctataaaataggatgaatgttccgatgaggtgatcagaggttttatagacagagaagactgaggaaagcagaaacagagcacaagaagctgattggctgtttcaaaattactttccttgtaaaggttaaagcaaaggaaattttcttatgccagctacaacaggctcatttgggggattggctattatctctcgctttcctgattttttgaaagatcagataacccacttagttttggcttggcaacatggaacagaagcatgaataactccattgtggtttgatcagttgcacctagtgtagaagctcagtccaaaccactgccctcttataaattttatttaacagtcacgtggttaccgttaccgtcaagacaatatagaaaggtgttttagctttccaaggtttgtcatagaaaaaaataaaggaagtgagattgtagatgattggaaaagccaatcctcagagactgtgaactacacatttaaatgcatgatttctgtaagatggatttgttaactcttttgtaaatatcaccattcttcaactgtcaatactatttaaaatattgagctgctgagtgcttctatgcagacagttatagtggaggatcaccacacttattaattattaattattagttgaatcttttgctctttgtattctttgattcaaaagaaaatacttgcattgtagaattttaatgaagttattaaaaatgtattttttcctctctacatatatgagaaaacatttttttatgattttttccatctcttccaaaaataccatgttagaatcacaaataaatcctatgaaactgtctaccatatcaatagactttccttatcacaagatcttaggagtgactgatttaaaataagtgatccttattatataggctaatcaagttgcaaactttgaaaacattttgagaagtctctcacatatattatgtagccaaaaacaacaattctaaaatgacatttttttttaaattatggaatgatagttttcttaaaagtgaacatatttcacagcctggaatgtgacattattgttgtacagcagtaaagttgacatgtacagtatgcagcatgcatactaccatgtaacccattgatgaaatttcagggtttttattatgctacagtacaatcctatagtggggaattactcacattttcatgagctaccgtttaaaataactttttgaaatgagatttatgacttcctgctaacagctgtagaaaggagatgaggagggggaaataaggggaaggctcttcctattacgaaaagaagaaacattaaaaaggtaggaaaagaacatttatattggcattctctggaaagagaaagccatgtgctcagcaagctttcagcattccagctttataattactcttgaatatcctgagggcttctaaagcaggccatttctgaaaagcagatgtatactttttgccattgtttcaagtctggataatcttttcatacttggaaattaggaatgcatgttaaaatgttgataggaaataaagagaaggaatttgtatttttaatcgttgactttaataataaccatatataggccaaatctctattaacctactgaagaaaagaactgtggcaattacattgataattgagacaaaaccatccagaagacattatactgttcagttagctggataagaggcttgaaattgatgatgctttctcagaaggcactcagccactcaaaattgaatagaaactttccccctcccacaatctcagacaaactctgacattagtttcccttgctatagaaatcatttaaaaagcaaatgagaaataaacaaaatatttgttaaactttggaaaattaccttgaattttagaaagttcgatcactgctaaatagtttgggaagaaaaaaaaatcctttcaaggtagagtaaggtaaattccataactgtctacatcaacagttcaaatctggaggttgaaatgtgggagacgaccagttagagaaaagtaggaagggcttcttggaagaggtcatctttgagacaggatttctaaatctcaaaaagggctaggattggttagtgagatgggggtggcatgggtcttctggaggaacaacctgtcactaggtagtcctagtgacaatggaagcagaacaaggaagtggaaaattatagtgtgtgttagtgtccttgtttgtgaactggggagtaatgcagtttcgtggaagaatactggaaactaagaccataagctaaaataataagcattataaatgaataaagccatgctgaggcctaagcacattgtaggtctttaactatttctccacacacagcctctgctggtgtctgaaatagacttcatggctctggagaagttcatttactgtcaactaatttatttaggcatatagcatttctattcctgcaatacacacaaaggacatttgttgttattatagtgcttttttggtttttgttttttgattggtttcccttaaaaaaatgagagggggaaagaaagagtatgttcatttgtatgtcacaacccacccctaaaaaaatagtcatgagcatgagagtagtgggttggtgcaatgaacacatagaaagacttaagttggcaagatcattttttcacttggtacaaaaccagtggggcatgacataagggtagtttgtacatggtagtgccaggaaaataagggtttcatattcatgttagacccttggtctacttaattgcttttgcattttcctaatgcatcttaatgtcacttttttttccagaaaaattctctaacttagtagaatgagtaaaagaatcactttaagggaaatagagttaaaaattgaaagtcacttaactgtaacaataatttacatagcgttagcattgttcttttcatgcttataattttgacttacttgttgatgtattttaaaggtttcattatttttctggtttaagatagatttatattgttaggttaatgtagtacaattagcacctttgataattaaggacatatttgtaagtacagggaagtctttcttgtagaccaattatagctgtgtttatagtatcaaattatacatgcattattagaccttcaaaacccataataaatactgtatatcaatgttttggggcttacacctagtggcacaaatattaatataactaaaatctaagttatatgtataagaatttttttttctgaatctctacattctttaggatctacatttcccttaattgtaagaagcagaatattttaacggcaaaaatgagataggatatatctaggggttgaaatcttcctactaaatgatttttaaatttgtaactaagcatttatgttcatttccacagtcttgtgaaacaggtgtgcatcatgtaaaccttgttagggttgacaaaataggaaagcattataacacttcatatgatcaatgaattaagaattgtgtattttgaattttttttccaaaggcaaaattttctttcctgaattcacaaagcttttacaatctagatctttcacatagagaagcatctactggattagtaatacaggcaaggaactaaaaacttaagtctaataacatatcgtagcagatatattgtgcacttttatttgtatattttgaacataggttattttcttggcagtttcctcagaaaaatttggtgtttatcttctgttttattttcacggttttaacagtaagaaccaggagtagtaagaaatagaatgtgtatatgttttataaaaatttatatacatatatacaattcatatataagtagttgattctattggatataccttggcacttatataagtttactaagaagtgaatttttttaaaaaaataggaaatgattatattagatttaatttattttttgccaaactaacattttgtttgttttgttcatatcatcttaaactagttattgtggctatcagtgcattgaaaaatgaattactagtgtaatatgttcatctccttctgcatatgaattgtccttggatgtaagttttctgtatttccagagtcagctaaaagttaaaactaatttacctggaaaaactatgttttaggtgctattattatttttatcatttagagacaggatcctgctctgtcacccaggatggagtgtagtggcagcatcatagctcaatgtaacttccagctcctagactcaaacttcctcctgcctcagtctcctgagtggctaggctacaggcatatgccaccacactcagctaatattttcactttttgttttgtagaagcaaggtctcagtatgttgcccaggctggttttgaacacctatactcaaatgatcctcccactttggcttcccaaaatgctgattacactacttcccaaaaggattgcagaggtgagccaccgtgcctggcctttaggtgccattattgtagacatcttttttttttttaattatactttaagttttagggtacatgtgcacaatgtgcaggttagttacatatgtgccatgtgtaaaaagtaaaatcttaacttcttatatattttaagcaagtttattttttaaataagcagtaccagaggaatgctgatttttgtaatttaatgtttcatatagtttgagaaatggtctcatgaagccagtcatacagaaccgtacaatccacagtgactaatctatgcacttggttcatgttattcacaactttctacaatcctataaaagaagcagctaacccaaaagtacaagacacatcaggagctaccaaaaaataccaagatcaaatccagccccaagattatgaaagccatattattttagtctttcaaatgccagtgtttgtcttttttctcaagtttttctaatgcagagagtcaataaacacccttctaggccgggcgaggtggctcatgcctgtaatcccagcactttgggaggctgaagcgggtcgatcacctgaggccagaagtttgaaactggccttgccaacatggtgcaaacgcgtctctactaaaaatacaaaaattagctaggtgtggtggcgtgtgtctgtagttccagctacttgggaggctgaggcaggagaatctctagaacccaggaggcggaggttgcagtaagccgagatcatgccactgcactccagcctgggcgacagagtgagactccatctcaaaaaacaaacaaacaaaaagaaccccttcttttttggtcaagagctcactatgacctaagttaggattattgtcattatagtaatataatataaaacttataaaaattttaattatttaggaccatttgcaaaagctgtagattgtttatagttcagattggcaagtatgggtggcagtaatgttagaaataagaaagctaaaacctaaaggtcaaaaacctagttgccttctcattattgtcctcatgtcttcagattgtcagaggacagagggttagaaccaagaacactcagcttgcgtaaaggttttctacttcacttgacatttccagtaacttagcagcatgaccaatgaaacctgaagtaatgaatgggaaaagttagcggggaaggaatatccaacacaaaagttttatctcagcctaattaacattcagagatcagatggaaaagatggagtcaagaaggaggagaaaagttactgggaaaatatcataattggtaaaaagggactataattgatagaaaggaagaaaaacagtgatttcggttatctagcagactgaaggatgttaagcaaatgattagggaatttctaacaggtaacagatgattaggtcaataaattaattcatgtgtaatttgaaaaatataacatttcacataatattcataatattcaccatttttcagaaggcaaaattaaatacttcagattataaatctaacgacacagaaaagacattttatgttcttgttttttgatttacgaggacttggacttataatagtcaataaatgctaactgattattaataaggtgtagggtctaaggagcataaatttttttaaattagttttaaatattcatagttatagccagttttttactgtctttaccaatgaaaggaaacaatgtcataaagtaactatttttaatgtttttagtcattcgtctttatgtaacattactttttgaaattgatttgctttccaaattaaaggttgtcgtaggataatggtaaaattattttgcatacatagcaatacaaataaattggaaactgaggatatgatctaaaaatacactaagtggcagtgaagagtgaatctggaattcaacatttttcacaatgcatatgtaacatggtatatttggatgaaacattattcaaatgggcaatctcttctggctccattgtcttgtgactgtgattctaaatgctgtcatttctaaagtaacttaaatactttctcctgagaaaattgtcattaaaaacaagtgcatataatatctaataaaaagtttttatattattactattttgttttatatatctagtgttcttttttttttttttttgagacagagtctcgctctgttgcccaggctggagtgcagtggcacagtctcggctcactgcaacctccatctcctgggttcaaatgattctcctgcctcagcctcccgagtagctgggactgcaggcatccgctaccacgcccagctaatttttgtatttttagaggagacgaggtttcaccatgttggccaggatcgtctcggtatcttgacctcgtgatccaccctcttcggcctcccaaagtgctgggattacaggtgtgagccactgcaagcggcccttgttcttaatcgtaatgaacatgaacagtattaataagttcaaagcaatatgtacacgaagaatttcttctttcaacagcaataaatgggtaaaataagtacagaacaacttttatgatacagtgttataaaatgcatgtgtatcagttacctttcatcaccttaattctttgttaaaaacaaaaacaaaatgccataaaacctcagtggcacacaatagtaaggatttgaatgaagctcaggcatctgatacaatcagctgggccattctgctgtttgtagctgggctcaactggttggttattctcttcttaactgaactcactcagatgtgtggatcagctggtttggtttgaggtgaaaatcaggacatttttactctgctccatgtctctcaacctccatcagactgggacaggtagatatcttctcatgatgaaagtggggttggggtagcagtgggaaagggcaagcctaattatacaaatacttttcaagtctcttgagtgtgatacatttactagcatctcattggctagtgcaagtcacttatcagtcagataatttgagataaattcatgtgccttaattatttttataacttaaaacataccaacaatgatccaaaatattttttaaactactgtgatttttaagattgttgaaaattgttttgaaaattagtttcacatttatcttttagggaaaaagagtttaccattgataatccaaaaatctgataaaatcagttgaagcctgtttagaaagattgagaacttataagtacatacataagtataaattatatataatgtagtatattatatacatgtgtatgtatatatccctgctgaaattacctgccagtagtacctgaagaaactcctcttagaataagatgtattttaacatttcattgtaatggaagtagcttattttactcaccttttttgactacagtttttccgactcaattacagtgttcctgtgtggttcaaaaccaataaaaatgtcattagtaaaaccagtccatgtcataaaattgtattccatctagttaatttgacacaaaataatataattataaataaaataataatggagttatttttataggcaacattctaatacagtgagacccctttatcttatatttaaaatattagaagctataatttcatattccatgtaatatatgtcttttaatttaaatttaatttcctttgttactcactgctagactgtatctgttttctattgctgctataagaaatttgcaccaatttagtgacttaaacactaatttatcgcttcacagttatgtaggtcagaaatctgtgcaggctcaatggcttctgctgcttagaatctcagcaaaatcaaagggtcagcaggtctagtctcttatctggaggctatgaggtagagtgtgcttcccatctcgtccaggctgtgggcagacttcaggtttagtggttgtagaactgagcttcctgcttccttgctggctgtcaggtggagtacttgtcaatttccagaggacatcctgtttcatgactcttgccaacattccttcatcttcaaaataggctaggcagattaagtttcctcatgctttgagtctctctgacctaccctctgtctcatttaatttcccttgctcatagggactgctgtaattagactagacccacccctcaggataattttcctattttaagcatattcacaggttccagaggttttggcatggacattgtgttatgccattattgcactgctatgaagaaatacctgggtattttataaagaaaagaggtttaattggttcattcttctgcaggttttatgggaagcatcgtgctggcatctgttcagcttctgctgaaacctcagggagcttttaatcagggtggaaggcaaagaggggctggcatatcatatggcaaaagcaagagcaagagagaaagactgaaggagggaggtgtcacacactttgaaacaaccagatctcatgtgaactaagagggagagctcacttagcaccaaagggacggtccaagccattcctgatggacctagctccgtgatccaaacaccctacaccaggccccaccttcagtattgggattacatttcaacatgagatttgggtggggacaaatatccaaaccatttgattcttgtgcattcttatgcctacataagttaggtagtgagaggacaacaggatccaggcagagtttaaacaagcagattaaggagagagaaacactacagcaaacacggacctctccttgttactcttgcagtgagattctctctccttgataaggataacaaaatgttgtaatataaacaaatgacacacacacacacacacacacagacatataatacaaaaagtaactggaggcagtgccgtatgttatagaggaagctttgggtaattttgagaggggtatgtgctgcagacattcagcactgaaataaggcaagtaatttgagttatttattaaaggacaggtgattaagctgtgtgattgagagacttgggaatggtgcataccttttatttatttccctgaatttggtaaaactcagtgtagataataaattatgcaactgaatacctgtggagtcactcctgtttggcttgtaaaaatggaagctctacgtcttgtctggattgtagcaagttgctgtttagatgctccctctgtgctcttttcctacccacagtgagtagatgggagtcaatagattatctctttatttttgcttggtttcacgtgaattagaagaaaaaagatgtcagcagaatttaagatgcagagataactgcatggaagtaagagacatctgaagtggtgtcctactgcatcacagattatcaggactcatttcaggtctgttgcttggttttcttaatttgtcattgtttgaacccatttctggatactaagcttccttttttggatttatgtctcacagccttatatgttcattaattttcaccttggctgaattggccgcccaatccttccccttaaacatgtacttttcattccatttatccattgtagttatatctatctggttgccacccctgaattcaagttatttgtgttcatggagtaatttttaacaactttatcaaagcgtttttataatgccagtttatacccctgttcccttcgtcccatccctatatcctttctcccatctaatggaaactgatgcaagttatcgccccttgcagctcttcagcttccccttgccagcatctcaaattacatatagtgagtgccaaacccagacatttgatctattcctcttgttcacaacagtttctgcttgtggcctatgacgcaactgaaatatgataatagaaacttattcagtcttaggaatttttttagtgtagaaattgagactcagattgacatatatatataacttttgttaatttcaatatgtgcctcaaattccaaaccttatgggtttgtgttgctataaagcaatacctgagggtgggtaatttatgaagaaaaaaagatgtatttttctcacaattctggatggttggaaagttcaagattgtacatctgcatctggcgaggacctcaggctgctgtcactcttggcatagggtgacagagagccagcttatgcacagatcacacggcaggagatgaaacgagaaagagtggggaggtaccaggctctttttaagaactagcccatgcaggaactaatagagttagaactaacacatcaccgtgagaatggcaccacgacatccatgaaggatccacccccatggcccaaacacctcctacttaggccccacctcccgacaccaccaaactggggataaaatttcaacatgagatttgttggaaacaaaacatgtccaaaccatagcagtttattttgtgaaagtgctgaagtttgatgagtatacttcaatgataaaaaaattaatattggctttctaatttatttataaaatagatacaaaaaagtcattatttatatgtcattacaataatcacattggcttggtggtatctaataaattggagccacattgaagtgaattctatactatacctcagcatgtaaatttacctgaattttatgtcttcagttgtaattcttccagttatttctagactatatgtagtttatatttctagatattctcctagaaaagagatttttcatgttaaagtccttaccataaggaagtttgactgtcattccaaagaatctactctctgtcattaatataataaggagatatgaaatggaacattttacattcataacaacacaaaattcttataaattgctgaaacatgaaataaccaaataaactttattattgaaatgggtttctttagaacataaatgtgtaatgtatcttctcaaacttgttaaatcataaagaagtgcggtgatttagtaacatgaagcacagtatatataaaactatgtagcataaaatgttcagctgctaaggtagcaggaaggttccaggagatattttcataaatctggaagtagttcacctgtttcattgattgtcctcatttcatttacctaaatagtgggtcgtgattctcctgtctttggagtttacaaatttcctttagttgaatctgtgtgttttgaaatggtatttctttcacgtattagaaagttgaataactttgaagaaaatggaaatgacattgtgtggattgtcggaaaactagaaagatgtgatacctttctttataagggtcaggaccagcactactataacaaaggcatgttaataagagaaaagcaaaacaaatttgtttaatccaagttttacatgacacagaaaacttcaaaaatgaaaagctaaaatccagggaaaactgtctatgtttagatttgatgaagaatggacagtcgagtagaaatgtgattggacaaaaggctgtgctgtagtggtaataaactggaaggggaaacacagagaggcctgatggttcagattcttctggcctgcctgtatggcatttcttctttcgagtacagggcaggacctctctggaatgaaggtctttaaggaaaagaagagaaggttttatggcttgctttgtagcagatgggttctagtttctaagactcaccttcgagaagagaaattctgtttttttttttatgattttcttctgggtagaaaatgcgatgggagacaggagggcaagagaatgtgtgtcgatgaggtttggtcagtggtgacttaggaaacattattaggctgcttatttgcttatatgttgactttccataaatgatttttgagttgaatgttataaaatgtaaatctttatatttttattttcactttggattttttttctcataacataccagtctactaattttcaaggaacattcttattagtatatttaaaaggccaaaatagtattactcttatttaataattaatttaatcacagttagctaaaatttgactttatccaacctgaagacttttcctagagaagtgcttatattcataattaaactaaaattttagttcagaagtataaaatgttgctgtctaatttaagaataaaatacaagtttttagaaagttgtgtggaaagttttacattggacgagaaagaccaaagaattgatacgatgtttaaaaagatttgggttgaatctataaactaataatatgggccagcgtggtggctcacacctgtaatcccagcactttggcaggccgaggcagattatttgaggtcaggagttcgagaccagcctgaccaacatgatgaaaccccatctctactaaaatacaaaaatgaggcgtggtggcggtgggtgcctgtaatctcagctacttgagagtccgaggcaggagaatcactttaacccagtaggcggaggttgcagtgagccaagattgcgccactgcactccagcctgggtgacagagcgagactccctcttaaaataaaagtaaactgataatttggatgaatgttacaatgttctataacatgggtgaattttaatcgcagtaccattgagtatctattaggtctaagtcactacataaggcctttccctgcatttgagccagagtagatattccagtctcggctgcctcttaccttgccaatgattgggattagcactaccagccaggtggcaaggcatatacaatatgtataaggttggaagaacattgaacaagaaaagaaaactgaagctttagcttttatgactaccctctagggcattattaataagtccacaaactgtgaaaaaactgtaagaatgctccactctagtaaaaaatgaaaggacagtgctactttccagatcctaatgatgtaagtcctgctctgctttgaagaaaacctataatttcacaatatttaaaacttaaagtgctagggaagtattaagatttcatctttttcacatttacttagctgtcttctgaaaatgaataagatccactatcttattttgacagattttaaattattgtgttttgtatacacatttgttttgtgacttttattgcatttgcatttcaccttggcactttttaagtacacttaataaatatgttttaatgatgaggacaactgtgagttgacctttcctgaaggtagtggtgaaaataccaatatacaaaagcggcatctgccatgatgatgaggagccgtagtttaaatagatctgggttgctactgtactctccaagttagtgtcctagtttcttctcttgtttcttactttccattttccacagagcagctacagatatctttttaaaatatattaatcatatataattctcctacttaaaaccgtgaaatgatcttaggagaaatttagtcgtctttcttcagtctaaaagccctatatgactttggtactcgccttcctctcgctccctatccatcctcaacacagtcctccttgcttgttctcttcagtcacctcggctttccttctgtcccttgagtgcaccacctccttgcagccttagcacttttgcacttgcagtcacctgtgactgaaaccatctgcccttagaccatcctaaaggtacttcttgcttgtcattctggtctcagctaggaggtcatgttttcaatgtgggctcccctgaccacctcatcaaaaataacattctcccccaaattattatatcactttactacattttctttatagctgacttattttcttcagttattttgtgatctgttctcccctacacataagtaagtttcctgagggtgatgcctctgtattgcatgctacatcataggctataaacacatatttgctggaataataaaaaaattccatgtgaaagtactttatataaatgctaatgcacatcacgatataagatgcagttactagctaagcaacagtcagacaactcctttttatgtatttgttctggcaacctgaataaaagcatatgtaatctgtgagtgtgtattgtctttaaggacaggtaggtaagtggtcatctaatgttcacggggcacacattttgatacggatttattttccacccactgtgcatcttctgctgtggcaataattagagcctgtgaactgaagtgaaggaaacatttacaatgttgaataacctaaagggaagacaagggtatctaattagtctttcttgtgacaatctttttttggattaatattcttttcttttgaaaagtctaacagtggattcttatgtcactgactctactgataattaatagtgttcaccatacacctacacacactccctccaaaatatcctctcgtaatgccactactggaaagaacaatttcaattagaaaggagagcttttgaagtatatatcatgtggtctattataagaaatgtgtcctattataaacgaaaaaaatctctgccagaacataatattttatgtaacatgcctggtatattgtttaacaaaacattttatggatacttcattagggcatgacttgattaagaagcaggactagcattcacccacattgtcttttcttgaatctgtaagatgtgttcctgtacgattttcaccctacttataagcttattaacttaggaatgttgtgacagagcctttatttttgaatcttgtaattataattaatagtaagttaaagggaagtagaaagcttatattcaaagtttgaagtaaaatgactttgtggcacttagggcaggtgccaggaagaaattaagcaaaagcttattattcttatttattagaactttgggatgacatctttgaggatgatagtcattttatggttacaagagggagacctatttgtggacaaagcttgaggaggggtatcctgctatcttcagctccgcatgcccagggtctaaaatgagcttttcccccaagattagcaactactttgtgctagttgcatatgtgcaagtaaggataggagtgaatgtgtacatactctccactacttccctcagtgtgttcctgaaatccctatcatgaaagaaacaaccacaaaatttccttatattaacttgtgaaagtgttatttatgatggctacatttttgccagagagtgacttaacatcatataaaacacagtaatgtacgatgtttatcaaaactaagagaaaacatcgtttaattgtaaatatctacagttttaagtagggaatgtcctacccatggtctttaaaagaaaaaagtatgaatgatagatgttaactatatgaagggccaaattacaaggaagttcaataatgttgaataatagtaataatagttgacatttgtggaaagctgacaaatgttcagataattgttctaagtactttacatatatcaacttattttatactcaaatgccctgatggatcagtatttttaccctgttttcacaaataaaaaagctgggctgtacaacataatcagctagtaattaagttgtgggccattcttcaaatctaggcaggcaggccccagataccctgtctctctgtgctgtgacaatgttcactaaattttcactatgtgtctagcaccattctaagtcctgtacaagtattaactttaaaaattcccataataagcttatgtgatcaatcctacagtagtcccatttcttcaggtgaggtacctgacaaaattcttgataaggaatttatccaagaatgtctagctagctaacactggaacaagaattcaaactcacatcttacttcagagccaacacttttaaacattagtctaccccatgtcatgcaaatgtttagggatcagcaaactatggcccacaggccaaacctagcccacaaactggttttgtaactaaagttttgttggaacacatccttaatcattcgtttatgttttgtctatgtctgctttcatgctacaagagcagagctgaaaagttacaacagataacatatggcccatagcctaaattatttactctctggtccttttcagaaaacgtttgccaacctctgctttagaccatgagtgtttctttagcaattatctttgcttgatccatcccaccaccaccctgaatctagacaattttcagaaaatagcaagtgacaatagttttaactttttacacatggttagaaaatgacaaaaaagaccagttctttagaaacttcaaaatgcatctgaataagtaccctagacacacataaaacaacattctctgctcttgctttcatctaaaaaaggaaaagtcaacagaggtgttgagctaactctacttaaagatatggacttgagacagttcactcaagttcatgtattctggctttaccacttcctagctttgtgacctcgggtggatcacttaacctctatgtatcccagttcctccacctggaaaaatggggatagtggtaaacgtaactcataggagaacaggaatatctcattttatcgcatttcactttgttgcatttcatagttactactttttttttctaactgaagtgtattggttaatatgctgttataaagacatacctgagactgggaaatttatgaagaaaagagatttaattgtctcacagttctgcatggctggggagaccgcaggaaattcacaatcatggcagaaggcaccccttcacagggcatcaggagagggaatgagagcagagtggagggggaagccccatatgaaaccatcagatctcataagaactcacttactgtcatcagaacaacatgggggaaaccacccccaggattcaattttctccacctggtcctgcccttgacatgtggggattattataattcaaggtgagatttgggtgggtacacagagccaaaccatatcattttactcctggtccctcccaaatctcataacctcaaatttcaaaacacaatcatgtccttcccagtcccccaaagtctcaactcatttcatcattaactcaaaagtccaagtccaaattctcgtctgagacaagttccttctgcctatgagcctgtaaaatcaaaagcaagttagttacttcctagacacactggggatacaggcagttggtaaatatacccattccaaatgggagaaattggccaaaacaaaggggctacaggtgccagacaagtccaaaatccagtagggcagtcattaaacgttaaaattccaaaatgttctctttgactccatgtctcacatccaggtcacattgatgcaagaggtggactcccatagccttgggcagctccacccctgtggctttgcaggatacagccccctcccagctgctttcatgggtattgagtgtctgtagcttttccaggtgcacagtgcaagctgtcagtaaacctaccattctggggtctgaaggacagtggccctcttcttacagctccgttaggcaatgccccagttgggactgtttgtgggggctccaaacccacatttcccttccacactgctctagcagaggttctccatgaggaagccaccctacagcagacttctgcctggacatccaggcatgtctatacatcttcggaaaccttggcagaggttcccaaacctcaattcttgacttctgatcccccacaggcccaacacatgtaagctgccaatgtttgggccttgcaccctctgaagcaaaggcctgagctgtatgtttgcccctgttagtcattgctgggatgcagggcaccgagtcccaagactgcacaaagcagcaagtacctgggcctggctcatgaaaccattttttcattttaagttttgaggaaagaagctatctccataacataaaagtatggtgaagcaacaagtgctgaagtagaagctataacgagttatccagaagacatagctaagataatgaatgaaggtggctaaactaaaaaatcatcagcataggatgggtggctcacacctgtaatcccagcactttgggaggccaaggaggatgggtcacctaaagtcaggaattagagaccagcctggccaacatggcgaaaccctatctctatcaaaaatacaaaaactagccaggcatggtggcgggcgcctgaaatcccagctactcaggaggctgaagctggaaaattgcttgaacccgggaggcggaggttgcagtgagccgagatcactccactgaactccagcctgggtgacagagagagactgcatctcaaaaaaaattattcagcataaacagccctttattggaagaacatattatttaaaactcttaaatctagagaggtaaagtcaatgcttggcttcaacaactccacctgacaggctgactttcttgttaggggctaatgcagctggtaactttaagttgaagccaatgctcattgaccatgttgaaaatcctaggatctttaagattatgctaaatctattttgcctatgatttataaatgtaacaacaaagcctagatgacagcccatctgtttacaacatggtttaatgaatattctaagcccacctttgagacctactgttcagaaaaaaaaatgattctttacaaaatattacttcccatttaaaattcacctggtcactcaagaactgtgatgaagatgtacaaggagacaaatgttattttcatgcctgctgacagaacatcaattctgcttcccgtgggtcaatgagtaatttcaactttcaattcttattttttaaaaactatattttgtaaggctatagctgccatagacagtgattcctctgatggatctgggcaaagtaaactgaaaaccttctggaaagagactttcatgatttataggaagagatcaaaatataaacattaacagaagtttgaaagaagttgatgcaaactctcatggatgactttgagaggttcaagacttccctggaggaagtcacatcagatgtgatagaaatagcaaaagaaccataattagaagtgcatcctgaaaatgcgattcaattgctacaattttatgataaaacttgaatggataaagagttgcttcttattgatgagcaaagaaagtagtttcttgggatggaatctactcctgggtgaagatgctgtgaacattgttgaaataacaatgaaggatttaaaatatttcataaacatatttgataaagatgtttgagagggttgactccaattttgaaagaagttccactgtgggtaaaatgctatcaaacaatatcacatgccacagagaaatctttttgaaatgaaaagtacatcaatgtggcaaacttcattgttgtcttattttcagaatttgctacaaccatctagccttcaggaaccacaactctgattggtcagcagccatcaacatcaaggcaagaccctccaccagcagaaagattatgactggatgaatgttaagatcagccccattttttagcaataaagtattttttcattgtcagtttagacataatactattatatacttaatatactatagtatagggtaaacataacttttatatgtactgggaaaccaaaaagtttatatgatttgctttattgtgatattcactttgttgagattgtctgaaaccaagattgcctgatacctggagtatctccaaggtatgcctgtattatagccattgaatgaatttatgtatgcaatgttgggaagaggaactgaatcctataaagtattagttattactcctattcttcagcttcttcaaaagactgattcagaggtaaacagaatggtcgaaggtgagccctaagtataactgggtaaatttttaatgaatgaaaagcctgtggaatcaatgattattaagtattgttctacatttatttttagagacctctatgaaaataaaaaataaaaagtccgccaggtgcagtggctcacgcctgtaatcccagcactttgggaggccgaggtgggcggatcatgaggtcaaaagtttgagaccagcctgataaacatggtgaaattccatctgtactaaaaatacaaacattagccagacatggtggcacgcacctgtaatcccagctactcaagaggctaaggcaggataattgcttgaacttgggagggggaggttgtagtgagccgagatcacaccactgctctccagtctgggcaacagagcgacactccgtctcaaaaaaaaaaaaaaaaaaaaaaaaaaaaaaaaaaaaaactcaatgtcctctgacaacttgatgtataataccggacttctactattagcacaagaaaatgaattaaagatcttaaagatcttggtaagtgcagcatgtacatctgcacaaaaacttatgtagacagattgtgggagaggctctcctcccttggtttctctggcagtaccagagcatattaactgtaaagaacaggttcttctaacccctctaacactattgtgtctggtggtacccagctctgatacaatacactggcaatttctaaattggttctttacctcagggcttaataatgactaaatgacttaagcatttactgggaatgataatagttacatccaagctctgtaacaggaattattgatatttatagtacacatagaaataataaatgattgaagattcatactaagctggagtagctaaaattatgagtcttaaagccaagccatcctgggttcaaagttggcttccgttcactaccaaatgtaagcttgggcaatttatgtggtatctctactaactctgtttacaatggcataaaataataatactgatagtaccaacatcagtcactaagtcatgtatttgatgaatgtttattgaatagctactatgtgccagctactattggggttgagcatacagcaaataatacagatatgaaccccagctcttttgagctttcatttcacttgtgagaactaagcatttagtaccaggtatggggcacattaaattttcaaacaatgttaaatatcattaccattagttgatgatgatgatgatgatgatgatgacagttatgtctcattatggagttgagaataacacaatttctgtacgtgggaaatatttctggtccatagcccttaaactgcttccctcccacaggagtgatttgaactgagatttggaactcctccctgggggtctttatcgctatgtcccagtatttgctgatgcacttattccataataattcaaaaccaggtatttattaatatattatcaaagcattaaattcctttctatatatgctgaaaatatttctattcagctaaagaacattgtatgccttgctgaaatgtgtgtagaattacccacaaaagtcatttacagatatatatatatatatatatatgtgtgtgtgtgtatatctataaatagacagatatttatacatatataaatatatgtgtgtatatctatatatttatagatatatgtatatatatacagatatatctatctatatatatatatacacacatatgtgtgtgtacatgtatgtatctatgccagtgttagaaaaggaatatatggacaaatcagagtgtgattaggaggatcagttcatgtggaataggagtccaagttgtttaaggtgtcacagaggaggccacatagtggaggggatgagaagagtcagaaaaaagtacttccaaatctgattagctatcagtgggtttgtatttatatttttgccttaacttctacaaataattcctctcacaaaagtcattttggaaacttatctttcaaagttcgtaaaaacatcaatgattttagttatcttcacttaaagagggtaatttatcatctggtcaagggtgcatgtgtctgccaggaaagctgtgagccaacatacatcatactcagtagcttcaaggattcagtttgccttcttgtgtgtatttgaatacagaattcattttaatctgacattttttacctctcatcatatttttcttctaattaagttctataaatgtatcttctatccggtttgagctgtaataaattctttacttgaattggccttctgaaagtcacaaaccaacattatgatgaattgcaaaatgaataatttcccttccactgtgtttattttgagcagcaaaatgctggagaaaaatgaaacaatgtttcactagaaagaaggccatgcccatagtggttacatggctttgacctgaatgctgctaatgctgaagccagtagattcccaaaactgtgtaggtctaatttaaaaataatttttcagttgataattttagagtttaatgatattaatgtaagatataaataatgagaaatgttttgctctcatataagcctggagttagctagccatgttggtgtggactagagccatggtttctttgggaaatgtgtttcttaaaatccatattgcagaagaaaagaacaaggccatttatagaatagactaagggaaaaatgaacatgtgatcgctgttttttaaatcatcatatgtcttaccgcaccacattggcaagtaaatgtattattgtctttgaatttagatggccaaattgaaattgaacaatttgttactaatatttaggttggaattttaataggtgcttaacattggacacatctgttcccattacattgtaaggcatagatgaaactttatacaaataagattaaagcattgccatagctaaaatatcaggcattaaccttgtagacttttgattttaaaatagttgagctccagtattaaaatagccacagtgatcagagtccagttcaaataatagtgcttaatgtgttaatcattaatcttacatacttctttctcatttccctctatgcctttatagagtgggaattgccttatatcttgaattcattactgtaatttgtgtactgtgcattgactgaagccaatttaagtggtaatgtaggatagaattttagttccttcactttgtgtagatagtgggccatggagttaatgtttcatttatagtatttattacagaactatgataatgtggttatgattcatgatcttttcctggataatggctgatttaagacatattatagtttgaaaacaatgttgatgttctatagtaaccatgaccactggtccaaatatcccaacataaaaataccattggcataatttttcttcccttaaagaaaaaccataattactcttttcaaaccagaattagatatgcacaatcacctaaaccaactactttgtcttgcaaatgaggaatccgagatccagtgaagctgactagattgatggagatcagaaagctactagtgttagagctatagcagggatgcagaacctgcttcctcttattttggggccagtactctcaaaactatcctgccttgctaaaatcggataatcactgccatttcatttattcatattctgaaaacatttgctattatctccccataactcttttttctttctcctcgcgcagtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccaggtcagtgcacaggacccctagaaatagcctaatctctctaggaatgtgctcctttactctgtctgctcactctgctgtctttgatgatgtttttctttctgcaacaacacaccctgcactgaatttcaaagtgtatagacaaattcccctttggttttcagtatattgacttctgattgtttttgatatttggtacatgtaaaacttagtccacatgcttatgcatttaaccaaagtaataagcttctcaggacaagcattattaaaattccttgtgctcacgagccctgacaaggcacagagatttctagtcaataatgcatgccagaatttacctttgttaatctttggagttttccttttagaattaatttatgtaccaaaaaggatcagatagctgcgatcaatttctctaaaaattcagtgacacacaagatattaaaaagaacaaagcaatactgagaacactgggccctgtaatttctgaaattcactgaacctaaattcatttgtacctaaaagaccaagggcacagaagggagatcattcttaaagacacagatggaaaactgcccatagttccttgtggcccattgctactgccaatcctgttttctgctcatcatacttcttggatctgcttcgttctaaaactctctggcctgattacttttttaacccatagttcttggtgcttttctaaaccattcttttggaaattttgttcttgggaagatttcttatgatttattttcatgttttcactaaactccttttttaaatcagtttttattttatctttgctatgaatgtctatgaaattagataaaaaaattttatttaaatttagaaatttgtaagttaatgacaagggtaaactaagtttgtttttaacttttgaaaatctttccaaaatataatttatctttagtactagatgtttgaccctactttatgaacatgcagtgtattccgtatccagtatataaattaaacagagccttgccaccctctcacctcttaggaacataaaacccatgttgcaagcagagacaatacaattagaagaatagccaatcgcttatgtagctactgggcatactaatcagattttgataatgccctgttaccatgacagccagtgactcagagattttctcattagtgtttgaccagcaatggtccttttaatagatcttcctgttttcccattcaattactgaaattaatatgaggtgagatacatcattattcactcataatatgaatttacatttagcactttcttacggcagaattgtagtaaaatactgctatactgtttgctttttttcagtgcatgagacaaatataaggggagaaaataaatataaccataagtgtttttaaatgagagatattgaatagcaaatgttctttttgtagaattaataaaaaagaaaaaatgatcattagaaacaacaacaaaaaaagctctattttggtttatttgtggtgaaacacattctgaaagagtttatatctcagaccacaaacattttataatccttgtatgcaaaccaacactaaatagcaaatgaatatgaaaaaatatatatgtacctacagatagtgttgatagattaaaagttgttggaatttatgtttcctggaatttaaatttgtaatatttgacttttgctttggcttatgtgatttggtaagaaaagatagttaattaatgaagataatatatttcctatctcatggtatacttcatctataatttaaaatcaaacctaaaataagtttgatttaaatatgatactctaatctgtagttgattttttaatgaatacagttatagtcttcagagtccagctctgggctctggttgattctgctttcttgggagaggcctagggtggacacagtatatactaacatttactgtcctcctatgctcttcacacaagacacatatactttttcttatttttttctttcctttgcttttaacatttcctttatttttaatttcagttgcttctagttgaatattttctctaactgttagctggatgtattcctgactacaatggtagctgacactgtcaggcactctatcttctgcaatgatgacatatccaaattttgtttgggggtcaattattcttgacatgattgtggtttaccttgactgaccccaatcaatcttctttgtcctatttctcgtatcatagcagacatctcaagtgcctaaataataaatacaatagacatagtaatactcatatcagacaaaagaagattaataggtaaaaaaataaactgaggggataactaacacttgagaatccagctaatatgatgtcgaaatatataaaacaaaaaatctcgtaaaacaagatgatagtaaaaaaatgtaataatcagaatcaaagacttcaaggtatctctctcaacttttaatctgtcaagtaaacaaaatttgtagtggaattagaagaattaacatggtagtataattaacagtatatatttacctctgtacaaggagagaatataaattttttgagttcatttatggttcaattttcaaaaaggcataaattctttacccaaaatctagcataaattcctcatagtataaattatacaatccataatttatgaccaagattcaatgataaaaggaagtgatatgaaattaataaccatgaatgagattaatcacaaatttttaagacacatgtaaatgaatactgagtcaaagaggaactataaactttcattacatagttggtaaacagttaacaactacaacacttacgaagtttatgagatgtatccaaagccgtattcagagtaaaattcatagctttaaattctttatcattaaataagaaaaaaagaaaataagtggattatgaattcaaattgaaaaaacaatgaaataaaaaatgcaaaagaataaatcaatgaaaattagaaattaataatgagaatagaaaaaggatgtatatttatgtatgttatatacctatgaaaacttctgaacttatatatatataaaatatataaacatttgtatataaattttttatatatttatatacatataaataatatacatatatacatgcacatatatgtgtaaattcagaatttgtctgtcctcaaggggaaaaataatgaggaggtacaatacattagatatcctggaaaactgctgaaaatatattaataagtaagaaaacagtaatatacatagcaacttggaaggagatagtactatatacacagaaacttatattatatatatatactatatatatatgtgcttaaattttttaggaaataataaatctctgtgaaagtaaacattctcaatgctaaatcaagatggaagaaaaacctggactagattaaaaactgttgaagaaactgagttttaaagttttaccttgcatgcccatctttagcagttttatgagtgagtttttagaaacttaccaaaaagaaagaaagaaagaaaaaaaagtgttagaataaaacaggtaatttttagtttcattacctagcccaaggacagaaaaaataaaagggaaattcattactggttttaaaaataaagcataaacataattttaaacctaacggatacagtactcacatggtaacagagacccatttcactattttgaatgcaaaactttaaaaaatgatatagaaaatgaaagcagttgtatgtttaaaaagagcaatataccatgaccaagtaagaattgtactaggaaagcatgaaatatataaatgatccgactatgaggacatcatataataaattatacttatagatattggaagttactttaaaaagtggcataaatctagcaactatacctgttaacacacgtttgcatatattgttaggtcccatgtgttgaaattgattaggggaatggattttggaacagctaaaactcttaataagatctgccaggtgaatgtcaaacctggatgccatgaagcttaatgagtcaaaagcagaatggtgcttacaggaaatagttcaagaggggaacataaaaccaaccaggtaaaaatgtagacaatccccaaagtcaaaacaggagcaagggtccaagctaacatctgtctatggaagcttaattacttctccagttggtgtttactctctttaaatgttgactacatattttatttttttcccttaataataatgactactttttgttgaacactaacaccgtctaacatatttataactcaaaaaatgaatgtggaaatcctttaagttttatacaaatataatgcagactatacaaacagaaggcatttaaaaattgcaagtcttcaaaatactgcattgcctcaaaataataactatacacataactgattatttctatctattgtttacagtggaattggttctgtttttatctaagtttttaatttcctcagtaggacttgtctgtccagatcttttttaaggacatggataactttcgtcacagtgtaactcatcattattacatatttaccactagattaaggtcatatattggtaagataaagcactctttgcatttacttggtagactgatggaaatgttggtagctgttgaaagtgattcatcaatcattgaaaatggtaaatgaatggatcaatgcagggaatgtgcattagcactatctttgtactactgaaagaagaaaatgtacattgccaaaaagtgggagcataaacatacccttgtgcaaggtagaggtcatacgagtggctcgttttagaatgctagcctcaccattgccagtcttttcaggtttctcttctgcaaaatagaaagaataatgatgcctactttatagtttgattgtgaagactagtgttataatatctgaaaaacacaaatacggttgctaggcacacatatgttcaataaatgttagctatcatcatatttttcattgatagaaattttgagaacttaaaaagatagctcggccgtgttcagtggctcacgcctgtaatcccagcactttgggaggccgaggcgggcggatcatgaggtcaggagatcaagaccatcctggctaacacggtgaatccccgtctccactaaaaatacaaaaaaaaatagccgggcgtggtggcgggcacctgtagtcccagctactcgggaggctgaggcaggagaatggcatgaacctgggaggtggagcgtgcagtgagctgagatcgcgccactgcactccagcttgggtgacagagcaagactctgtctcaacaaaaaaaaaaaaaaaaaaaaaaaagatagctcaaacgttgttataaaactgtcagccacacagtgggctacgaagggaagaggcaattgtgttttctggattataccaaactctgttggaaaaatgatatgcaaccatcaacattagttggtaaaatcatgtctaaaattcatacccagtaaatgattaagatagttataaactgaaaaccaaattcaattgcttcaaaatgtatgttatctaactcttctcagctcataaaatgtaaatgttactttaaaattgtgccaaactcatcctatttttttttataaaaatgagaattttttttttattttagattttagattatgttttagaaagaaaacaaacttggccagaaacatcaacagaattccattttaaaatcatctttttgatttgtttttttgcacaatataaaaaatacagtggttgaacttccttatccacaggcaggttctatttttgtcccatttagaccagctttgggcaacaaaaacacagagttacataatcaatattcaggttaataatgttatatcagtaaaactcatgctacattacttaataatatattaattggtctttacctacaccagacgactgcttcataatagtaacataattttgaatgtaaatacaatgtccagttcaccagtgcttggagttgcattttcttctgtatgaccacagcttattatgtgaaacagcatgtaactcctcacatatctctataagtgaaagcagtgggattagtggtttaaacaatttcacagtgccacattttatcctgagttccctgcctgaggcagaaatagagctgacagcatcctgttaaacagaacttctacccttaggagctgattcatgaattgtgaataaatggacctctccaaaatacctcatgttctctcttcactgtacaggctacctattcacatatttatgtagtgcctaaaaccatagtatgaaaaccccttgacgagtacattatttagatttttaaaaatatatatacatgggactgggcatggtggctcacacctgtaatcccagcactttgggaggctgaggcaggcggatcacctgaggtcaggatttcgagaccagcctgaccaacatggtgaaacctcatctctactaaaaataccaaaaattagccgggtgtagtgacaggcacctgtaatcccagctactcgggaggctgagacaggagaatcacttgaacccgggaggcggaggttgcagtgagttgagatcgcgccattgaactctagcctgggcaacaagagctaaagtccatgtcaaaaaaaaaaaatatatatatatatatgtatatatatatgtatatatatatataatatgtatacacacacacatgcaaaactttttatttggtgtaagctggaagttaagagtacaaatttcaaattatttttaataatacagatattgatatactgtctctctaaaaattatgatgtcctctttcttcctgagctgcagaagtagctgttttcataatctggaaaacatagtagacttttattaagacaattttgacatgcctctgttaagtaataatattcaactttatattctttgcagaggtgtatattatgcttctgttcttaatatagttatcacctttatgtgaaagggctaagcattaaaaataacagcatactgctttgagtagtttttttttttttttgtctaattccaaaagtaatacaggatcatcatagagaaaagtgttaaaaagaaaataaatatttctcacagtcctacaactcaatgaaaaccacattttctttgtaaaaccaaccttgcaagtattaattttagctttatacacatttacaaatgcccttataataatgtccgtacgtatagtagttacctgcttaatatttaatcaactaatgttaaggagggaaatttggaatggagaggatctttagacatatctgtattggggaaggcctggtttgaatgttgatggcagttaccttttaaacagcaactaccatatgtcaagtattgcaattgtacgtagcaattataatgctatgtatatttatgatgctgctttctcttcctcagtttatagaaatactacatcctctgtgtcgtttgtattcatagttaaattgaggccatataactgatctctggccagcgaaatgtgaatgaaagtcacattttcagctgttgcacattgaagagcaaagtttacctccttcaggctctcttcccttctcttcagaaccacatagctttatacaaagacatagctttataatggcataagactgcttgctttctgttgaaatgggattataaccaagacaaatcaagatatctttgttatattaagccttataagactggacggcttgtctattgtggcttgctagtgttaactatcctctgaatttatgtattatgtattatagataaatttatgtattatagataaataaataaatttcaaggcactgcccaagcgctttcctccacgaagtggcagaatctggttatacacaagatgcgacttttaaaatcagacttattttccagtatgggtgtggaagagtatttgctctgttattttacttaaactcccagcacctcagttgctcatttgaaaaggatggtaatatatatcaaaaggttttcatgaatgttccacgagaaaatatatataaagcattcagcacagttctgatctcagaatcagcatttggtaaaaatagcattattatggttgttgttgtttggcagaagtaggattctaacctaggtctggtttgctgtaaaactagtattgcctctaagtctattggcctgtctctctttttgtagaaagaaaataatttttaaaaaacccataggaatgctataagctctttaagggcaaggtctagatctcacccatctttgtatccctgggacacagaaggtaaactgaaacattatagagaatgagaaaatatttgttgaattagaataaacagaattgaagatgcgagaccagaaatgtagtcactttctttcatgctcccagaaggtattatgtaattttagggacatactcacaaatatacacatacacaaacacacacacataccattcattatttctgaaatcactttatcagaagaacctacaacctagtattagtcctgcattggacaaaaaatcctaaaatacaaaatcttctatgaataatattacaccaagaataaatttcagtcaaaacccaataatagaagcacttccagaatggcagaataaggacgttcaaaaatatattccttcataaaagcagagagaatatggggggagaggagggaatgttaaaatccacttttttggaacacaggaacttaaccaaaggcttacatcaactcaaggagcacttattcaagaaaaattgctgaaacttactaagaagagtgaactcttttatgttttaactttctccagtcctaaatagaaaagctggagagtgaaatgtccaaaggggatttgaagcacactgacatatttctaagactatggaaggacacatacatgcaagcggagggctgtgcacatgcataggaaagacttgagaagggtctaatctcttgcatctggttgacctcaaggacttgcacaagcaggaggtaaaggctaaggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgactttaagataaggagattatctttgattatctaggttgacccactgtaatcacaaagttcccttaagtgtggaagatgaaggcagaatggtcagagtaagagtgatgtgacatgaaaaagggattctcccctagagagacaagagagaaccagctcttataacaccttgacttcaatccaatgaaacttattttgtacttatggcctccagaactgtaagagagtaacttcatgttatgttatccactaagtttgtggtaatttgtcacagcacaaaaagaaaacaaatacactattcttccacaactatagttgagttttctatactaacctcctgtcaatatacaactttgatgagctcatttattaatttaaaaaattttagtatattttttagacttctctatatacaagatcatatcatctctgaagagagatcattttactttttcctttctcatctagatacctttgattgtttttttgttatcaaattgctctggctcgaacctccagtgcaatgttgaaaagaagtgacaaatgaagacatccttgtcttatttttgattttaggtaaaacgtgatcagtctttcaccgttaagtatgatgttagttgtgggatttttgtagatgcttttattaggttgaagaagtttatttctatttctagtcgaatatgttgatcatgagaggatgttggattttgttaaatgctgcttctgcatctgttgaaatgatcatttggtttttatcttttattctatcagtgtggcctattacattgatttttgtatgttgaaccaaccttgcattcctgaaataaatgctagttgcttatgatatacagtcatttatatatgttgctggatttggtgtattagtattttcttgatgacatttttatctgtattaataagagacatgggtgatgcctttttcaggttttggtattagaacaatactggcctcacagaataagttaggcagtgttccctcctgtcctattttttggaagaatttgtgaagtagtagtgttaattcttcttaaatatttgggaaaattcatcagtgaagccatctggtcttgggcttttctttgtggaaaggttttgattactgattcaagtacaagaatttgtctactctatccaggttatctaatttgctgccatttttttctcatatttgttgccatgttgttaacaatttcccttataaatcctttataattctgtaaatctggtaatgatgcctttatataattattgattttaataatttgagtcctctctatttttttgttgctcagtagagctaaagtcaattttgttgctcttttcaaaaaatcaacttttattgttgaattttctatatatttttaaattcttttatttatttacattcaatattattttcttctgcttgatttggatttatttttctcttctttttctacttgcttaagatagaaggtttggttatgatttgagatatttgttctttttaaatgtaccatttacatctgtgaattttctttcaagcaatgctagaattatcctataagttttcatatgttgtgtttttgttttcattcatatcaaaatattttcagatttcccttataatttcttttttggccgattggctattttaaagtgtgctgttccatttccatatatatgtcatgtgctgcttaatggtgaggatacatttgataaatgcatcattaggcaatttcatcactatgcaaacattggagcgtgtacttacacaaacctagatggtatagcctactgctcttccaggctatataccatagactatacagactatagcatattgccattgctattgctcctatataacaaacttatatagttactgtactgaataccatatacaattgtaatataacaatattttatatagaaacacagaaagatatagtaaaaatacagtataaaagataaaaagtggtatacttgtttagggcatttaccatgaatggagctttcaggaatggaagctgctctgggtaagtcagtgagtgagtggtgagtgaatgagaaggcctaggacattactctacactactgtagactataaacactgtacacttaggctatactgaatttgttttaaaatcatttttcttcaataataaatcaaccttagcttacgtaaccttttactttataaactatttaattttttaactttttgattattttgttaacagtttgaaacacaaactgtacagctgtacaaaaatattttgtgctttttctataaatttttctctattttttattttcaaactttttgttaaacacaaagacacacacattagcctaggcctacacagggtcaggatcattaatatcactttggcccacttccacattttgtcccactggaagttcttcaggggcataataatatgtaatatacccttaaacaactagcagtgcagtagatttgtttacaataacatcaccacaaacacatgagtaatgtgtagccatatggcattatgaaggttatcatgtcactaggccataggaatttttcagctccattataatcttatgaaaccatatcatatatgcagtccatcactgactgcaatgactttatatggcacatgactgtgccttattccattggccaaagctcagagggagggattgtggggactatgaagctacagggttaagggcttggatgcaggaagaagtggagaattaggaccatttttgaactctgtcatttatatgcatgggatgaccatacatctaggtttgcccagaaaagtcccagtttattcctgtcatccttatagaaatattattttttaagaaagagaatcttgctctgttgccctggttggagtgcagtggtgcatcatagctcactgcagcctagaactcctgggctgaagcaattttcctgccttactctccatacgacctgggactacaggcacatactaccacatcaaactaattttttttttttttgagacagggtctcactttattgcccacgctggtctcaaactcctggcctcatgggatcctcccactttgaatcacccccttgttactctaaaaagtgtcccaattttaatgataaattatatgggaactctacatttggagggttttaaatagaatggatgcactcattgaaaaaatctgtgaagtaagcagaagaattaagataagtttagagtccatcaaagaggttccaggaagcaagagatgagccaaaacagaatgggtctgaagaagcgaaaagggatacatgaaagagggctaaatgagaaggtcaacagcatcaaggcatagactatcaaatgaatgtgtctgttgtgtttgtcaactagaaagttttttactgactatgatgagaggcttcataggagtggttgcagtgaattaaagagtcaactaattcttgctctcacactgatttaaaaataaaactttaatttcactcttttgggtcttacatttaaaacaaaagggaccagactctgcggaattgagatcctctgagtgttaacattttcaggatctgaatactaaatacagatgccagactaaaaccaaatgtgtaagaaccaagacctgtagcttacatttattctctatccatcatttttgacactaaataaaaatgatctggtgtgtattcattgggaattattctgattttattttattacggctgtaaattcattttccttcacgtatttgatgtctttgattgatgcaaaactcaataagacttactgtagttacattaaatattaaccagaacattattttgaaacatttgggaagctgtgacatctcaacctgatccaaaaccttagtatatatattaaacacagcaactaaaagacttgccaagatatgtttgacaattgtcctaactttgatgaagaaaataagaaaataccagtttccccagtagagagtttactgtgaaaagcattgcagatttgacattgcgtgaaagtttccaactataagcaaatgcagacttaatggcagtaaatgacattaaattttttaaatgacaaaacctgcatttgaaatgtaggtacataacttttagttatttgaaacttcaaggatagctaattggctaatacataaggggacagaaaatctgactagtattaactttgaaccaaaaaaaaaaaaaaaagaagaagaaaagaaaagaaaaagaatctttgtgtagttgaatccttatcttggctgttacttacacattgcaaacctattttgtatgagtgcacatcaaattccctttgggattctcaatttcatttattttatcaataaaaagagcctccttgtggagaaaggaataagtcacatataaatgaagtagaagagattacaccagtacctgagcttttactttgactaatccaatagctttggccaaatatctcaatgtcaaaagcattataagtattctacgacgtaagtctggaaaagagaaattaataagaaagtattggattgattaaaatgtttacttttcccctccatccttccccttctcaagcttaatggctctttctcataccaatctgatctttgttatggttattggctggccttgtttcttgttataactccacatctagaactcatttctgcatcatatacttttctgtctctccataatttcagtattagggtcctcgctcagatgcatgtcctttgtcactgaacttgacgacaggctttaaagagattttacaagtcccatttacacaaattatttattttggtcttcaacaatgttaaaatgcatgatgtaatttttatagaagagaaaacatgcttagcaagataattctgccaaagatttctctgcttaactatatagttaagtcttttcaactattttgctcatcaaagatcttgtacatcatagaagattctagaaaagtgaccttgatatttatcttgcacctcagtgcctttaacatgtactttttctgcttagaatataccccaaactcttttcttcatcctttttaatgtgtcttcagggctgagctttcaaatccacttattaaggatatctttccccaacccttaaattattatttaagataatttcccagataagtttttctgtttatatgtctttatcagaattatgatacatgggtttttttgtttgtttttatttttgagacaaggtctcactttgctgtgtagtcaggagtgtggtggtgtgatcttggctcactacagcctcaacctcccaacatcaagtgattcttccacctcagctccccaaaaagctgggaccacagtcacacgctaccacacccaactaattaaaaaatcatattttttgttgagatgagatctcactatattgtgcaagctaatcccaaactcttgagttcaagtgatcctgctgtcttagcctcccaaaattctgggattataggcatgtgccaccactcccatccacataaggcattttttatgaatgcctgtgttctctactgggttgtgaacttagggagaggatgaggataccataatatccacttatgtatttccaacaccttatggcactgaaaaactattgtcatctgactaatggtctagttgccattttagggcctcatgatctcatttatgaatcatgacacaaactgccttattttccatgtgccaatctcaattccatattgtccaggcctgactgatttgtgatcttaaaacatggattttatcatgttacattctgcaaccacactgtcactatctgttatttatggaaagacaaaagtgatactcagtgtatcattcatgaccctccatagattgacctagatcaaatttctgaccttgtcataccctcttctctccaacacaagcactttgtctttgccatagtagctgatagaatggattcagaatacttcttcctgttcatctttattttgactttctacttgtgttcttactcattttgaattctctctaccttcttactagtttatattattgatataataatttcttttcatttgggtagatacctagtagtgagattgccggattgaatggcagttctatttttagttctctgagaaatcatcatattgttttccaaagaggttggactaatttacattcccaccaatagtgtataagcatttcttttccttcttatcattgccaatatttattttttgacttttaaataacagaccttctaactagtttaagatgctttctccttgtgtttttaacttgtatttgtcaatatgctttttggccacttgtctgtcttcttttggaaaatatctattcattttctttgcccactttttattggggctattgggaatttttgttattgcggagttttttgagttccttgtaaattctggatatcattaccctgtcagatacatagtttgcaaatattttctcccatcctgcaggttgcctgtatactctgttgattatttatgtttctgtgcagaagcttttcagtttaattaagtctatttgtctagtttggtttttgttgcttgtgcttctgaggtcttagtcataaattctttgcctaaaccaccatccagaagagttttctctgttttcatcattttaatagtttcgagtgttacatttaaattcttaatccatcttaagttgatttttgtatatggtgggagataggggtccagctttattcttctgcatatagcaatccagttttcccagcaccatttttgaaaagggtgccctttccccagtgcatgtttttgacaacaactttgtcaaagatcaggtggatgtggatgtgtgatttaatttctgggttctctattctgttctgtcaatctgttgtctattttgataccagtacaatgctgttttggttgctgtagctttgtagtataatttgaggtcaggtaatgtgatgcctccaaatttgttctttttgcttaggattgctttgtctatttgagctctttttttgattccatatgaattttaggatttttttttctaattctgtgaaaaatgacattggtattttgatagagattgcacttaaactgtagattgctttggatagtatagtcattgatattcattcttccaattcatgcgcatgagatggttttccatttgcccgtgttatctataatttctttcatcggtgttttgtagttttctttgtagagatgttttacctccttggttaaatatatccatgggggtgtgtgtgtgtatatacatatacacacacacacacatatttgtagctattgtaaatgagattgctttcttgatttaattctcagcttgatgattatcagtatatagaaatgctactgatttatttttaatttcagcttttattttatacatagggagtacatgtgcaaggttattgcatgggttcattgtaactaggttgtgagtgtagtacagaacaggttgtttttcaaaccatgaccttctccctccctccccctccttgtagtctgccatgtctattgttcccatttttatagcagagtgtgctcaatctttagttcctacttataagtgagaatgtgtggtatttggttttccattcttgcattggttcactttggattatgacctccagcttcatgcatatagttgcaaagaacatgatttcattcctttatatggctgtgtagtattccatagtgtgtgtgtaccatgttttatttatccaatccaccgttggtgggcatctaggttgattccttttctttgctattgtgaaaagtgcagcaatgaacatatgagtgcatctgtctttttggtataatgatctcttttcctttgggtatatacccagtaataagatagctaggtcaaatggtagctctgttttaagtttttgagaaatctccaaactgatttctacagtggctgaactaatttatattcccacagtgtataagcattcccttttctccacaacctagcaatagctgttatttttttacttttagtaatagccattctgaatggtatgaaatagtatttaattgtagttttaatttgtatttctctgatgattagtgatgatgagcattttttcatgtgtattggctccttgtatgtcctcttttgagaagtgtctgttcatggcctttgcccactttttaatgaggttacctgttatttgcttgttgatttgtttaagttccttgtagattctgtatattaaacttttgccagatgcattgtttgagaatattttctcccatttctgcagattgcctgtttactctgttgatactttcttttgctgtgcagatctttagtttaattaggtctcacttgtcaatttctgtgtttattgcaattgtttttggcaacttagccaaaaattatttgccaaagctgatgtcaagaatggtatttcctaggttttcttctaggatttttatagtttgaggtcttaacatttaattctttaacacattttgagttaatttttatatatgatgaaaggtaagggtccagtttcattcttgtgcatataactagccagctattgcagcaccatttattacatagagagtcctttccccatcgcatatttttgtcagctttgttgaaaatcagatggcagtaggtgtgtgactttatttctgggttctctattttgatgcattagtctatgtctctttttgtagcagtgccatgccatttggttactgtagctgttcagtatagtttgaagtcagataatgtgatgcctcaggctttgctcttctttgtttgaatgacctgttaaggctcttttttggttccgcatgaatttttgaatagttttttcctaattctgtgaagaatgatgtttgtagtttgataggaatggcattgaatctgtaaattgctttgggcagtatggtcattttaatgatattgactctcccaatccatgagcatggaatgttactttgtgttgtctgtgatttgtttcagcattgttttgtagttctctttatagagatatctcatctccttggttagctgtattttcctaagtatttcattttctttgtggctattgtaaatgagattgtgttcctgatttgactctcagcttgcacattattggtgtataggaatgctactgatttttacatattgattttgtattctaaaaccttactaaagttgttttatctatcagttctagcagccttttgacagtcttcagattttcctatatgtaggatcatatagtcagtgaagagagatactttgacttcttctttttctctttggatgctatatgtgtctgtttttatactgctataaagaactgcctgagactgggtaatttataaaggaaagagatttaattgactcacagttcagcatggctggggaggcctcaggaaacttacaatcgtggcagaaggtgaagaggggaacaaggcaccttctccacaaggcggcaggaaggagaagtgccaaggcagggggaacaaccccttataaaaccatcagatctcttgtgagaactcaccatcccaagaacaacatgggagaaactgcccccatgattcaattatctccacctgatctcttccttgacacatggggattatggggattacaatttaagatgtgatttgggtggagacacaaagcctaactatatcagatgccttttatttctttctcttgcctgttttcagtactatgttgaataggagtgatgagcataggcatacttgtcatattccagttctcaagggcaatggatccattttttgtctattcagtatgaggttggctgttggttcatcatagatgattcattattttgaggtatgttcctttgatgccttgtcttttgagagtttttattataaagggatgttggattttatcaaaagctttttatgaatccattgaggtgattgtgtgatttttattttaattctgtttatgtgttaaattatatttattgatttgcacatgttgaatcagccttgcattacaggaataaagcctactacatcatggtttgttaatgttttgatgtgctgctggattcagtttgctagtattttgttgggaatttttgtgtctatattcatcagggatactgacccaaagatcctttttttatttttgtttctctgccatgttttcatattaggctaatgctagcttcatggaatgagttagggagcagcacctggtcctcaatttttggaatagtacctgttcttctttctatatctgttagaattcagctgtaaatataacttatccatggctttttgggtttttttctgtattcaatttcagattttgatatttacctattcaggattttaatctgttcctggttcaatcttgggagattatttggttctagtaagatatatttcctctaaattttctaatttgtggaacagaattactcacagtattttctgaggatcttttgtatttctgtgggatcagttgtaatctcatatttgttatacctgattgtactgatttgtatcttctctttttttgttaatctagctagtggtctattcatctaattttttcaaagaacaaacttttggtttcattggtcttttgtttgcatttttgctttgcaatattatccagttcttctctaattttaattgtttcttttcttctgctagctttgtggttggttgtttctttgtttttgtttttctttttgtttttgtttttttgagacggagtctcgctcctcttctcccaggctggagtgcagtggcgcgatctcggctcactgcaagctccgcctcccaggccattctcctcctcagcctcccgagtagctgggactacaggcacccaccaccacacccggctaatttttttgtatttttagtagagacggggtttcaccgtgttagccagttcctttaggtgcaaaggtagattgttaatttgagatctctctaacttcttgatcaaggtgtttagcaatataaactctcctcttaacagactgcattagttacatcccagagattttggtatttgtttgcctattttaattaatttcaatacttttttatttttgccttaatttcagtgtccacccaggagttattgaggaccaagttgttaaatttccatatatttgtgtagttttaagagatctttttgatattgatttctatttttattgctctgttgtctgagagtgtgcttgactcccagatgattttaatctttttttaattgagacttgcttcatgaccaattatgtggttgatcttagagtatattccatgtgcagatgaaaaagaatgtgtatgttgtggttgttcggtagaatgttcagtagatgtttattaggtccatttgcttaagtgtcaagtttaaggccagagttcctttgttagtattctgccttgatgatctctctaatgcagtcagtacagttttgaagtctcccactattatagtgtggttgtctagaccttttgatatgccaagaagaacttgttttatgaatctggatgctccagtgttgggtgcatatatatttggggtaggcaagtctgcttgttggattgcaccctttatcattatgtaatgccttccattgcccttttaaatttttattggcttaaagtctattttatcaggtatgagaatagtgactcctgtacttttatgctttctgtttttatagtagatctttctctgtccatttactttgagcctgagtccttacatgtgtgatatatctcttgaagacagcagatggttgggtcttctctttttatccagcccaccactctctgccttttaagtggggtgtttagcccatttacattcgggattagtatggatatgtgagatttttattctgtcatcatgttgttagctggttgtcatgtagatttttattgtgtgattgtttcctagtgcctatgggctatgtgcctaagtgtgtttttgtggtagcaggtgtcattcttttgattccacatttagctttcccttaagaacctcttacaaggctgatgtagttgaaatgaatccctcagagtttgcttgtctgagaaagattttatttctccttcccttatgaagattagtttggtggaatataaaattcttggttggaatgtctttcctttaaggatgctaaaaattgtcccagaatctcttcttgcttttatggtttctgctgataggtctggtgctagtttcttccatatgtgatttgacccttctctctagctgcctttaagatgtttttctttttcattgaccttgatgaacctgatggctatatcttagtgatggttgtcttgtgtagtatctacgctgttctccatatttcttgggtttgcatgtcaacctctttagtgaaattagggagattttcatggactgtatactcaaatataatttccaagttgtttattctctctccttctctctcaggaatgccaatgagttatagactctgtctcattatataaacccatatttctcagaggttttgttcatgttttaaaattgtttatttttatcttactgtgttgatttgaaaaactgatctttgagctctgagcttctttccttagcttggtctaatcttctgttagtacttccaattgtattatgaaattcttgtagagaatttttcagctttagaagttcagtttggttatttcttaaaatggctatttcatctatcatttcttggatcattttactggattccttggattgagttttacctttctcttgaatatcaatgaccttccttgccatccagattctgaattccttgtttgtcacttcagtcatttccaactggttaagaatcattgctggggaggaactggtagactcctttggaggtaaggagaccctctgtctttatgaattaccagagttcttgtgctgatttttgtacccttaactgtagtttaaatatagtcagttggtttcatttctggatgtttttagacagccaatatgctctctgtagggtctttatctgtggctgatttcttgcctttgtttcacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtaagaaaaatggcttaatctatgagataaaccttacagtatccatagttacacatacctgtcatgtgattcagaccctgtaattcacattcccttgacgctcaaaataattcagagatccaacagctgagattctgaattacatatttttacaggattatagttttacatgacctggaagtcttcagaatgaagaccaaaatatacaggagaaactctatttttatgcttagcttcaataaattatagacagccatgtaaaaatatgattggataaaaagggtatgatctagtgctaattttctaagtagggaaacccagcaaagcatgcctgttttggtttttcgtgacctctctgtgcagcatttcccctttctgggtatggtagaagattctgtcaggattggaatcttatgacctacagtcaaacaaggtaggtcagataatttctctgtggccaatttttacacagaaaggctaggagaaaattagagtaatatttttaggttttgtggttggcttttgagaaaagacgttctggtttctatgtcctgcctccatggggaacggatattcagaaactagaatccctttggcctgggcaggaggagagtggtggcgggtagaatgagcagctagagaaagaggggcattaagcaggaataggtcagagaggactattgattctgaggctgtatttgaggactgcattttaaggtgtcactttctgatccccaacactggccttgttgaaaaaacaaccacagcaacagtagcagcagcagcagcaaaaacatgagaataaaatccacccaaacaaatgatgaattgagatgcagtgacgaaaggattggtgtaatgcttaatgccaaaaaatatgagaggagtgccaacaaacttctgaggggaaacaagcaactatcacagcaacaagtagatctcaaatgtattagaacttgagggcatatgacttataaaccgtttatgaaaaaaaaaacttggaaatcaaatttttccaaccaaaaaaaatgaatcaaaataacacaggtgaaagaaactgtggataaaggactcatgaagatgactaaaaccatttaaaattagaacaatggacactatgctggtatatatcataacagttggagagaaatattaaaattatcaaaatctggtaaggagtagaagtttaacaattctgatttttatgtgctttcagagctgggagttggaagaaatgttataaaagtgaaatataagattttttttctatttttaaaactttaaaattttgttaatattttagacctacataagagttgtaaatatagtacagagagttctgatattgtcttcagtctgtcttaccctaatgttgacatattacataaccacaatacaattaacagaataagaaattaacactggcatcatacttttaactaaactatagacttcaatcagagttctccagtttttccattcatgttgtttctctgttcctgaatcctatcaagcatctattgttgcatttaatagtcatgtttctttcatctccaatctgtgacagttcctccattgttttttcgttttgttttgttttgtttttgacaatgttgacatttttgtagactactggttatgtatttcgtaaaatgactctcatatcgtattcgtctgatgttttctcctgattaaaattagagatttctgagatgaataacataaagatgatgtgtcttcaatacatcctatcaggtgatgaaacatgtaatttaaaaaatattaactactaaatgttttcataatttaaaactggaggggaagaaaaatgcacttgttcaaaactttctgcagtttaatttaccttttttcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaaggtaattgcgacagttacttttgcaccaacctaatatgtacttttctgttctgatttattttaatttgcttttagaaagatagagttattgtttaaacaaaaattcaatgtttttgagcatatattatttattttgcatttttatttagtttgtatttctttcagaaacacaattctggaaagatacaacagtgtttaccttgaaggagcaagaactgtggatgctttgaatagacttatgttttcttatttgtgatgtgaacttttctacaagggaattatattacctttcaaataagctacatatgttactgtttcataatttctttatttttccatggaaattatttaacattttattttctgacaaagctcctgtttataagttatattttctgacaaagctcctgtttataagttagagcattcagagatttacttagaactatcctcagcttggccacttctatatggttttgagaaaagttaggtacattattatctcttaaaaaacttaaattagaccacaagctagttttgaaataactcaactgaggttattctttgatgactgacagtacaagagaattgtcatacactcagttattagttctttagacaaataaatatttaataaataaatatgttatatattatacatattaataggacaatgtaagtacacatgaaagttggtggtggaaaaattgccattgttactaatgctgtctcatgtctaataatgatagagctggaaaacagatgtttttctaaggcaaagaatttactcctaaccttttcttttatattgacatcatattgccattgtatgtcaggtaactgagtggaaagagagaatagagctgagggcacatacaattcatttagaattattctagtgagatgctcattagactagaaaataaaaacatatttggaggaaaacatttcttccctcactcctacaagggataaaaatgctaatatagttctcaatgcacagaacgtaatcaaatctacttcatagaactgatatactactggtatgaatgacctgtgatgatatactgaatttttgctttaatatttgttcttttcattgtttactagttttaaaacaccataaaatatttattaaaaaacctttaagggatttttttaaaggccatattgtaaatgtctttgcattaaacatttcataaggtatatttccaaatcttaaacaactttgctgtttgagtacaatatcagtaaatggcactttaagaagatagaaagccatctgcatccaaaatataaattaaaattatatgtaaaataaatcattttaactttagatagaaagtaacaacttaaatcaccttctatatagtgtataaatatatcatctaaaagatacctaaattttgatgtaaaaatgttctcaatatattttaccaggctgagaaaatcttacaagaattatctaggtatgtaatcattatattaaaatgccaaagacatattagacttgtggttatatttccttgggcaacaaaatagattttttttttaaatctatgtgtcttttaaggtaggggaaatagtaatgctgacaacaaagttttctcactaaatatatctgttcttctttgttaatatttacagtcaaagggggctgttctctggccaacctgcacccaggtgaaataaacagccttgttgctcacacacacacacacaaaatatatatatacatatacatatacacacacacatatatacatatacatatatacacacatatatatacatatacatatatatacacatatatatacatatgcatatatatatacatatatatatacatattttttaaccgcccacctatgtaaagtactctaccacatctgacaagttgagaaaaatgatgacatcaaatgttgcctatgggaagcctctaatcaactaaatatctcgacttcaacactcaaatatactgctacagcattgtaaagtgttttgtaccctctgaatataatactgtaaaatgttctacattattatttgaagaaaattgttgaggaataattttacagtgtgtaaggtggtagatgcagatgaaataattataatatgaaaatattgagatcataaagtaatttcccttgtagttacctttatgaaagttgtacgattgagtttaatttcaataaagcaacatcagccataatttagtgtcctttaagtgaattaagcaatttcaagccttataaacatgttcaagttcagtgagaaggacactttttagaaaatttctaagctaatgactttagtggcattggtaaatatccagagactgtgtgaggaaaacacccgaatatagaactgtaaaatctaaatagagaaaccattgtgttaaatctgaaaacatattagtaagtgacattttcctttaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtcgctattaagagtttcaggtagtgctaatataattacaattcttaagtcaattgatggacactttgaatagagatttaaatgaagaagtttatcattggcatgcatgctgtatagtcccaaatatctcaatcctattatattaaggatgagtattatattggagtaatattttatggctttcaaaatatgttttaaattgttacttttagagataccaaccataatacctaatacctaagtaggcagagctgtagatacaatcattctgaggtgatctgaccctacactgacaataacagttgtcagtagagatcattgaaattcatatttttctactttagatgaaatgtattttgaatgtcttagctggtattcaaagaaaaaagaaaagatgattaaaagcaatacaatcataggaggcttccagttccaaaattgtgatgtagatggaacctggcttcacttcccctaacagaaagccgaaaacaaatatacaatgccaagattatcaccagaaatatcccagaactcaaataaggaaatgagaattcctggggccacaaagaagtgtaatattaataactctaaggagatggtaagataataggacttccacatctgcaatatctgtcccctcattctgcctgcctccaggtgaagagaaaaatttttcccaattcactgtttctgcactggcaaaactgagatcaagatggacaaccatcttccccatcatattgggtagcctggcaggagacatgtttctgtttttactcacagaaagcattacaagtacttaaagggataaatatcactgagaatagccagtgacaaaggatggaggtagaattatcatccccagacctggaaaatgtaatctgtaatttggagatgtaatttgccaaaggagatgccaaatcagaatgactgtatagcagcaccacacgaaaggaggttcatctaataggtccctagaacacaaaaccctagacagccttcctccctgccaggacatcccctttaggaccttctccacttgggaaaggcagcactttgagcttttactagagccaaggcaaacctgggctgaaggctaccacccagagctgaaaaggaggtgatgacctagcagtaaaaatctgtgaggaaatgtatccaataaaaatcaaaacaagcaagacagagaagactgaaataaatacctaatctttcaatgcaaagacacacatatgtgtctacaagaaataatagcaaacaggaaaccatgatttccccaaacataaaaaacaaggaattaataagtgactccaatgagatggcaatatgtgagctctctgacaaagaattcaaaatggtagttttaagaaagctcagtgatctgcaagataacacagaaaagaaattcagaaatatatcagaaaaatttaataaagagattaaaataattaaaaatcacacagaaatcgtagagctgagaaatacataagctgaagtaaaaaattcatcgaagactctcgatagcagaatgaccacgcagatgaaagagtcagtggactcaaacacagcctacttaaaaatatacagaggagaaaaaagtctaaagaccaaaaaagatcacctaaaagatatagaagagtacctcagaagactaaatttaagaattattagtgttcatgagaaagttgaacaatagcaagtggcagaaagcttactaaaacaaaccagcatatttttccaaacttgtgtggagaaaacacatgcatgtaagttacatccaagcacacataggcgaacaacatcatacagatttgacaaacaagactacccaagacctatgataatcaaactctcaaaagtcaaggaccaagagtgaatcccaaaaacagaaaaagaaaagaaggaaaataaaaaggagttccagttcacctggaaacagacatctcaacagaaaccatacaagccaggaaagagtagaatgacatttctactaaagtgctgaaagaaaaagaaaatcaccatacaagaatactgtattcaacaaagctgtccttcagctatgaaacagaaaaattctttcccagacaaacaagagcttaaaagagttgatcaccaccagatatgtcttacaaaaaataccaaagagagttcttccatctgaaagaaaaaaaaatgtgaaggaaacaaacaaaaacatctgaaggtataaaacccactgttataattaagtgcatggccaaacccagaatactgtaatgccgtaattgtggtgtgcaattcactcataactctagtatgaagcccaaaagacagttctatcaaaaacaataatagttacaggaacctgttaagagatatgtaatataaaatatgtaaactaacacaacaaagagccaaaatgtatgtgtgtgttgtggggatggagttaaaatgcagatttttcctgttttttttctttgtttccattttttctttgtgatctaagataacttgtcatatctgtaaaataactttattatatctataagatatttttgtaagactcatggtgaccacatacaaaagcctataatagataaagtaaaaataaaaagcaacaaattaaaccatactagcagagaaaatcaaaatcttttaactacaaaagaatacaacaagaaagaaaggaagagatgaattacaaacaactaaaaaacaagcaacgaaatggcagtagtaagtccttatttacagtaataacactgaatgtaaatgaacttaattatccaattaaaaggcatagaatagctgaatgagtaaagaaacaagactttatgctgcctacaagaaacttcatctgtgaagacatatatagcctgaaagtgaaaagattggaaaatgatattctatgcaactgaaaactaaaaaagagcagaagtagctatacttatatcagataaaataaactacagattaaaggctataaaggaggccaaaagtgcccactgtataatattagtgaacagggtcacaaaaattctcaagaaaatattagaaaacttttgtcaagaacacattaaaaagatcattcactatatttaagtgggattcatctcaggagtgcaaggatggttcagcatacacaaatcaataaatatgtacatcatattaacataacccagaacaaaaaccatatgattattttaataggtgcccataaaagcacttgataaaatttaaatcactttataatgaaaaccctcatcaaaatggatgtagaaggaacatgcctcaaaataataaaggctgcatatgacaagcccatagctaacactttactgaatgggggaaaattgaagacctttcctctagatttggagaaaaagacaaggatgcccacttaccactttaccactcttattcaaaacagtactggaaaccctggccagagcaattaggtaagaaaaggaaatttaaaagtatccaaattggaatggaataagtcaaattagccttgttcacagaagacaagattctatacttagaaaaacctaaagacggcctggcgcagtggctcacacctgtaatcccagcattttgggaggctgaggcaggaagatcacgaggtcaggagattgagaccatcctggctaacatggtgaaaccacatctctactaaaaatacaaaaaattagccaggcttggtggcatgtgcctgtagtcccagatacttgggaggctgaggcaggaaaatcactgaacctaggaggcagaagttgcagtgagctgagatcgtgccattgcactccagcgtggcaacagaacaaggctccatctcaaaaaaaaaaaaaaaaaaaaaaaaaaaaaaaactgaaagactctaccaaaaaacagtaagaattgataaatgaattcagtaaagttacaggccacaaaatcaacatacaaaaatcaatagtatttatatacactgacagtgaagaatctaaaaaagaaatcaagaattcaattccattaacaatagctacaataatataaaatacttagcaatcagtttaaccaaataagttaaatgtctgtacaaagacaactataaagcattaatgaaagaaatcaaagaggacagaaacaaatgaaaagatatttcatgctcacggattggaagaattaatacttttaaaatgacaatactacccaaagtgatctacagattcaatgcaatccctatcaaaataccaatgccattttcacagaaatagaaaaagcaatcataaaattcctatggaactaaaaaaggccctgaatagccaaagcaatcctgagcaaaaagaacagagctggagtcacactacctgacttcaaaatttattacaaagacatagtaaccaaattattgtggtaaaaatagactcataaaccaatggaacagaatagaagacccagatataaatccgtgcatttgcatccaactcatctttggctaaggtgctaagaacataatggggaaaggatattctacatatgttctcactcatgtggaagctatatttaataaatggtactgggaaaactatataattatgtagaagaataaaactggatccccatcttttaccacacacaaaaataaaaatggactaaagacttaaatctcagacctgaaactatgaaactgctagaagaaagcattgggtaagcaccccaggacattggtctggacaaagattttgtgtttcatactgtaaaagcacaggcaactaaagcaaaaaataaaaaataaaaaaaaatgaaaagaaaaaccaggattatatcaaggtaaaatcttctgcacaataaatggaattatcaacaaagtgaagagacaacccatagaatggaagaaaatatttgcaaattatccatctgatggaattaataaccagaatatataaggagctcaaacaactcaatagcaaatgaataaattgtccagtaaaatggcaaacagacctgaatagacgtttatcaaaagaagacatacatatggccaaaaggtatatgaaaaaaatactcatcactaatcatcagagaaacacaaatcaaaactataatatatcaatcctgcacctgctaaaatggcttttattaaaaggacattataaaaaagacagatgctggtgatgatgcagagaaaagggaactttcttatactgttggtgggaatgtaaatttgcatagctactatggagaacagcatggagatacctaaaaaaaaatagaactacatatgatccagcaattccactactgggtatataatcaaaagaaaggaaatcagtatatcgaagagacattacactctcatgtttactgcaacactattcacagtagccaaaatgtggaagcaacctaagtgtccatcaatggttaaatggataaaatgtgatatatacacacacacacgcacacacacacacacacacacacatagatatgtacatatatatgatattctattatgtgtgtgtttatatatacaattcaccatatatacatatatatgatagaatatcatttagctataccaaaatgaaattctgtcatttgcagcaacatggatggaactggtggctcattatgttaagtgaaataagcctggtacatgttctcacatgttctcactgtcttatgttaaagccaaacacatgttcttactcatatggaagctaaaaaagtgaatctcataattaaagggagtagattggtcattaccagagagtggtgagaaggggaggggtaaagggaggatgaagagaagttgattaatgggtacaaatacatagtttgatagaagtaataagacctagtgatagatagacttgtacagtgactatattgtacaacaatctattgtatatttcaaaatagctagaagagaagaatttgaatagttccagcagaaagacaagacaaatattaggtgatggatatcctaagtacactgatttgatctttaccaattatatgagtgtattaaattattatttgtaccctgaaactatgtacatatgttatgcatcaataaaaggtaataccatcatgtataatttgatgtattgaacagaaaatcaacattgatgcatctttggctatgacttacaagtatgagtttattttggaatatcaataccccttcaaccttcaataagtatattataataattctataatgagatactagtctttatgctgcttattgtgcagactgggtttcttcatgtttttctttgaatgttgcaatatattttaaacttcattactttcttgacactttatgattttgtatctatgactttattgttttcttggatatattttaaaatgtgttttttctttatgtttctacatccacccatatgcatttccttatggtttcatctttaagctatcttattttctagagattgtaccctcctcatctgcctatattggtctcagggcatttcttgtgcatagctcgagtgggtagcatccccagtcactgagctcatcacacgcggtgctaatctataccttcagatgatgtgcatctaatttctaattccagcttctgctatagctaactgttccatagccagtaatttagtccttacttagagtgattgcccagtggggttcacatttattctgctcataaaatcccatcttttctgcaagaaaggactgacttcctggaagatgaaaacaatagcaatcatcctcctataaaaaggatttcctatctttgggttacttcttttgtaaaatttcttcaaagcattgggctccaggcaagtgacaatttttaaaaaactattatatgaagatggacaaattttatctcttagtacccacaactgtgttgtaggttatattttggcaaacggccttagtttgatctaccctatagaatcacagtaaggagatctcattttttccttttattgatgagaatactgaaaaactaagtgtgtttcacaaacaacagaaaggtccagaaagactatgtatgtttcagaaacaaagcttttaaatggcaaagatgtgataagaacatgaacgttctgatttttcctgatgttctaatttatcttatttccagaacaactaagagccattgggcacttgatttgtatacctaaaatatcttatttacttaatcttgtaaaactttgggtaaggaattcacacagaaaactaaatgcttacctgagggttatcaattccttggtgaatagtacagtcctggtgaagtatatctgatctatagagacatgtgaaattcagatgaaaactgtgatcttttctggagtttattagaaacgtgatggagaatctgctggggtcatgactgttgctcccccactgaatttatggtggaacagatggttctcccagaaagaccaacaaagttttaatgattataaaatctttgtcagaaaattcacggacttggttatgcatgcattgttatcactgcttctttcttttatttatactttaaggatgaagagcctgatttacacagctggattttaaacatggtttaaatgaataaatttggatttctgaaaagtgacttaataaactgaaatactcagttggattcttgagtaggaatacagtatagctcaaaatattagagacggtcttacttgtcctgaaataaactgatcttatcaatagaaattcaacctgaatgtgagtctggttattaggaaaatagtatctctcatggaaaggaaaatagcaatttggaaatgaaacatgagaggtaattagtcaaaggataagaaagagtatctgttgccgcagggaatgaaaactaagtaaagtgaatctcatatttcagtgtgtgaaaatacatatgatcatatattttcttaccaagacttgaagggataggataccagattagaatagaataatggaaatatatgccttattcaatataaataggccagttgtgagttaggatagtgtggatgtgagctgcttagaacttggtgtacttgtaaagtggaaatggcctgaagaataatatttgggtgataaaggagatgaacggagtgtctttgtaggacatgatagctttcctcctgtactctaaaggctactgagtgaaagaggaattatttgaattctgaataatgccaaggatgatatcccttatatagaagaaaaacatatcaataaaaggaagactttctaacagagctacttgcaaccaaatgaactgtgttccctcttactagaagttttatatagagactgcatgataaaattataaaatcaatagaatattagtagaaaaaattaaaatgagagatccgtgattagattaaatggatttaaagcctcttccaggcttgggattctagaattctgtgatacatgacacatgaattcagtttcaccatgctagatttaaatgttttcaaattgtcactataatattctataatatgaccattgatggaaaacaaccacgtttatatgagaaacagaggcactattgcttccagaaccatagagctatcctgctcttcctcatcctagggccttcaaatagtgtggctttgtcaggtgtgcaataactgaaaaaatctgagccttaatattgaatgcttcttctcaaatatgcaataaagaggtttttttctatttttaccttccaaatgttatctagagaataattatttaaaaaatattgacctgagttttacttagaaccttcacaagtttgtgaaaaacaattctcttcactatccttgtcttgatgcagctttgtacaactcttagtaccaaagcagagattgcgaagaaagtattgcattccatatttagtcagagactacagatgatgacaaatatattctgcctttgttgacctagaatgcatcaacaaatcaatcctccttagacttgaactcagcatcacactcacatattttggttaccatgtattcctaaaatgcagaaatgggtacactgacaaattttgcaattcaagatttttaccagttcagctcagaggtcaaaagaagacagagaagcagatgcatcacaggggggatttttcactgcaagaatggcgtgtctccatttgttacaagttagacttggaaaaatcctttagttaaatgaaaaagacaaatgtgagacagactgcctcgagaatcatttaccaatatctcggaacgactgtgattatacaaaacaccgatattaaaataattaagttcaaaaactaagtgcaaggttgtaagataaattgttagcaattctttaacataatttctgtcctctccctgcaacaaaccgggtcttcatcatgcccctggagttattctaaaattaatacacgattatttttctaactccgcttaaaattctttcatctctcctcttggcctacagattaaaacttctcaggactgcctttcctaagcccttttattatttgactattgcttatctatttagactaattgttctgttactcttctcttcctgaatgcaaattacttaaaaatttctgaatgtaatgtccacatcctggacattcatcatttttcctctcctatttttacattgtgaacacctactcatatgtatagattttgttcagatgtgttcatcattttaaaggccatagccttcataaccaccttttaggcctagagaattgattacattctgctctgtcccataactatatcctgtgttttcatatattaaaatacacatgaaaatattacaattaattcattctaaggcagagtttattcaatcatctgtatatttctagaacattgtacaacttctaaattttaaatattttgtatcattcattttccaaagaaatttagaaggcttgatagcatgtatgttttttaaagaaataattgctgtagaggataacataggacatgtaaaataagataaagctaggagtcagattaatatttaaaatgcatgtaatatgccttaaatattttctactttatggatattcattaattaataaaagccaagagttttctaaattaccagaggagggcttcagtttgggcctaagtatcgtagcagcctacaaaaagaaggaggcttagtcagctatgtgattttcattgtcattgaaagaaatggtctcagactgtcagcagctaaataattatttttgctagtaaggcctgaacgcatttcaccctggtccattttaagagtagatgatactcttatttaaaacctattgagcaatagcctcaacaacaacctttcagtaatgcccataagaccatgtcttataacttttgttattgtagtgaaaaggaataataccactggtaattcagtaaaagtaattctatgctggtgaaggtgaggaggaaaaaatgatctctgaatgtactgccttctaattctcaatatttagtccaaagaaaacatgtaaacttgtacaggaatgtatgtatttttatatttgtcccacttattgtagtgaatattaaggaatggaataaattcataaattaaaaaatacaataatctatagcacagcatctattggaagatacatacccaagcagcagacaagaagttgagttgtagaattttctcagttgtataagcagactcagtgatgtgcagggccaaggttgagtgtaaagaatgcctggagtatatggttaaaaaatcattctgaatagagtggctttcttgtcctatagaaccatgtgaacacagggtgagaaacagacaaggggtttgtaaatggagagctcttgcctctggagctatcacaagctctggatcctggtctgaatgaaaatgaggcatctcctagagtctcgtgaaaaacaggtataacagctgggttttcatatttaggcccagagatctggtaatttaagactttgcaagaggataagattgaagctttcaataaaaaatatttttctgtaagaactggattcaggcagaaaatggagcctaagttaaaggcatttattttctgtggatataccaaagaataaagaagtaggtaaagcagaggcccacaaaactgtgggagcttgaggaaagcaaataaacaagaaaaatcagtaaaatacatagtacatttatgtattagtctgttttcacactgctgataaagacatacctgagactgggaagaaaaagaggtttaattggacttacagttccacatggctgaggaggcctcagaatcatggtgggtgctgaaaggcacttcttacttagcagtggcaagagaaaatgaggaaggtgccaaagcagaaacccctaataaaaccatcagatctcatgagacttattcactaccattagaacagtatgggggaaccacccccatgatgcaaattatctcccaccaggtctctcctagaacatgtgggaattatgggagtacaattcaagatgagatttgggtggggacacacagccaaaccatatcactctacccctggctcctccaaatctcacgtcctcacatttcaaaaccaatcatgccttctcaacagtcccccaaagtcttaactcatctcagcattaacccaaaagtccacagtccaaagtctcatctgagacaagcaaagtcccttctgcctatgagcctgtaaaatcaaaagcaagctacttcttagatacagtgggggtacaggtattggctaaatactgctgttccaaatgggagaaattcgtcaaaacaaagtggttattgggcccatgccagtctgaattccagtgaggaagtcaaattttaaaatgtcaagatgatctcctttgactccaagtctcacattcaggtcatgctgatataagaggtgggttcccatggtcttgggcagctccacccctgtggctttgcagggtacagcctccctcctggctgctttcacaggctagcattgagtatctatggtttttccaggggcacagtgcaagctgtcagtggatctaccatgctggggtctggaggacggtggccctcctctcacaactccactaggcagtgcccccgtagggactctgcatgggggctcagaccccacatttcccttctgcactgccctagtagaggttttccatgggcatcccacccctgcagcaaacttctgcctggacatccaggtgtttctatacatcttctgaaatctaggcagaggttcccaaactccaattcttgatttcccttcactcacagctcaacaccacatggaaactgccaaggcttggagcttgcaccctctgcaagccatggcccaagctctacgttggcccctttcatccgcagctggaacagctgggatgcagggcaccgagtccctagactgcaaacagcatggggaccctggccctggtccacgaaaccattttctcctaggcctctgggtctgtgatgggaggggctgccatgaaaacctctgacatgccctggacatattgtcctcattgtcttggggattaattccgctccttgttacttatgcaaatctctgcagctggcttgactctctccccagaaaatggatttttcttttctatcacattgtcattttttgaacgtttatgctctgcttcccttataaaactgaatgttttttaacagcacccaagtcacctgctgaatgtttcgctgcttagaaatttcttgctccatatactctaaatcatctctctcaagttcaaagttccacacatctctagggcaggggcaaagtgtctttgctaaaacataatagcctctttgctaaaacataacaagagtcacctttgttccagttccccacaagttcctcatctccacctgagaccacctcagcctgaaccttattgtccatatcactatcaggcttttggtcaaagccattcaagtctctgggaagttctaaattttcccacatgttcctgtcttcatcttagccctccaaactgttccaacctctgcctgttacccagttccaaagtcggttccacatttttggttaccttgtcagcaacgtcccactctactgataccaatttactgtatcagtctgttttaaagctactgataaagacatactggagactgggaagaaaaagaggtttaattggacttacatagttccacatggctggggaggcctcagaatcatggcaagaggagaggggaacttcttacatagtggcagcaagagaaaatgaggaagatgcaaaagcggaaacccataatgagaccatcagatatcaagagacttattcactaccattagaatagtatgggggaaaccatccccatgatgcaaattatctcccacttggtccctcccacaacatgtgggaattatggaagtacaattcaagatgagatttgggtggggacacagagccaaaccatatcaattaataaggataaattttgcaaaaaaaaaaaaaaaaaaaaacaaagtaggtaaagggcatagtgttagggatgagactggaatttagataggcctctcttctctgatgtgtctttctgtaaaggtctaaatgaagggaaggggccttgtcattggttttctgggaaagaacatttcaggaagaaagatagcaagagcaagtccttatgtggctagagtagaaggaaatgagatgagtagaaggagaagaagtcagagtggtaactcggtgggtggtaggcagattgggcagtgctttatttcgttgttagggtcttgttgttagggtttttaggtcttactgtgagaaatgagaaaccattggagagttttgagcagacaagtggcataaaaaggattcttcaggtttctgtattgaaaatagattatagaaagcaaaagcattagaatgaagaccagtctggaagctacttgtacaattcagatttaatgcttggaatttggtccactaacatgattttgtgaaatatcctattgtgatgatcaaaagactcgatggatttgacatttcactggtaaaagaagataagacatatgatttttacagtttattttatgggagcaaattgtttattcattaaattcatttatgtcatgcatctatccaaaaaaaaattatgtggttggggatatgctatttctcaaggttatgtgataatatcttccagcatagtcagatattttatacgtataataactcgggcaaaattcaaaagcaaatagtttaccatgttatgaaataaagcttctgtaagaaaatattcaaattaaatgtccagtggcaaatggcacatacaatccactggcatacatctttcttaatatttataaaacttgaagaagtgtttgaattatctacttaaaacaggattttagggaattcaatattgtgtttcattcatcaaatcattgattcaacagctgtttattgggagtctctgtgtgcaaagcagcatgctaggctttggggaaatagcagcaaatttaaaaatttcctgccccctatgtattacattctattggcagggagagagacaataaataagtgctatataattccttagatggtagtaagtactatgaagaaaaataaagcagggaaggatggcagggagagggcaaatgttgggaagataaattttaaaggggttataagcgatgcccaccctccaagataaggtgaagttagagaaaatgtcttcactgaagtcatgggcaagccatgggaatatcctagtagcagaggcagagaatgtgcctagatgttctgaaggaagcatgcttggtgtgtttgagaaacacaggaagatgctgggttgagttgtctagcacattgtaatcaactttgagatgaataaataaatttcctgtcttgaaatatcttagcacctacgctaaattccaaatatcttaccagcaacagacaggaaggtcttatgtgctttggcctctcatacttcagagacctttatttttaaccttccccactctatgtcccacccccacctccctgccacattcacccttagctccttgagcaagtcatgtccacctcagcagcctttctatgcaccaataatgaaccagctggaaaagaaatcacgaaagcaatcgcatatacaatagaaacaaaataataaataaatggataagatacctaagaataaccaatgaggtaaaaaatttttacaatagaaacctcaaaacactgatgaaagaaattgaacaggacacaaaaaatggaaagacatctcatgctcatggatgggaagaattaatattgttaaaatggccgtaatacccaaagtgacctacagatttaatgcagtctctatcaaaataccaattacattattcacagaaatagaaaaaataatcctaaaattgcagagaacacaaaagagcctaaatagccaaaataattctgaccaaaaagaacaaagctgaaggcatcatactacctgactgcaaaatatactacaaagctatagtaacaatgacagcttgatattggtataaaaccagacacattagaaaaatgaaacagcttagagagcctggaaattaatccacatatttacagccaactgattttcaacaaaggcacccagaacatacaatagggaaagggcatcctcttcaataaacagtgctgggcaaataatatccatttgtgaagaataaaactagacttctatctcaccacatataaaaatcaactcaaaatggattaaaggcttaaatataagacttaaatctataaaactactagaagaaacataagagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaaaaaaaaaaatctaaaaatagaactgccatataactcagcaatcccactactggttatttattcaaaggaagtaaaagcagtatatcaaagtgataactgtactcctatgtttaatgcatcactattcacaataaatcaacctaaatgtccatcaatagatgaatggataaagaaaatgtatatatacacaatggaatactattcagccataaaaaagaatgaaatcctattattcacagcaacatgtatgagcctggaggacgttatgtaaagtgaaataaataagtcaggcacagaaagacaaatggtgcacattctctctcatgtgggagctaaaaaaacgttgagcacatagaaatagggagcagaattatggttattacaggctgagaaggggagggagaggatagaaagaaatggtacaaattacagctagaagaggaataagttcttgtgctccatagcactgcagaatgaatataattaacaataatttgctgtaagtttcaaaaatctagaagataggattttgaatattcccaacacaaagaaatgataaatgcttgacgtggtgaatatgctaattaccctgatttgctcacttactgtatacttatatattgcagtatcactctgtagcacataaatatgtacaattattatgaatcaactaaagataaaagagaaaataattcagttgaagatgagtaagcaactgacccaggtgaccatggagctctacacaatgcatccatccaagaagaggtaatagttctggcacaaggcatgggagaccttagtctggaggttcactctttttctgtgctgttctgcacatcattctccttttgaactccacctgccctgtttggggcatttaaaggagacatctagagtccctctgcaagaaaactcattgcaaagttattacaaatattcttagagctttcttggccatcgtgcaaatatttttcaggtttgtgtgtttctctatttctttcttgggttcagtctccctctgtgatctcactgaacttctttaaactactcaggcagtggctattctttccttaacgctgaaatctacctctctcattcgacgagaattcataatacctatatatagtgctgtcctctcagctccttttgtttgtgattcttggttgattctagattgctaaacaaaggaagagtatagtattttggagtgaaggcaggaacacttggatatagtcactgattacttcaggaaaccaaccaagatcattctttttttttgtctttttttttcctttttttaattattattatactttaagttttagggtacatgtgcacaatgtgcaggttagttacatatgtatacatgtgccatgctggtgtgctgcacccattaactcatcatttagcattaggtatatctcctaatgctatccctccctcctcccccccaccacacaacagtccccagagtgtgatgttccccttcctatgtccatgtgttctcattgttcaattcccatctatgagtgagaacatgcggtgtttgtttttttatccaaaatcaatgtacaaaaatcacaagcattcttatacaccaaaaacagacaaacagagagccaaatcatgagtgaactcacattcacaattgcttcaaagagaataaaatacttaggaatccaacttacaagggaagtgaaggacctcttcaaggacaactacaaaccactgctcaatgaaataaaagaggatacaaagaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggagccaaaaaagagcccgcatcgccaagtcaatcctaagccaaaagaataaagctggaggcatcacgctacctgacttcaaactatactacaaggctacagtaaccaaaacagcatggtactggtatcaaaacagagacatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagttgaaactggatcccttccttacaccttatacaaaaattaattcaagatggattaaagacttaaacgttagaccaagatcattcttgatgtgggcttgtacttactttactttgtgcgagtgccctcactttctaccctcaaaccctcatacagccagaagtgctgtatcaaggctaagggtttaaagaaacttgcatgaaaacaggccttttatttcaactcataaagattggagggttttcacaaactgtacattaaaggtatctcaaatatgccttaatatttttatgtaatctaaattctaagtgtttttctaatataataattttatgactcagtgaaaccaaaatcataccttttacttatacaaatacaatgcaagaagatatttgagcttaattttattagattttggttgtatgtaattctgctgcatgaaattaatacatacatattctatggtaacagaacattgtgactaatagcctttttatgaattcaaatagttctattgaatagatagacacaggtcaatgagactacaatataacgatagtaatttattttattccactagttacggaaatagtgataaactattctacataagaacttatattctgacttctcttcagatcatataaatctattactttttactgaagattttctaggagaggaacaactcatttcagcaaacaaaacaaaacaaaagtcttaactagagataacaagagaatttttacaaaataatcccaaatttgaaaggtggaaataattaaaaatttgcttttgtaagaattcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtagttttagtagagacagggtttcaccgtgttagccagaatggtctcgatctcctgacctcgtgatccgcccgcctcggcctcccaaagtgctgggattacaggcgtgagccaccacgcccggccaagaattcttttactagatctacaaaacaatcattaaaagtatatcaaccagaatttattatccatatttccaaataaagacagtaagtttcagagatggtaaatgtaaatattaaataaactgtccaagatcatgtggggacatttatgcagagccagaatgagaagccaaccaagtcttcttgcttctacactttccacttcctacttagtgatgtaagaactattgagtcctcctgttccaccccctctcataaaaacacttcagtacatttctttaaaaaaaaagtgattaccatcaatctggcacctgtaatatatttgattttcaaaactaaagtcattttcaatagaaacaagtttttgttttgttttgtttgagacagagtctcactctgcccaggctggaatgcagtggcacgatcacagctcactgcaacttccacctcccgggctcaagtaatcctcccaccttggcctcccagtagctatgactacaggcacacaccacttcactaggctaatttttgtattttttctagagacgaggtttcacagtgttgcccaggatagtcttgaactcctgagctcaagcaatctccctgccttggcctcccaaaatgctgggattacaggcatgtgccacggtgccctgccaatagttacaagctcttatgtttctatagttatgtaaagtctgaaaaatgccaagaatgcacatgaagagcatgtaatacgtgtaatgaaaccattataggaaatactatgtgttgctaaatataatgcttattatttgcaaattataattttggttgtcccaaacttgatgattatttgtatatttttcataaactgcaaaaagaattttcagaggacttagtgacaaacaaaaggtatgatataaagcacacaaaaacatattctccatggaaagaaaagttggaattgagaggcctaggagaggcagcctccatgtattgatgaaattacagttaaattagaaagcagagaacaattgagtaggtttgaaaaatgagaaacagttagcaaaaaaaaaaaaaaaaatacacacacgcacacatatatgtatgataagaagttttaaaaatgattaaaagaggtatccatgaagagatgaacacaatttgaatatgcacttagcacataaggatgtacaatcaatatgcaacatagtgttttgaatcctaactgataataaaataactacaaaatcctgcaaactcataatatttagctaggttattctgtaaactgtattttactgataattaaaagtaattttagtgagaataatagtgtgtattttatattatcaataatttgttttccttgcttatttctctttgctgcaaaatgggttagtaaaatactttgggcgtcagttaatgtacacttgaaaatgcttttagttttattctgaaaaagaaatgatatcaatatacatttataaatgttatgaatagttatacactttctgattaaacaataaaatccaacatctttagctttctaaatggtgctttttcttgtacgtatctatatttaatttttgtaagaaatatttgctatataagagagaaactatgagacatttatgtaatttataaataataaaaattaaacaaatagctgagaaactctgcctataattagatcaaaattatttttgtaaattatatggctcttcaaaatatttcttcctcgcttccttactttcctggaaatagtgtgctttcccacccctagaatttctgtttgtgcatttgacttgttttggccagtggatattaaccaatatcaagcattccaaggcttgctatgtgcattcggtgtagagcttgctgtcctgtgtttcctcaatgttaaaaatagccattgagtagttactgtgccttcagactcagccccagaatgtacctgtgtaggacagagttgctctagcagacctgaattgagaagcaattctaccccgactaccacagcctgaagctaagtggcccagctgacctacaaatcataaacaatacccccaaaaaacaaattatcatgttaaatcactgaaatttgaagtcatttgttcacaatagacttcaaatttcaaatagctaatcaatagatttaatcatttataggatagaaatcacctacctatttgacccattcccctacttagcacctagagacaatcaatcaacctgaacattttgaatggcactatctgtttttctaaacataattttatgtcacatacatgtattcacatatataatgatatatatagtatatctgaatattttatttttacttcattaagatatgtcagaatgtatatggtcatctgagtcttattttttcctcaatatagtgtctctacattttatccacattgttatgtgcagctgtagtatattcattttcactgctctataatatccattatgtgacttttcccacatattatttatccatgtttgttactaacatgttatttcgatgattttcattgtttgctaatacaaacaatgctccaaggagcattctgcatatctggagattgtatatgttgaagcacatgtgtaaacgtttctctagggcatcagttctcaaacttttggcctgaggatctgtatttgttaaggtttgccagagaaatataatagaacgaatatgtgtgtgtgtgtctgtgtgtctgtgtgtgtgtgtgtgtctgtatgttgatgtgtatatatacatatgtattgtgtgtatctctctgtgtgtgtatatatatgtacatgtacatatatgtatatgtacatgtacatatatgtatatgtacatgtacatatatgtatatgtacatgtacatatatgtatatgtacatatggatatatatgcatacacatacatgtgtgtatgcatatatatacaaagagatacatgcagagacagagataaagagagagagaacagactctctttggctcacatgattgtggggactgttaagtccaaaatttgtagggcaggtgagcaggctggggatccagggaagagtagatgtctgattttgcagcttaaatctgaaggaattccatcttatttggggaccttagtgtttcccttttaaggccttcaactgattggaagaagcccactcatgttgtagagaataatcagctttactcaacatctactgatttatgtgtttatttcacctaaaacatacctccacagagatatttagactgatgtttgaccaaacattgtggtagcatagcttagtaaaactgacgcataaaattagctatcaccatacccctttattaccttaaagattattaagtaccctaaagagatttggttaggggcttatatctattgatgcttattgtattataaattaaaacttagaaatcttaaagatatttattaatttaaataactatagaaagttcattgcatgttaactaaacattttaatgcaaaatcaatataatgcctaaaacaaaaaaattaatgaaaagtgtgacattattttatacttctgtaaaaatctttgtggcacctggctcaataaattgccagtagaggaaaatttttctgttcttgtcaaccttagcagaaatttatttattttattactcttcaaagaaccattttggtctttgttgatcttccattctattattctatcatatatatagtatacgctttctaacctcaaaatatatgcacagcacaatgattttaagtctgttctcttttcattataaccagttaaaattaaattcccttcaaaatactgatttgacttcatgtcagagttttgatgtgttgccattcagttctattttaaaacatttcttctcttatgtatgttatttaaaactgttttaaaatttgcacaaatatactttatcagcatatttgtatactgatcgatgagtgatattgatctttatttcataagcttgttggccacatgtatgtcttcttttggaaagagtctgttcttgttatttgcccattttaatggagttgtttgttttttgcttgtaaatttgtttattttccttacagatgctggatattagaactttgtcaaacacatagtttgtaaatattttgtcctattctgtagtgtattagcctattctcacactgctgataaagaaatacccgagactaggtattttataaaggaaagaggtttaatgactcacagttccacatggctggggaggcctcataatcacggcagaaggtgaatgagaatcaaagtcacgtcttacatggtggaggccaagagggcatgtgcaggggaactccccccacctcttttttttttttaattatactttaatttctgggatacatgtgcagaatgtgcaggtttattacataggtatacatgtgccatggtggtttgctgcacccatcaacccatcatctacattaggtatttcttctaatgctatccctcccctagtcccccacccctcagcaggccccagtgtgtgatcttcccctccctgcgtccatgtgttctcattgttcacctcccacttatgagtgagaacatgcggtgtttggttttctgttcctgttttagtgtgctgagaatgatggtttccagcttcatccttgtccttgcaaaggacatgaactcatactttttatggctgcatagtattccatggtgtatatgtgccacattttctttatctagtctctcattgactggtatttgggttggttccaagtctttgctattgtgaatagtgctgcaataaacatacatgtgcatgtatctttatagtaaaatgatttataatcctttgggtatatgcccagtaacgggattgctgagtcaaatggtatttctggttctgaggaatcgccacactgtctttcacaatggttgaactaatttacacacccatcaacagtgtaaaagccttcctatttcttcacatcctctccagcatctgttgtttcctgactttttaatgatccccattctaactggcatgagatggtatctcatagtggtttagatttgcatttctctaatgaccagtgatgacgagctttttttcatgtttgttggctgcataaatatcttcttttgagaaatgtctgttcatattcttcacctactttttgatggggttgttttgttttcttgtaaatttaagttccttgtagattctggatattaatcctttgtcagatggatagattgcaaaaattttctcccattctgtaggttgcctgttcactctgatgatagtttcttttgttgtgcagaagctctttagtttaattagatcctattagtctattttggcttttgttgccattgcttttggtgttttagtcatgaagtctttgcccatgcctgtgtcctggatggtattgcctaggttttcttctagggtttttatggttttaggttttacgtttaagtctttaatccatcatgagttaatttttgtataaggtgtaaggaagggatccagtttcacttctctgcatatggctagccagttttcccaacatcatttattaaatagggaattctttccccattgcctgtttttctcaggtttgtcaaagatcagatggttgtagacgtgtggcattatttctgaggcctctgttctgttccattggtctgtatatctgttttgataacagtaccatgctctttgggttactgtagccttgtagtatattttgaagtcaggtagtgtgatgcctccagctttgaaattccctttataaaaccttcagatcttgtgagacattcactatcttgagaacagcacaagaaaaacctgcaaccatgatttaattacttcccacctgctccccccatgacacatggggattatcacaattcaatgtgagatttgggtggacacacagccaaaccatatcatataggttgtctgattactctgctgacagtttcttttgctgttgagaagctcttaagtttaattaggtcacacttgtcaatttttgtttttgttacaattgcttttggcatttttgtcacgaaatctgtgctaaatcctacatccagagtgatatttcctaggttatcttccagggtgtttagaattttatgtttcacatttaagcctttaatccaccttgagtttatttttgtatgtggtataagggaggggtccagtgtcaatcttttgcatctggctagcacattttattgaatagggaatactttccccattgcttgtttttgttaggattgttgaaaatcaagttgaacatgtgtggcattatttctgggctccctattctgttccattggtctgtgtgtctgtttttgcaccagtaccatgctgttttggttactgtagtctagtagtacagtttagtcaagtaatgtgatgcctccagctttgctattttttcttaagattgccttagctatttgggctctttttttggttctataggaattttaaaatattttctaattctgtgaagaatatcattggtactttgatagaaatagcattgaatctataaactgctttgggcagtatggccattttaataatattgattcttcctatccatgagcatggaagatttttccagttgtctgtgtcacctctgatttctttgagcagtgttttgtagttcttgttgtagagacgtttcatttcctgggttggctgtattcctaggtattttattctttttgtggcaattgtgaatgtgactgtattcgtgatttcactctcagcttagatgttgttggtatatagaaatgctagtgatttttgtacatcgattttgtatcctgagactttgctgaagttgtttgtcagatcagggaacttttgggccaagattatggggttttcaagatatagaaatacatcatctggaaacagggatagtttgacttcctctcttcttatatggatgccttttctttctttttctttcctgattgctatggctggaactttgaatattttgtagagtagggatggtgaagaaggcatacttgactggtgctggttttcaaagggaagacttccagcttttgcccattcagtatgatgttggttgtgggtttgtcatagatggctcttattattttgaagtgtgttcttttgatgcctaatttattgagggttgttaatgtgaagatgtattttatcaaaagacttttctgcatctattgagataatcatctggtttttctttttagttctgtttatgtgatgaatcatatttattgatttgtgtatgttcaaccgagcttacatcccagggataaagcctacttggtcatgatggattagttttttgatgtgctgctggaattgattggcaattattttgttgaggttttttgtatcagtgttcatcaaagatattggcctgaaattttattttttgttgtatctctgacatgtttttgtgtcaggaaaatagtggcctcataaaatgagttgagaaggaatctctcctcctcaattttttggaacagtttcagtaagagtgataggagctcttcattgtatacatatggtagaatttggctatgaatctatctggtcctgggtttttttctggttgataggctgatatggtttggctgtgtcctcatccaaatctcatcttgaattatagctcccataatttccatgtgttgtgggagggacctggtgggaggtaattgaattaaggcaggacttgcctgtgctgttcttttgttagtgaataagtctcatgagatctgatggttttataaaggggagtttccctgcacaaattctctcttgtctcctgccatgtaagacatgccttttaccttccaccatgactgtgaggcctccccagccatgtggaactgtgagtctattaaatctctttttctttataaatacccagtctcaagtatgtctttatcagcagcatgaaaatggactaatacatagactttttattactgattcagttttgtaactcattttttttgtctgtgcagggattcattttttttcctgggttcagtcttgggagggtgtatgtgtccaggaatttttccatttttttctagattttttagtttgtgcatagaagtattcgtaatagtctctgatggttatttgtatttctgtgggttcagtggtaatgtcaggatcagtgtaatgccctttgtaatttctaattgtttttatttggatcttctttcttctttatcattctagctagcagtctctcttatttactttttcaaataaccattgattatttggattaattaatcttttgagtgatttttcatatctcaatgtccttagttcatctctgattttggttatttcttttgtgagttttggggtcagtttaatcttggttttgtatcttattaagttttttaaattaccattgattatttggattcattgatttttttcagtggttttttcatatctcaatctccttagttcatctctgattttgcttatttcttctgttagtttttgggttcagtttactcttggttctctagtccatttagttgtgatgttaggttgataaattgagatctttctaactttttgatgtgggcatttagtgctataaattttcctgttaacactgccttagctgtgtcccagaaattttggtatgttgtgtcttggttctcattagtttcaaataacttcttacttcttgatttctgctttaatttcattatttactcaaaagccattcaagtgcagctattcaatttccatgtaattgtatgtttttcagtgattatttcagtcttgatatgtaattttattgtgctgtgatgcaagagagtagttgatatgattatagttctcttgcatttgctgaggattgttctgtgtctcattatgtggtagagtttagagtatgtgcatgtggcaatgagaagagtgtatattctatttgttttgggaggggagagttctgtagatatctatcaggtccttttgatccagtgctcagttcaggtcctgaatatttttgttaattttctgactcaatgatctaatactgtcagtagggtgttgcagtctccactattattttgtaggagtctaagtctctttgaaggtctttaagaacttgctttatgactctggttgcttctgtgttgaatgcatatatatttagaatagttaggtcttctcatcgaattgaaatctttgccagtatgtaatgctccccttttttcgtctctatctgtttaaagtctattttgtctaaaattaggatagtaacccctgcttttctctgttttccatatgcttggtagatttttctccatccttttatttttgagcctctgagtgttactgcatatgaaacaggtctcttgaagacagcataccaatgaatcttggttctttatccaatttgccactctgtgccttttaattagggcatttagcccatttacatttaaagttattgttgatatgtgtgaatgtgatcctgtcatcatgatgttagcttgttatgcaagcttgtttgtgcggttgctttatagtgtcactggtctgtatactggcaggttaggatgcatgcacacacacgttggcatgggggaaggtaaaacccacccacgtacacacatgttggcaatgtgatatatgtggtggctctgggcctggaggaagctgcagtgggggtagggaataggcaggctggtgtgtggccatgggggctgccccattggacctctctgccagtcaggcacagttcaccactgcaggagctattatgtgggctcccagagcacctgcttgttctacaagcaggcatggccaggctggggccctggaagaggccagcagaccaaggggtgctcaagtcagactagccccatctgatgggcaagaccaccatgcagagttcaagtctgagagtttccctagggataatgtctcctgtggtagcatgtcgagcctacagggatggacatctcttgtcatactctgccacgagtgcttaggcaccaaatccttttggctctgcatcagctggcatgctgcccctaccaattctctaagcagctctttgttccaactcaagtatccgtcatagtttaggggtctcctcctgccaagattccagaggcctgtggcaagagtaggttgatccttgtcagttcaattcacccattcctttggagttgttggagggtaggaattagtcccctgcctggtagcctcctgtagggttcccagcttcctcccacttgagcacagcttttgtatcttccctccatccactctcacaggcttccctctgaagctctgtcaggagtgtgccaattttcttggtcccttggtggcagttgttccacctggttgtgtcaagttggccatcttctacttaatcaggtcttcttgttgaattgaaactattgccattatatagtgctcttctttagcttatttggtctttgttggtttaaagtctgttttgtctaaaactaggattgcaacccctgcatttttgtgtttgttgttgttgttgttgtggtggtggtttacttggttgatttttccccattcctttattttgagcctatggatgtcattgtatgtgagatgggtctcttgaagacagcatactattgggtcttccttctttgttcagcttgccattctgtgtattttaattgggggattaagctgtttacattcaaggttactattcatatgtacgaatttgatcctgtcatcatattgttagctggttattatgcagacttgtctgtgtggttgctttatagtgtcactggtttgtgtacttaagtgtatttttgtagtggctgataatgatctttctttttcacatttagcactcctttcaggaccacttgtaaggcagttctggtggtaatgaattcattcagcatttgcttgtttgaaaatgatcttatttctccttcacttatgaagcttggttgggctggatatgaaattcttgtttcaaatattattttaagaatcctgaatataagcactcaatgtcttctggcttgaagagtttctgctgaaaagtccagcctgatgggattccttttgtatgtgacctgtctcttctctctaattgccttttacattttttcattcatttggaccttggagaatctgatgattatgtgtcttggagatggtcttcatgtataatatctcacaggagttatatgcatttcatggatttgaatgttggtctctctagcaatgttagaaagttttcatgtacaatatcctgatatatgttttccaagttgcttactttccccctgtctctttcagggacaccaatgagtcatagttttcatctatttacataatcctatatcttttggagattttgctccttccttttaaattcttttttctttatttttgtctgactgagttatttcagagagccagaatttgagctcttagattctatcctcagtttcttctatcctgctgtttatacttgtgatttaattatgcaattcttgtagtatgtttcttatctctattagatgagtttggttccttttttataatggctattttgactatcagctcctgtatcattttactgtgattcttagcttccttggattgggttttgctgtttccctgtatcttgatgatccttgttcctgttcatattctgaattctatttctctcatttcagatatttcagcctggttaagaactcttgctggggaaatagtatgattatttagaggaaagaaggtactctggcttttcaagttgtcagagttctttcactggctttttctaatttgtgtgggctgatgttccttcagtctttaaagtttctgtcctttcaattgatttttttgtttttttcttcattgatgcccttggggattttattatgttataattgagtttggttgactggctttgattctagtacactactgggtcttggtggcaccctctatgattactgtctgcatgcccgcatttcttctgttgggctttctgatctattgagtttcctcaggcaagggctgcggttgacagacaagctgtattcttgccaggttggccttaatttgatgtccatgtgctccctggggaaacatggggttgcacttgcctgcagagttcaggcagaagtgggacctctgggttggaagctctagcaggtgtggtccatctggctatgggaggcaggggtgagtggagttgcctaccctgacctcctggtgtttccagggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcagggtcagtgggatcacatgccttactgtccaggtgtttcctgggacaacaggaggcttgtgctcctcagctgagttccctctgaagcaggaccactgagccagaaactctatcatgtgtcgcttgcctggctatgagtagcagggatggatggggttgtctgccctaccagctgggtgttttcagggcagcaagaggctgtgccctccagctgagttcaacaaaagtaggactgctgggcgggaagctctagcacacattgatcacctggcaaccagtgatgagggcaggtgaggtcacatggtgctgtgctctctgggtgtttcccagggcaacaggaagctgcaccttccagctgagctcacatagaggtgggatgactgggctggaggctctagcagttgttgcccacctggctgtccatggcaaaagtgggtggggtcatgtgcagcctcctgccacctgagtgtttcccgggacatcaggaggctgtatcctgcagctgaatttacacagaagtggaacaactgggctggaagctctagtaagcattgcctgcctgcctagcagtggtgggggtgggtggagtggcaggccaaattcaggctgaagtgggactgatgggctagaagctggtgctgagccccatctggcaagggggtgggtggagcaatcttactgctcccaggcactgcaactatgcctttattcaggtgatggcactggtgctggtctgctctggggttaaaggcttgtagtccccttggacttgatagttgcccctgcaaaatgtctggatggctctctccctcagtttggaagcacagctgggggccaggcagattttcctactcccagtcttgtacaggtctctgcagagagcatgaatctcctggggagctctcactctctcaccctttcccatttttgtagaggttcttctgcgccacattgatcccagacagatagctttgctcctctctgttctctgtgttctcctgctgccttcatggatcccagcatggtttctcagatgattggcctgcagggtcagtgttgactagccttttagttcctctctgtgagagcagcacatacaagctgcttctcgtctgccatcttggccctatccctcatctttattttcatttcctttggcctaggtaactttttttggtactttttcattttgctttgctttgctttgctttgtttactctcaatctttgtatctccttagaagtttagtgtgcctcgtgtaaaaatcatatagctgaatttgtttctttttagccaaactgaaaaatctttgtcttttatgtcttttagcttccactttagtctatttgtgtttgttggatttgttcatatgtttgtatttctatctaaaaacttatttttaaaattcattttctatttgtatcatttattctagtgcttttttcctcctttcctattttcttttagatatattagatgtttataattgtaagtttttcttacccatttctttttttcttatactggtttggaagtcatatgctctattactattcttatagtgctcactcttaacattttaccatgctgactgaatttagtaaagcctaaattgatcaaggttttacttctcttcttaatagcacatgaactttattaatactatatcattattgtttttttttatttttacaagcatttttgttttatttttgcaagcattttatttatctacacaaatatttctatatacttacatgtttaccaaattgtttgctcactatttcttccctttcagatcttctgtccctaaaatatatccttagtaatttctgtaggagaggactgctttgtttagttggaacattaatacttgttcttgtttcttttcttccttttttttttttttgaggtggagtcttgctgtgttgcctaggctggagtgcagtgtcacaatcttggctcactgcaacctctgcctcctgggttcaggcaattctcctgcctcagccttccaagtagctggggctacatgtgtccactaccctatccggctaatttttgtatttttagtagggatatggtttcaccatgttggccaggctggtctcgaactcctgacctcaagtaatctgtctgccttggcctccgaaggttctggaattacagacatgggcctctatgcccagccttgttcttgttttgagagagatttttgataattccagagtaacattattttctattagctctttgaagaaatttcacccctgtgacttattttctctgtgatgttgtttaagtgttttagagataatgtagtcatcttatgagtcatagtgaagatcaaatatatataaagagcttattagtgtttctaacacatatttatcactatataaataaataaccttatttttcttttttccctcctttttttcttataattcttattattgccaatgctgctcagcaattcactaaaatgcatctaagtaaaaatttctttttattgacaccactgtttatcctgtttggtatacatttttctttccaaacatgtggttctaggtcttaaattttctagtttctgtacattctcaacccttaattctttgaatgttacatctatcttttatttccattctcttctggaattttgattaggaaaatatacttttttattgtatcctttataattttaaccacctatactgtgttcagttcctcatctgtctatagttgggataattttttcaaatatgtactttatttatttttattttttatttccataggtttttgcggaacaggtggtgtttggttacatgagtaagttctttagtggtgatttctgagattttggtgcacccatcacccaagcagtatgcactttacccaatctgtagtcttttacccctcgccccacttccattccaccctttcctccaagtccccaaagtccattgtatcattcttatgcctttgcagcctcgtagcttaactcccacctgtgagtgagaacatatcatgtttttcattttttttccggatttatttcccaattcatttactctgaattttgctgtttctcatatgctatttaacccatccattgatttcttaatttcaataattttatttttaaaatttctaaatatatatttttttcagatttgcagattcatgttataaccttacgtcgtttgatctttttattgtagctgttatttccttatatactttacttatagttatattttgtaccctttaattataacaactagtgtccttcagggtatttgttaattttattagctcatcctcagtcatggcttcttatttcccattatgtgtttgagaataattttgtaagctcatacttggttgaattttatttgcagaattttgagtagctaatttctaataacttgggctgtataccaacagcgtggatctacattattagtcagctcagtctgccataacaaaataacagagactgggtagctcaaataacagaaattaatttctcacactcctggagcctagaagtctaagaccagagtgccagcctgatcaggttctggtgagggcccccttcttgccttgtaaatggctgccttcttgctgtgtcctcacaatgcagggagcgagttaactccagtctctttctctgattataaaggcactaatcgtattacagggttcccgtgctcatgaccttgtctaaacctagttatttctcagaggccctacctccgaatactgccacattggaattagggcatcaatgtacggatctgggaaaggagtggcacagtcagtcagtccataacattcacttgtgctctttttgagagctttggttccttctatttgtgtggagcccagggaaactctgatcttttgcatctcttaaaacacacttttttgattttagtgtaccattctttttctctctcttgatttctctcagccctcagaaatggcctttattttttcatgaaccaaagttatacagttttccatatttcaggccatgtttttgaaaggcaaaaccatttcaaaagaatgttcagaaatttatatttgatatattttggatttagtatatgagctctgactctatatattaaaaacttatgggaatattgtttatatttattgttgactaaatatcagttacagcactcacaaagaaataatactgcttcattctagttgtaattattccagtgtgatttgttttttttgcctggcacatggtttaaaacacaaaataagcatataaaacttatatgagagggtttttcagccacaggcagaaacataccacaataatttttatcctatgctaagattttggtccataataacatgatacccattggaaagatagatttgagaaagaagcatgcttaaataatttttaaatttttttacatgcatgtttttggataagtgtattgttcaatctttaatattaaaaactaaaattctgaatgacaaacatatgtgcaaaccaactattgtggcaaaaacagtttttgttggtgaagggactagctgccatttggtgatttttcagatagtcaaatttgaaaaatcaattggatcttctcttctcttctcttttctctttttgagatggagtcgcagtcccccaggctggagtgcagtggcatgatctcggctcactgcaacctctgccttccgggttcaagtgatttcctgcctcagcctcccgagtagctgggattacaggcacacgccaccatgcctggctaattttttttttttttgtatttttagtagagacggggtttcaccatgttagccaggatggtctctatctcctgacctcatgatctgcccccctcgacctcccaaagtgctgggattacaggtgtgagccatcacacctggccccttggatattcttttctaactcaaatgagaatatcctcattatataatccaccttctctccagaaacttcaagctctttctctctaatggtggctgtttctacgctgcagatagaaattacatttccctcttagctgaaaaatacccaagcctatgagcaagaaaacaaaatattttttgattctactattccctctgtcagagatgccagaaactttttcttcttcatttatagcataatttcattcatgcttgcatgcatttctatatttacttactctaaagcatttactaagcactttaattggtcagtcatgaggcttggtgccgtagaaacagagatgaaatgcaattctccatcataaaacagtctggcagggaggaggaggataaataagtggtatattacaattcggtgagagaaagtacctaagagaacacatttaaaaagcatgcaatgcagaaggatgtgtagaagatgatggaagtaaaattttcttgcagctgatgttacacacacacacacacacacacacacacacacacacacaaaaccaactagatgtttctgttggtgtcattgacacctacccatttcttttcttttctttttttttttttttttttttttttttttttaagactgagtcttactctgttgcccaggctgcagtgcagtggtgcgatctgggctcactgaaacctctgtccccggggttcaagcaactctcctgcctcagcctctcgagtagctgggattacaggcgcacgccaccatgcccggctagtttttgtatttttagtagagacggggtttcaccttgttggccaggtttttctacaactcctgacctcaggcgattcgcctgcctcggccacccaaagtgctgggattacaggtgtgagccaccgtgcccgagcctgacgcctacccatttcttaaactagcttttgtgtccaccacttggaagccactgctttaagatctactgattaccgaaatgcaaaattgaatgagtcatgctcaaccacccagcacttaaacatctctttgatctctcatgatctaactcaaaggtatctcattcctgattcacttcttccttcatccaaactgcactcctgaagcatttaattaatctaaacataagcaatgctgacttactgtttcatattgtattatgtttttgaaactgatttagcccatgtctgaatctttattgttctgaagcccgatcatccagagcctaatatatacaacgctgaaccaaacaaacacatgataacaaaaacactaatttagtgaattaatctagaagaatctagcagaattaatctagaaactgcacagcagcagtttctctcttcagcttgaattactaagcaattcaagttagcaattgtgtagacccaaataagataataatatttagtcatttagatatgccactacaagtaaaaataaatcagatacatacacatacacacaaattactcatagaatgcagtattcataaaaattatgttactttttaaacaagctgtctttttatgtttttgcaaatagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaataggtaagaagtactttaaacattactaatcctctgtgctgatacatatacgtgggtaaagtggtaaagttcttttttttttttccttgatgctaccccagggaaacattaaaagaaactgttagttgataagattatagagagctacttaaataatctttgtgaaatccatttctaactccattaatctttgttgattaataatttctttctaaatgtaagtatcaagatcaagcctatgtaataagattagaattgcttcattggaaagctgtttgtttcaagcaggatagaaacaaatacttcttttaaagagttggatttttagttccgctttccacaggcttgttattgctctgtactattaaatgtaatagttcaacgaacgtaaatataacagaaataattattttctttatgcttaatttgttatgtcgtgatattcttgattaaatgtttcttgtcgattcacaaattgtaggaaatagtatactgtattgtatgtaaaatcctatacatatcatgtggatttggaagttttatgttttgattttaattcaaggtagacaaattcattatgtttcaaatattgaaattactatcacccatatatttttggatgctcattaccttctgttaggtttgcagatatgatacaaagaggtaaatttagctactatcaaatatgctaattccttcagctaaggggttatatatcatccatcaaactttctcagtagtctgtggtcctagctctggaaggacctccatccaccagaggaacacccataacagcagagaagtgccctctcctcggaggactgaggttccgttttgaaggtcctcccttcaagggtctaagttttaatattctaccttattccctgtgttcgctcagtcctaggggtggtagctctttcttgaagttgttatctccatgatattttaatgttcttttcccttttttagttacttagttagcaactttattcagtttttaccatcctgcatgtgaaattattattgttacaatgataggtgcaagttccgtttcctgacaagtccttgaaagatccagggcattagtggataaggagcataacccacctgagttataaagctatagctaaataaaattagcctgccccataggagaaaacatgactgtgaataacatattttagacctatgtctatctgaaatagtgacaatttcagatagcttttaattctcagatgggtacttactatttatctggaatatccaatcatttataattctttattatatttctataatgtgtgactggatttcataaatatttttataatagattaatggaattttagcactagtatttaatttgaattttgtatcacttttgacttggttgaggatcgtaatagaaaacagtgatcttttctaaaatgtaatatgtctttagaactcttaactacccagggtgtttaaaagcaaactatggttaaaaaactcagtagtctcagccctacttggaatgatttcaaacactttgacttgacaacttttctttatgaccctggtatctaaatactgacttccaattggtgcccagtaaatcttgatattacagatcaaaattgcttctgattgatgccaaaattctttaaacttcaagtttcccatcactgtcaagagttcactttcatcatcaaggacaaaataaattgtactaattttggcattgaggtggtggataagtattgacaaataaagtagaaattgattgtttctatagtggctattgatatacctttcagagtcacaatcaaagtaccaagctctaatttataattactctcagatcaatacaatatagatatgtctaaaactagtgtctttcttcaaaatttcatagattacttgaactggcttagttacttaaggcaagagattatttgccttggtaagatggatggtgctggagctatgtatgctgtgtcatatattcttggcttgatactgcatatatatatatatatatatatatatatatatatatatatatatatatatatttgttgttgttgttgttgttgttgtttttaagactgaatcttgttctgtcacccaggctagagtgcagtggcacaatctcagctcactgctctgcaacctctgctttctgggttcaagcagttaacctgcctcagcctcccgagtagctgggactataggcacgtgccaccacacctggctaatttttgtatttttagtagagacggggtttcaccatgttggccaggctggtctcaagcttctaagtgtttgagaaactcccaaagtgctggggttacaggcgtgaaccactgcgcctggccatgctgcatagttcttaataaataccaaatttatattggtagacagtattagtcaccagagaaggaagagtttagaatacattcttctcttttcacacccgtcctttccttcaagcttctggctcagtcttgaacagccttgattggtgttctatctctagctctgcagctgtttctgaattgggcaatacttggtaagaccatccatttagttcctcaccaaaaagttggatcactgtgaagcatcaacaatatagaaaatttcagatcaagattcatatttactgagtgctaatcagaatctatgaacaattatctatgacactcagtctgaataattccatactctacaaggtttctgtgaataattaacagtagcttttttattatcttctgaatgatcaggtatataaattgttatgtatttcacttaatggttgtttgaaaacacacacacacacacacacacacacacacacacacacacaccagtgtaacccagagagtgcttggcacatggtggtttacttacataaatgaataaagagtgattcaacaagtaaatatggcaaaagtattctaaatattctccctgacccatccacatttaaactacaatataattatgctgtcttatcctacacaaatcaataaaatgatgaaaatggggtagaaaaatcagaaaatagctataaaaaataatttgtatttctttagaggcatttagaggcatttgtatataacattaagcagtaagtattcatgaaatgacttaacaatgttggtctgtgttatagatctaagacaattctcatactcaaccattgccttcaatgagattacaagtaatttaaaatgcagcaattttaaagcaataagggaatatgcaatgcatctaccatttatatttataatatcagatcaggtattctagttgactcctggctgcttttcttccaaggtagctgggtatttgactgagcagttatatcacactgttactctgatatttggaaggcagaccatgtgcctgcttagcttgtagctcgaaggagaaggggtcggaaacagccaaaatgttactgaatgttgctattccagctgttttaacaaggtgttacacagacaagaattgggtggtttgtaccaaggatagtaggaaacagagggacttgcaaaattcaacagcttcttgacccctaatgttgggagataaatctgtggcccttatttctaagtgtattgtgtccaatactcttgtaattacatgggaagaggaaaataaagaaggtttaagaactgtgtttactttaatttgtggttactgtggcattgcgttgcctggaagcaactatattagaaacctaccaagtttttgagagaattgtattgacaaggaaactatgagcctatccttaaatcccgttgactcttcaaacagtgaaacagtcctcagagccccaaacttgcatccaaaaaaagtggacttgtatttttgcacagttcagaaggaaggcagagaccatagcaccaatctcaatatggccacagaggataatgaacaagaaggaacctacagtggaactaagccagaagctacaaagaacaatggggaaaggtgctcctctgggggacagccatggtccaatcaaggaactttcttcagtaccacggcaaagttcctcatgatgcctgcctagtttttcactatttggactagtgatgcttatatgtttcccatgtttccgttttctgtattacagtttatactgcagttattctgtccttacttcacaattgtgcattgtgttcatggtggtgatggtggtgggaagcagaaaacttgtattttgttttgttggttaccataatgcaagtgacactgctgaaccaaatgatgcagattgtgtgtcagccacagatcatgaactgtgagacatgcagtaactgaagaagagatctggggatgtttctttttttggttgtggagagaagaaagtcagtgaatattctaagtgtggaagaaaggatgacagatatttggtgagaaaaaggccaaactgtggcagagactgttagcttttcactagaatccactttttcctccttccatattagttaggcacttggctatatatctaaatgatatttattagcctcaattagttaagtatgtctgcatcactaagttctatacaatagaatattagttaaagtagcaggtactatttcctcattcttgcccccttgtggtggaatggaataccagtgacaatgaccacaataatcttagaagcctattattgaaactgaaagaacaattgtcaagctgcttgaagtaaagccacccctgttttgtaacttcagttaggctgcaacattctctggactctccagcaataagaaaatacacttccaggcctggtgcggtggctcatgcctgtaatcccagcagtttgggaggctgaggcaggccgatcacgaggtcaggagatcgagaccatcctggctaacacggtgaaaccctgtctctactgaaaatacaaaaaattacctgggcgtggtggcaggtgcctgtagtcccagctacttgggaggctgaggcagaaggatggcatgaacccagtgggcggagcttgcagtgagccgagatagcgccactgcactccagcctgggcaacagagtgagactccatctcaaaaaaaaaaaaaaaaaaaagacacttctatttggtttgagacattatatttccagtatatttgttacagtatttttgcttgcctagtctactataggcacccatgaatacttttcaggtgatatgtttttccctcatgacatattattaaggcaaccaagacaagctctgaagtgttctcaaattatttgaaggagtagtaatggaaattttctgctgataatagatggctagtctactccctcttttttcttcccttgccccttctttcttcccatctttattgtctatcgcaatgctgttggagtccatgaaatcctgcttgccaatagcaacatatgcaagttagtttgcatggaggtaatgcttgtaagactagttataaattataaaaacatgcaactgttgtaagtgtctccattagtaggacactgtttcaataatgaggatttcactgaaataatgaaaaacgccaaggatttaaattttatgttagcattgaccacatttactgataggaatgagttttgctcattgtagttaagctgatggaataaaaacagtaccttccacatggttgacctcacaggtttatttatttgcttatagatccaacaaatatgcattgagcacttacttcgttctatgccttattctagttactaagctataatagtgaaaaacttctgcccttatgtcattggcattctttcaggaggcagaaaataagccaaatgaaaaatgataataattaataattacatataatatttagagatgacaaattttgtagaggaaaactagagcacaggtgaaaagggatagcaggcattggaaagggttgcaattttaaacaggaaggtcgagaaaattcttgttataaagttgacatttggataacctgaataaggtgaatcagcaagccaagcagatacttgggaggagaatattccaagctcttctgatcaggaagctttcctatggtggtagcatgacccatgtgactgctaagcagcaaagaggccagcatgactggaataaagtgagcagatgagagaatggtaggggtaaggtagttaaatgagtatgtacatataatagagggccttataacccctgtcaattactttgacctttattctcaatgaaatgggaaaccattagtgggttttgagcagaagagtctcaatctgttttacactctaataagatgactctggctactgttttgagattagatggtggcagaggtggggtgaaagcttaaaagcaggtaaaagcagaaagaccaattggggaactattgtagcaatccaggccaaagatgtagaaggtttcagccatgagaatagtgaaagtcataaaaattgtattctggatagatttgaaagataaagacaacaggagtttctgaagtactgtgaattgtgagagaaagaggaaacaaatgacctgttacattttcatacacctgaaaggcaaaggctcattctccttatactgggacactaatataaacattataaaaggcttttccaaccaggtgtatcagctggtgatccagaagccatgacagaatgaggaatgccttctcattgttcatctaacatttccattaaagaaaatggaatgtttcccttctgcccacttcctagcatcacttcctttttattttaataattctgtagccaatcataacccctgtgctggatgagatgacagaaacagaagtctatttgtaaagaaaacagataaattaagaaagaggaaatatgaaatgttaagattgttatgatgaattaccttctgttaatgatatatactattattttgaaggggaaggcaaataatgcatgaaagtggactctaaaataaaagaaattttcttattacaaaaccaataatgataagatagcaccaaactagtaatacaatggagtttagtatttataacacaaaatgttccgttaatatattttatgttctttatgtttcatttgcaaagttggctatgctagcaaaggaggatatattgtataatattaatgggtttaaaacacgataatgtaagaagaagtattaagactcaagggcatggattattggtacattaatacctgtcttatattgccaagatccccactttgccttcttatacttgaaagggcacccaaggtatatattaatagactgccaaagtaatgcttaaaatataattatgttacagtataagaaatggtaagatacttaaattgacctcttgtgatcaatttctcctgttacaccaggataattaattattatatcttcttggattttcaagtacattcaaatgaattgtttccccttgacatatgggcttgaaatgatgtctgagtattacggagcatagacacataaataagcacaaaaaagtgaagaaaacagaatatagcatgtatttttttattttcctttcccccccaaaagtgcataattaataagcactattcaagaaatatctaccttatgaagaaaattgtattaaagccaaagttcagatttcatttagcaagttctgtcatgtttgaaaaattgagaatctctcacacattcaatatggctttgtatgtgtgaagaatggctcaagtaagtgtccactgcaataaacttgatgtgaacgttctttgataccaatatacatggatcaataataaaaaaggtaaatgtccttaggattttaaaattcatccctattcctttccacagcaaatgctattacatatcaatgaattgtataatttggatctgacatgctgtataatgtacactttctgtttgttatctcatacaccaaaaaagctatttattagaaataattagaatgagtataaatgaaactaaagatattctgataaaagcgaatatatatatatatattttataacatgatacatttctgctttattactgccaatcaaagcaagaactttaccatgttaaatatgcaacaccttttctccaactctgcacaaaataatctggtcaatgcataagtcttagtcctcctcaatgctgatgactaaaagggtttagtatatttctacactaatgtatggtaaaataaaatgatatgtagccatagtccatctgaggtaaaaaatgaaaatcacgtttgttttatatttaagatttacttgtacatgtatgtgtgtgtgtgtattctcacacatttatgtatatatacttatttgtattgatgaagtgagtttattcagctcaaaattaattttagagtggcaaaaactgtaattatttgactatcttaaatattttaaatttcaatcaaaatatttatttatgtgttatctatgactccaaaaccaagcttgttttaaaaccatttatttcagacaacaaccactattattatatccctaaaacattgtttttggaattattaaaataattttaatttaaataaaaatttaagatttgattcaattactgtggaaacaaatcaaatgtccaaggacatcaaatcaaaataaaagaagtaaactggttactaaatataaaaaatggcaagcaatacaattttggcagcattaaactaaatattttcttattgttaaacttactgttatatggaaaatcatttctatttagataataaagatgaggtttttttttctcttaaaggactaggaaatataattttgatagaaaatttaagtaatgtttcctcccattgtctgacatgagtttatgcaaaatcctaacacttaacaaagagagcagaacttgttaacttgtgttctgggtaaaaagaccataccatcttcagtcaaggaaccatggaataatctttggtctccacacaatctagaatgagccatgagggaagaaatacctccagcagaattccaccttctagaaaaatatcccttcctgattttttccatacttttatccttcactagatttgacaactaattactaaaaatcactactacttagaaactgattatttatttatctaatatttaccaactatgtaccaagtaatatagctggagctggggatatagcactgaatggaatggtccagacccttgcccttgtggagcttacattacagaaaaaagtgtcactggttacctgtgccttataaatcattagacaagctccctgacttggtcattgatcaaaagattaattcctttctgctagagatgacaagggggtatcactgagagtgactgtctttctcagatgtcatgtgtgaatcctagttctctattaacggaaagaattaaaaaccttcagagtaataagccaccaatgaggtgaaccttaaaaatggtgccaagccttcttatctttacaaagatgatttttgttttcacttgcattaggattcttttcaggtacctgtcacacataaaccacccaattaagatcatttgaagcggttttcacatgaaaagaaaactttcctgtgatggttctatttcagtttattttggggttattgtgtcagtttgctttttgttttaagtaaggaagaaaatagtgaattttagaaaagtatacattagcaagaatcaatataaaatgctattcaagcaataacaaatagagataatatacaaagatgtgctgtatctcaacctgtttatgttcaaaatttttatctctgggtagtaaaaattatgtcttatatatgcagacaaattcagagggatccaaaaatagtgttttcttctttaatgttgaagatgtagagtgacatagttgtttttcatatttcgtttcaatacatgtcctagtaaaatttcttatctacaaattcaaggcatacacctactgttgaaaatttatggtaattacataaatatgcatttgaaaaggtacaaaattttaaactagaaacacaaaacatataattatataacagccataactaccattaaaaaagtgagcatttaactttttaaaattagctgtgctaaaatatctgacaagtttatgaaaacctgatggttccaattttagaggtgacatataatttatttcattgcatatttttctagctattttgtgaaaatgtttaaaaagtttttttagagatgacatcttgctgtgttgcctgggctggagtggtacaatcatagctcactgtagcctggaactcttggtctcaagcaatcctcctgcctcagcctcctgagtagctgagagtacaggcaggcacaactacatctggataattatatatttatttttattttttaggaatagcgttctccttatgttgcccaagctggtgtccaatcactggccccaattgatcctcctgccttattctctagagtagagagaattacaggtatgagccacctgcttctggccacaaatcaaatgcactttttagaaaatattaatgccagtatctccagaataaattaacttcactactttacatacataaattaatatagcatatgtctatgcaaaactataatcataaattatgtatctgcaccccaataatactacctatgttcctaatctttatgaattgtaaatctcttatacaaataacattttagttaacaaacacacataaattgtatatgcaataacttcttacccctaactcttatttcctcctaacttatttataaacaggctacattatgtttgacttgaggctttcagtgatatcgctaacaacaaattatctcttcattacctgagttataatgattctcattatctatgttcatattcttacaaaccactgaggaaccaatccctaaattgaaaatgattgttcaccttctcttgaggccattgggattaatctcattaaattaacagccttatttatgtgggtcaccgcaaaatgccatcccttatattctagatattgttcatatatccaccagtcagactctatctctcacttacctctgatgtccttccactgtatggtttggaattaaatacctgtcatcaacaaaatattctatgtcttcaatcccttcaaggtacaatttatcttcttgcttatactggctatccatcccctgagaatatcaatttccttttctaattgagcctgtaactccttctttttaatccttctctggagatttataacttgtaatgaatgttaagcatgtagacgctatcactgaggtacataaatataatttattttagaattttgcatacatatatattaattgacacacacacaaacacacacatacgcatacatagagagagagagagattgttcttgggatcgtgacataaatttcccctaccgctggatctgcaggtttattcactaatgggtttccagtaggcaaaacaatgagcttggaacatactgggaaagtagtaaacatttgttgaattaatatcttaactaataacttatgttccctcctactcttcacttacttctagaccactttacttcctctctcctcccacaaaattacaacttcttataagtacatgctttgtgactataccattagcttcccttccattttattcatatactggcctcttcatcactctcatcatattttgaataacatagcacttgacttgctgtcatccttgtttgcaatgtggatattgaatccaagcagaaagtccagccaacaccctagcctcacagctccttcctcccttggtcccaacaactttcaagtcttaattgtaggttttctactctgtgagcaccatttcttatctctccagcttgtatattctaatcactcactgcaacaattctttgatgccagtggtattaataattaattgtttacaccattttttttgcccttgataatagccttcctcttcttttcttcttcccctgagtagatgccaaggtcttcctcacagagtttcaatttcttgcccctctcttcttccacatttcttgcctgtcaaaaccccaactctggttaaacctaattctctgcctgctttgcctacatctgttcagctgagcatagctatggaaaaaaatcagaatcaggctgacctgtttcatttcatgtttataacctcaactcacaagttgaattcaactgaattttctctatcaattaacttactacaatgtgagatgagtatttcacaccttcctcctccatattcaaatccctaacactctccccactcactttttctctgagtgacaacatggattttcatttcactgagcaaatagaagaaatcagaagaacatttttattcttccaccaccaaatccatcaatgatttatatttcccttttctctggatgttgcctcggtatttcttctgtattgacttacctggagctgggtagtctggaatagtcattcacgtgtttgaagcttcagttgggacagctggggaaagtttctctgtgatatcttattttccacatagtggcagaaatggtccagcagcaagaaaaagcaagctccaatgaacaagaactcatttaaacctttacttactattatatcattgaccaaagcaagtcacatggccaatattagagttcatgtgggaggggaatactcaaaagtgtgcatataggaaaagaaataatggcgactgctatgaactaagtgcttgtgtccctccaaaactcatatgttaaagcctaaatctcccatgtgatgatatttgaaggtgaggcctttgggaattaattaggtcatgaaggtagagccctcgtgaatgagattagtgcccttatataggaagggacaagagaccttactttctttgttgtccaccatgtgaaaatacaatgagaagatggccatctgcaaaccagaaagtgggctttcaccaggcactggatcttctggccacctcatcttagatttcccggcctccagaactgtgagaaataaatgttcattatttaaatcaccccgtctgtggtatttttgttgtaacagcccaaactgactaagatagaaattggtacttagaagtggagtgctactatttcaaatacctgaaaatgtggaagtgtctttggaagtaggtaatgggtagagtctggaaagattttgaggtgcatgctaaaagaatataatactgctatgaggggacttttaaatgtgaatctggtaagagctcagaaagtaaagaagagagctagaaaggtctctttcttattagagaatatataagtgatcatgtaatgtcagcagaaatatggacaataaaggccgttctcatgtgatctcagacaaaaattgggaaacatgttattggacaatggagaaaaggcactccttgttatacagtggcaaggaacctgggtgaattgtattcatgttctagtattttatggaaggtagaatttgcaagcaatacatgtggatatttagctaaaaaaaatttctgtgtatagttttaaaggatcagcttggttcctcctgactgcttatagtaaagtgtgatgagcaaaaggaattgaagagaaagaaggaatcattaagcaaaaaggaaccaaaacttagagatttggaaaattcttagcctatccatgttgcaggggaacacaaggggtgtggccaggctaccatttgataagaagattagtatgagtgtgatccaagaacctaatcagacatctcaacagaagccagttatagagacggaaatacaccacagaaatactggcaccaaaatggaataaaatgaagaaaagttgttggacttcttagacactacagcactggaccatagagctattcaactgcaaaaacatgttattcttcaagacaagagaagaatgaccctcaagtcattttcagagtttatcagggctgccactctcaccaaaggtccagagtgtatgggcctgggggacagggctgcctccatctcaactttaaagggcaagaccaatatgtgaacccaccaatgggtggggtaatattcttggttccaataggccatacagaggctgccctgagccatggagtcatgacctccacttggcagagcaactggggcctgtgtttcttgcctagcagtgctgcagaggcaaaacttacatcccactggatccagaggcagagcatcatcaagtcaagaggattattgcttaggtgtaagctcttacagagtttgccttgctaggttttggagtttcttgagacctgacacatctttctttcttctgatttctccattttggaatggaaatatttatcctatgcctatcccatcactttattttggaagtacataacttaacgggtttcacacgttcacagggagagaggaattttggctcagaataaatcatacctcaagattcaaccatatataatttagataatatttagataaggctttgaactttagatttgatatgagactaggtaaaacatttctgttggcatggaattaatgtatttttattgtgagaaggacatgaattgtggggggctgggaatggagtgctatgggctatatgtttgtgtccctccgaagttcatatattgaagcttaaattcccaatgtgatagtatttgaaggtggagccattgggaggcaatttggtcatgaggatggagccctcttgaatgggagttgtgcctttataaaaagagacatgagatggcgaaaccccgtgtctactaaaaatacaaaaataaattagccgggcgtgggggcgtgcacctgtaatcccagctacttgggaggctgaggcaagagaatcgcttgaacccaggaggtggatgttgcaatgagccaagatcgtgccattgccctccagcctaggcaacagagcaaaattccatctcaataaaagacaagacatgagagactttgcttctttcttctttgttctctgccatgtgaaaatactataagacagtgtattagtcagggtaccttagaggtacagaactaataggatatatatatatgtgtgtgtatatatatgtatatatatctttttatgtatatatatgcatgtatctatatatgtatctttcatatatatgtgtatatatacaagtttatacaagtatatatatatacacaaacacacacatatatatacacaagtatatatatgtgtgtgtttgtgtatatatagtatatatatatgtgggaatttattaaatattaacttacacaatcacaaggtcccacaacagactgtctgcaagcttgtggagcaaggagacccagtccgagtctcaaaactgaagaacgtggagtcagttgtttgagggcaggaagcatccagcatgggagaaagatgtaggctgggaggctaggccagtctcgacttttcatgtttttctgcctgctttatatttgctggcagttgattagatggtgctcaccagattaagggtgggtctgccttccccagcccactgacttaagtgttaatctcttttggcaacaccctcacagacacacccaggatcaatactttgcatccttcaatcccatcaagttgacactcagtactaaccatcacagatagtcatttgcaaagcaggaagtgtgcactcaccaaacattagatctgacggcaacttaatcttggatttcccagcctccagaactgtgagaaataaatgtttattattttagccacccagatcctaatatatttgttacagtagcccaaactgactaagatagcaaccgttttgcgaacaatacaccttctttttagccctttgtttctcttataatcactttcttgcaaatataaatgtagcattgttatatttttaccatattttatatgacagaattgatgcttcttcagttgagctaggtacttacatacttttcacatcatttctaggagaaaagttgacctgactttttgtcttaatttttatacgtagattgttggggaaatttttttgtgtgtgatggagtctttctctgtcacccaggctggagtgcagtggtaccatcttggctcactgcaacctctgcctcccgggttcaagcaattctcctgcatcagcctcctgagcagctggaactactggtgcatgccaccacacccatctaatttttctattttgaatagagacggggttttaccatattggccaggctggtcttgaactcctgacctcgagatctacctgcctcggcctcccagagtgctgggattacaggcgtgagccactgtgcccggcctgttggggaaatttttgcaaattgattgttagaatgatttaggctaactgtatttctctgctctgtatattttagattactcttagtactcttttatgtctctttattttgaattcgtttaaaactaagaataaattttaaaatggtagtttcagagtatccttcacccaaattttcccggtgataatattttacataaccattgcctattgtcaaaattaggaaatttgaaattggtacaatattattaactcaagctcagacctcattcatatttcaacagtttctacatgcagatttttggtatgtgtgtgtatagttctacaaaattttatcacatgtgtagattagagcaatcaatgcaaccaacaccataatcaggatacagatttgtccacaaccatttaaaaactctttcatgttaccccttaattaccatactctcccgcctactcttaactgttggcaaccactgatctgttctagatcactgtcattgtcaaatcaaaattattatattaatagaatcatatagtatgtgaccatctgaagtttgctttttttttcatttagcataatgcccttgagatttattcaactattgggtgtatcaatagttccttcctttttattgctgaataatagtctattgtatataaacatcatagtttatttattcactccttgaaggatatctggaatatttccagtttgggaatatcacagataaagctgtaatgagcatttacatataggttttgtttgaacataagtcttcatttctctaggatatgtgtccatgaatgcagttcctgggttgtatgttaaatatatgtttaacattattttaaaaagtgcaaattgtttttctagtctgtggtattttacacaatgattggcaataatgagaaatccagtttctctgcatccttatcagcatttattactatcagtatttcttatcttctctattctaacgtgtggtggtatctcataatggttttaattggtatttctaccatggctaataatgttagacatcttattatgtacatacttgccacctatatgtcttttttggtgaagtaactttaatttctggcctattttctggttgagttgtttgttttcttaactgttgagtttctgttgaaagtgccctgtgtattctggatatacatcgtttgtcctttaggtcaaggacattttttttggcttacaaatttctaatttttccaataccatatgatgaaaatttgtaagcaaaactaaaacaaataaagtacctaattttcgagaaaggcacagaaacaattcccttgaggaaagaaaaaatccatagtctatgtggatctgtttctggttctctgttctattctactgatctatgcacagtctttcacaaatatcatatagttttgattattataaccgtatagtaagtcttaaaatcagatagtgtgattccttcagcaatttttctttttctttcaaaattgttttgactgttctattttccttgtcttgccagtcttatttttcctcttatctaaaaattactttaacctgactttgctgatcatcaattgctgtattccttttctagttaatttctgcacttttttaaaatttttgactctcagtagtatctaatttattcctgttatttactcatgctaacttctcagaattagtttccctgtaggctcttctccagcaatccacctatagtttttccttcaaatttgagttggagactatcgtttcctaagaaatattcctgtctaacctcaaagtgtaatagctacactttcttttccccttattagggtcaaactgtgagtttttatgaccttaagcacacacacagataaacagacacgcaaatgcatttctgcatataattcaaaatttaaaaattaaaacaagcaataaaggaagtgtgtaacaaatcccatcaaaatttgacttctcctcatgaagaccccattgatgctactctatttgctcgtatttggaatacgaaattctttttaaaaattctctctctcactctctaattttttttgtttttatctttgcctttaaccacctccccaatttgatgcagatgctttgctggtggtttaggaatatgcattatctttttattgagtaatccaacactagcttttatgaataatttgttctatgtcattaagcattcacatttctgctctagctctctttatctttgctgtctctgccatgtgacaatcacctgatttgtctctctcttttaaattactccatggagcccctaatctgatgccatattattttattctctgcctcacattttaccttagaatttattcttaaatcttcatcccttttcaaaataaatgtattttacacatattcctgtatatatttctgttacattttttgccaaagattgcaaacagttaaattacttctctaatactcttctcttttttaaaaggtatatttccctcagtgcttgaacttaactaaatagtccctcagaacttcttttcataattaaattatttgatagggtctcttgggccttgtgtttgcacagccatactgaatgtgaactaaataattctgagtactttttgaaactttctttttacaaacagtaatgtattatttagaagacagagcaataggattgttcatattgaatgaaaataatgtctacagttatttatcattttaaggagcagagacactacttaattacaacagttttttttttttttttttttttttgaggtagagtctctgtcaccaggctggagtgcagtggtgtgatctcggctcactgtaagctccacctcccaggttcaagcgattctcgtgcctcagccgcctaagtatctgggactacaggtgtgccaccacgcccagctaatttttgtatttttagtagagatggcatttcaccattgttggccagatggtcttgatgtcttgacctcgtgatctacccgcctcggcctcccaaagtgctgggattacaggcatgagccaccgcgctcggcctacaatagttctttttaatgtgcgttttttactcatccaacatggctaatctctaatgaattaaaaacattttgccaaacagatcacaacccttcaccttcaaatgtacatttgttggtattgtgaggtctttggtactcaaccttggtcatcaaagcaaataagttttgactgaggactgacagaatattctcactgaatatttaactcctaaattatttaccatgcctacttaggccttcatttttattgcataatgaggcgtatgaaagcacattttagtctgacaaaataaaatccacacagaaactatgtacaaagatgcttgtgaacctacatgctggtaaggaattgtgaagcagaatattcaggttattttataaaattaacattaattgaaatgacttctttctgctcctttggcaaatctttcctgaataagtatacttcagtgagtacaattcttacacgtgtgaacaaaatgtagcctttgttcagatgacagaaaaatctataatgtaggatcagaagtaactgcagcttccttcactgcatatatctgtagttaggtgacatgaactgacacatatttcttattcatgagttctacagtgtgagaaggaggattcacctgaatattaaactgttataaactgttaatatattctagctagaattaattaagctggtcacattatttcaaagaaaaggttcgtgtagtgtctgcttcatacatatcaatgcttctcatttggattccagttcctgtggcccgcagcagtctttgcaaatgtatctttatttttctttattcttctaagaattaagaaaaacgagatttggaaaaaaaacctcaaactttcaagtgaccttttcttctgttcacatagttacagacattttgctgtaacatgtatgagctttttgaggggcacatatgcacagtctcacatctcatgtttaagccctttcctcttctttgattgtttcagttgaaataagaacacaggtcacaccgccctttaacagtggagtctgctgtttaaaaggtgtgtggggcattgtactaacatcagtagcttctaaattgcctttgtactttaagattattttacagatattatttagaacagccatagtttgtttgcttgcttccttccttccttgcttcctccctctctccttccctccctccctccctccctccttccttctctctcttttcttttttctttctttttttttttttttttttttccctcaagacggtcttgctctgtcgcccagactggagtgcagtggcatgatcacggctcactgcagcctcaaattcccaggctcaagtgatcctcccatattaaccttctgagtagctgggaccacaggcttgtgccaacatgccctgctaattttgggggaccttgaaggtagagacagtgtctctctatgttgcccaggctggccttgaattcctgtgcttaagtgatcttctgccttggcctcccaaagtgttgggattacaggtgtaagccaccacgcctagcctgacatagtttttttttttttaataatacatttagcataaattgattaatatttttcctctgaagcacttttagtttgataagcaagatatttaaaataccaccccaatatacaaaccttcaagccttaggagtcaagttctcctatttgaaattcaggatttcataatttaggaatgatgtaaatcctgattaagtaaggaaattgaggaaaattttaggaagtataaaatgtactttccttcatatttataaaagcttgtagcatttaaaatttggttgtcataatgatacaaaataaacattcaaatagaaatgtcaattataaactaaattttaaaattcatctaagaatagcaaaagtaatagaatatacatggattcagagtcataatagtaacatatctcttaaaggtagagaaacattcaagatcaagacaacaacatagcagagcctgccatgatttctcctgttctcaatttaaatagttatacaatatgcaaaagacaaaagcacataaaagagaaaatatgaataagaggcaaaagaatgactgagccagacttcattcccacttcatttgatttatttatattctcttctttcaagaaaagatttaaaccagtttacaaggataaacaaaatatgacaaaagagtataaattaaagttggaagaaataagaaaggataaacattgaggagataaatggagccaggaatatgccaaaatgcatgctataataactcactggctgacgttgagtcacacattcatatttaagctttcaaatagccaagcaaaagacatagttattttcatttgtataactgaggatgttttgagattcgctaaaaccaaatattaaaaacaaagacacacaactatattggtactaaggaaggattttaactgatggagcgcatcaaagaacataggcaggtgcattaaatgatgttataaagaatatccttgtaatggtaagtttcatagagtggctttcatgataaattaatatattctaagaatattacttatggacaatcactgagggatgatctaaaggattaccagttggaggtacaatgattctctacagaaaattgttttgaatcatctttagactatagataatttaaggaaacctaaatatgagaagaatacaaaaatgcatcgaaaacaaatgaagagtgtaactgatactgaagaaaattgaaatagtgatatggagaacacattttaaagggcatggtagaatgcagaaatacataaaaatgtaattaataaagaaaatagaggatagagcatcaagcttcagaaaacaaggagacgtttatagagatttttggtcataaaagacagttgtaaccattcatagaatgctatgccttccatattttctattaaaataaaaacatataaataaaagaataaaattagatcaacattgaaaaataagatgctgaaaatgtacatgctaaaaaataatggctatccaatttataaatcttcacatgcaaaattaaatttgtctgaagagaacatagaaaagagtcttcactgggccaacacacagacatactcaaatttgaaagagtcagaactaaattaaagataggctctggaatagtttttcttagatcagcccctaatgctaatttgggaaccatagaatgatagatcatggaacccattctaaccgtggatggagggctaagaaatgtaaggaatactgtccatcgtagatccccttaaggataatttggacttcaaagaaataaccaatagctgaaatatgggtgtcaagtctttaccagaatgagaaagctccctgtcaaaagacaaagttagctgtagcttcattctcatttcttatgtgtaagtagaattttaaaataacaagtttcaatcaccagatatcttaaaatctcctcagcccttttggaataaaactaacaaactggacaggtaaacacataattgtagaaaccttcccaaagaaaatgatatagaacacatataattgctttctactagtcatgaaaaaagtgagaaatattacatatatgatgaaaaggactagtagttcaaaagaaggacactatgaagaatcagcataaaggtctttctgtgaatattttttcaacaaagcaatgtttaaaactatatttttaatcccccaaaacttagaaaatatacttaatacttcaaatgggaacaatctgaaataaagattactttaaataaaaatcaaaatgtctgaatattcagagaaaacaagaaacaacatactgaaaacaagcagaacaaaaaatattttaacatccaaaggaaaattttaaagaataaataggttgggggccatttaggaaaaggagaaaaacttacagaagaaaaagtatataaaaaagtaatatgtcaaaagaaattcccagagctaaagaaacatttaggtcttggaacacaaatgtatcccagaatacttagaaaaattaaggtaaaaatctttatacacacagagacacatacacgtgacacatacatcatggtgaatttggaaatttttaaaaaatgaaattgagaaatcaatttaaggaaaaattaaaaagaaaaaaatttttaaattattagcattctgaaatgaattttttcataaagtttaccagatttttttactatgtaaagtattaacagaaacgttcaagtagaagtttaagaaggaagaaattataattcaagaattccatatccatacaaactgacccaaattatcaggataaaaaggcatcctttacataaaaaaatgaaaaagtactcaaagcaattcattaaatgaaccaaaagattgtatgcaatgatgaagaaaaggcgatgtaatgaaaatggtgaattgtggaaactgcaaaatagaataaatgtctaaatgaatgttgtcaggaaacacagcccatgcaatggatatagatagatataaatataatacacataccacaaaatttactcatttaaagtttacaattcagtatttttagtacattcagacaattgtgcaaccattgctataatccaatgttagaacaatcttatcacaccaaaaagaagctccactctcataaagagtcactcctattttttttttttttttgagacagagtctcactgttgccaggctgtagtgctgcggcacaatctttgctccttaaaaccactaatctactttccattttatagatttgcctattctgagcattttatataaatggaatcatataatatgcaacctttggtgactggtttcttttatattttgaaagttcatcaatgttgtagtatgtatcaatagcttatccatttttattgccaaatactgttgtgtcatatagatataccacatttgtctatctagtcatttgaaacatttctactttttggttattatgaattatgaaatatttatgtacaggtttttgtttggacatatgttttctcttttaatttttattttactttaagttctgggatacacgtatagaatgtgcaggtttgttacatagatatacatgtgtcatggtggtttgctgcacctatcaacccgtcatctaggttttaagccctgcatacattaggttggacatatgttttcattactgttgggtatataactaggagctgaattgctggatcccacagtgactgtaggttaatgtttaaaagagctaccaaactgttttccatagtgctatttttattcctaccagcagtctatgagaaattcccaattctccacattgttgctaacacttgttattatctagttttaaaaatattatgattattatagctgtcttagtagctgtgaagtcataaaacattgtgattttaatttgcattttcctgatagtaacgttgtgttttccattcacattttattcatgtgcatgtcttctttgaataaatgtctattcatattcattgcccattttaaattcatttatgtaagttttattcagttgtaagatttctttacatatttcttttatttctttttttattaggcaaataattttcaaattttttcctattttctggctcgtctgttcactttttatggtatattttgcagcacaaatgcctttaattttggttaaatgatttatcaattcttcaaagaataaatttataatttcttcattgcttgtactttgggtgttgcatctaagaagtcattaccaaacacaagataataagcatttactcttatttttcttatgttttcttccaggagttttatgattttgacctttaaatttaggtctatgatccattttgagttaattttggtctatgttataaagaaagttcaactgtattcttttacatgtggatgttcacttgttcaaactttagttgaaaagacatttgatgaaaacgctatttcatccttgacttgttggggtacgcttgttgaaaatcatttaactataaatatagtagtttattattagactcttaattctgtcagattgatctacatgtctatccttataatagtaccacactgtcttaattactgtagctttatagtaagttttgaagtcaggattttccaactttgttcttttttaagatcactttaatctggatctcttggatttctgtattattagctataagtctactcagatgttctatttcatgattaattatggtaggttttgtgtttctaggaatttgttcatttcatccacactatccaatacattggcatataattattcacactacttttttataatcattgttatttctgtacaatcaacagtaatatccctattttcatttctgattttagtaatttgagttttttctcttttttcttagttcatctagataaaagtttgtcaattttgttgaacttttcaaagaaccaatttttggtttttatttattatttatttatttatttatttattttttgagatggagtttcgctcttgtctcccaggcaacaatctcggctcactgcaatctccgcctcccaggttcaagcaattctcctgcctcagcttcctgagtagttgggattacgcattcaccaccatgcctggctaatttttgtattattagtagagatggggtttcaccattttggccagactggtcttgaactcctgacctcaggtgatctgcccgcctcggcctcccaaaaggctgtgattacaggcataagccaccatgccaggcctttattgattttttaaattgtttttctattctcttttttgtttatctctgctctcatctgtattatttctttccttctgttagatttaggcttagtttgttcttatagttccttagtttgttcttatagttccttaagttccttaagtaaaggcaggttgatgatttgagactttactccattttttttcctttttttttttttttttttgaggcagggtctcactctgtcacccaggctggagtgcagtggtgtaatctcggctcactgcaaccgccgcctcccagattcaagcgattctcctgcctcagcctcccgagtaactgggattacaggtgcatgccacgacgcctggctaatttttgtatttttagtagagatggggtttcaccatgttggccatgctggtgtcaaactcctgaccccaagtgatctgtcgtctaccttggcctcccaaattgctgggattacaggtgtgagccaccacgcctggacttacttgatttttaatgtatgcatgtatataatttttccccttagcatggctttcattgcattccataagttttggtatgttgcatttctgttttcattcatctctaagtatgtttaaattttccttgtaatttcttctttgatccattgattgttaattatgttgtttaatttccaatgatttctaaattttccagtttttctctgttattaatttctaacttcatctcgttgtactcagagaagatactttgtatcttttaaatctattgagatttaatttgtggcctaaaatatggtctatcctggaaaatgtaccatgtctacttaagaagaatgtgtatgtagctgctggtatgttgagtgctctgtgtttgttggatcaagttgctttattatgatgtttatgttctcttctcatacttatcttttctctggtggttctgtccattattgaaatgcaggacactgaagtctccaactattacagaactatttctccattcaattttgttagtttttgctggtcagaccattgatggtctgttattcattgtgtaaatgtttacaattattatatcttcttgcaatattgaaacttttactaatatatggggacctgctttggctctgattaacttttaaaattaatgtatattttgtctgctggtatagccatcgttgctttattatttgcatgaactttttttttttcactttcaatctacttgagattttggatctaaactgaatcggttgcaaacaggatatagttagatcatggtttttaatccattctgctaatctgtcttttcattggagagtttaatccatttaatttaaattaattactgatgaagaagcacttctgttttattgctatttcttttccatataccttataaatattcttttctttatttccagcattactgtcttcttttgtgtttagttgacttttttagtagtgaaatgtttcaattacttcctttgtgtgtattttatagctattttctttgtggttaccatagagattacatttaacatcctaaagttatagcactataatttgaatttataccagcttaacttctgttgtgattttctaattttttgtcttaaagtctctttctggtaagtggccataagccaagacagccactctctagaaaagccccgactgggaggagtattagattgagattgccagtaaggaaagacacagaggaggcagcacaacaaagcccattagataaccagaagcagttttattatttgcccaagaacagggaacagcatgtcttgctgagccaaccagaagaggaaagccatccaggacacatgctcacctagtgggaggggagcaaaagagagagcaaaatacctgtgagccaaagcccttattggggtccagagtgtgacccagtttggtttcctgcagggaattctaactgatgggtttagagcaagcaggcacaagttccgtggagtctgtgactgagaggtggttgccttggcatgtcttggcagtccatgtggtatatgggagtcagtgggtcaggtaggttatatctagctgtcccatgggcaggtggttgtcaggaggtagttgtataaactcctcccagttcctcaagctggatcaaccaccttgaggacttgggaggaggtagagaactggaaactatgcaaagtgtgactaagccccgcttctggtatgataaaattaaacctatattcaaaatggatgccaaagcaacataaaattatgagctcacaactttgaatagtatacaaaaactgcccctttacaggtcagttcccactgaccaactttttcagttgctgatgttccaaaattatatctttacatataatgtgccaaaaacataaactaacaattattttaaatggattagcctcttacattattcagaaaacataatgtggagttacaaactgaagttaaaataagactagctttttgacttttttttaatgtgttagtatcttaaattatgtagaaaacagtgaattataaactattgctactataacattagcttttgtaattgcccatatacttaccagtaatgaaatctttatttcttaatgtggctttgagtgactgtccagcatcttgtcattttacgctgcaggactttctcgtacatttctttcagggcagttctactggtaacaaaccaccttaatgtttgtatatctgggaatgtcatactttttcctcattttgaagggtatttttgggatatataagaaagttcgttgacggtttttgtttttccttttagctctttgaatattttgcatcactgccttctggcttccatagtttttgatgagaatctgatggtaatcttattgagcatcacttgcatgaaacaagttgcttatttcttagaattttcaaggttctgtctttggctttgaaaaatttgaatgtaatatgtctcagtgtggtctctttgatttcatcttacttgaaggtctttgtacttctcgggtgtttatattcctgtctttcactacatgtggtgtcataaatttgtgtaatatagtcaccacttaatatccaccttcaggcttgatgtaagttgtttgaaaccagttgtatccagtcacctttcacctagttaaaacttcctttccctgaatggttgtttagatatagcctgtttgttcctcatcccagtgacccaaaccctaacacacctcatagttggttactattataagacccaatggtgaacaacagagtcatctaaataagtttattcatttatatgtgttttctaagctagaaaatctacaaccttcacaggaaaccctaaggaataataccatggactttactgaaggcataattacacaggtactcttcctctctcctgctcctcaccctctggttgagctccctgatgcctttggaattccagtcagcctcccatcagtacctgtaacctctctgaaacctgtgagttatgaatttcttgtttcatgcactttggtttcacttcctctttgtctcacctgacacgcacacacacctaaacctaaccttcctcccattcaggtcttttctagaagagtggctgttttggtttatgagtgctctccaaaaaaagacaataccaaattaaaagaaactgtaataatggaaatctcatgtggaaagttttcagccattatttctttaaatatctctcttaccctttctctctctcttttccttacagtattcccacaatacttgtctgcttgttgacgttcagagatctcataggctctgtttaatattttcttcaatctttttctatttcaagttttataatttccaataccctatcttcaaatttgtttcctctgcctgctcaaatatgcctttgaatccctttagttaatttttcctttcagttgttatatgtttcagctccacatttcttttcggattttctctttttattgatatttccattgtgttcaacattgttttttgtttattctttttttgctttctccacttcttcttttagttatttgacagtctttaatacagttattttaaagtgcttgtctagtagatctgacagcaagtcttttttagggacaatttctgtttgtttgtttttttttctttgaatggaccatacttttctgtttctttctaggctttgtgattttttgttgttgagaactagatagttgaatctaataatgtggtaactctggcaatcagatttttctttcttccccagggtttgctgtggttttttaaaaattattttggtttattgtttttgttttcctattgttgtaggcagtctgtgtgccaggagttagcctgaggtgtaaatttaaggtctcttctggtctgttttgaccctgcacctttcaattgacatgtgtggtcactttctaattttcctcacatacgcagttgcttttgaatgttctaaatgtctttaatgtctgatgcccaagaggggaaaaagagaaaaatgaagtgataggaaaatgatactggccttttaaatgccctagaagttattgtggctggtgggggagcgcttgcaataatgcgggaggtacaaaaacaatagtcagccacttctttctctgcacttctgtgattggaagcagcaatcagtaatcagagcacaaatctctggtatttggggaatacgcttcttttttcccactctggctcccataagctacggacaagctgctccaggaacatgtgcacagccatctgcgatggggacaaggataggtagctactattatgttaagagccgaaattgaccaaaattaagtgcagtttattatccaagctctccagagttccaaaatagttatattggtcagattcttctagtgcgattacaattgttgtttaggtgggaagaaagattcctggtgcttcttattctgccatctctccaaaattttctctccaattgatatttgtatattgctcatgtatcctgtaaccttgctgaatttgtttattagtttttacagttttatgtatattcgagttttctacatacaagatcatggaatctgcaaatagagaattttacttcttccttttctatctggataccttttatttctttttcttgatcgttttccccagctaaaacatgtagtgcaatgttgaatagaagtgattagatcggccatctttgtcttgctccttattttaggatgaaaactttcatctttcattattaaatatgttgttagctattttttttttgtagctgcctgccttttatcagattaagaaagctgtcttctaaccctagtttttttttttttttgctggattttgataaatgttttttcagggtcaattaaaattattgtgtggtattattcttcattttcttaagtgttttattatattaatttttaattattaacacatccttgcatttctagtgaaaatctcactgttcattgtgtataatccattttacatgttgctggatttagtttgctaatattttgttgagaattttaaaatctctgatatttatcagcagttttgatctatggttttttttcttgttatgtatttgtctggttttgatataagtgtaatatcaacctcatagaatgagttgggaagtattccttcctcttgtattttttggaaagtttctgaagtattgatattaattcttctttgaatgtttggtagaattcaccagtgaaacattttgggcctgtccttttctttgtgtagggtttttaaattactaattgttatggactgaactgtatcccctcaaagttcatgtgttgaagccctaagccccaagtaattctatttggagataaggcatttaaagcggtaattatggttaaataagggtaaagccctaatccaatagaactggtatcctttttttatgttttttttttttttgagatggagtctcactctgttgcccaggctggagtgcagtggcgtgatctcggctcactgcaagctcgcctcctgggttcacgccattctcctgcctcagcctcctgagtagctgggactacaggcgcccgccaccaagcccggctaattttttcgcatttttagtagagatggggtttcaccgtgttaaccaggatggtctccatctcctgatctgcctgccttggcctcccgaagtgctgggattacaggcatgagccaccgcgcccagccagaactggtatccttttaaagagagaaagacggcaagggtatgtgtgtatacagagaaaaacctgtgtgaggacagcaagaatatggccatctgcaaataaaggagagaagtctcagcagagattaaacctgatattttgatctgggtcttccagcctccagaaatgtgagaaataaatttctgttgtttaagccacccagtctgtggagtttgttatggcaacattagctaactaattcaatcgctttactcattgtaagtttattaaaattttctgtttcttctagagtcagtttcagaggtcatgtcttcctagaaatgtatccatttaatctaagttgtctatcatagtactttgtcttttaaaaaaatttctgtaagattggcagtgaggtcctctctcttgtttctgattttggtaattttagtcttctctgttttttttcctctggtcagtgttactaaagatttgtcaattttgttcatcttttctatgaacctacttattattttattgattttttctattgtttttataatcactatttcattatttcctactgttattttgtttcctttcttttgctttctgaatgcttagtttgctctttttttttttttttaatgtctaaagatagaagctatggttattggttagagctcttcctttaaaaaataagcaccaacattcataaacttctatctgagcactactttagctgcatccagtaaatattggtatgtcgtgttttcattttcatttatctcagagtatgtgctaatattcctgtgatttcttacttgatacattattcaggagtatattgctaaattttctatattttttaaaatttctcaaatttcattaagtgattgatttataagttcatttccttgtggtcagagaacacgatttctacgatttctacgatttaatttctttaaactttactaaggattattttatggcccactatacgatttatcttggaaaatgatctgttgtactttgtactctgctactgcaaagtggagtcttctatagatatgttagttctagatagtttataatgttgctcaagtcttctatatccttcttgcgcttctgcctagttaatttatccattaggaaagtgtgatattgaaatttcagactgcttttgttgaattgtttatttcttccttcaaattatcagctcttgtttcaggtctttcaggtttattttatgtacctattattagtgttatattgtactgatgaatttacccttttaccattttaggacatccctgtttaacttccttttacatttttggtttataggtttattttgcctgatattagtatagttactccaactctcttatgcttactgttactgtttaatggtgtttcctttccctattcttttcaatctatttgtatctttgaatctaaagtgtgtattcgacagacaacatatagttggatcttgttaatttatcctttctgacaatctctgccttatgattgaattgtacaattcatttcaatttaaatggaagtacatataaaacaaggttatgcattgattggttgataaaaatattgtggccagagactcacaggaaccaaattctgtttttccactacatgaaatggctcagtatttgcctatttgaaattgttggtgactttataaaacataactacatatgaataataaaaattgatggtatatacatgtagtatatgcatactattttatatagttgctttctatgtcaggtaagagatgaaaggacaataaatatgcaattatactaccttttataatcatctctatttatatttatttgtattttatgtgtggatccaaatatttgcctgatgtcacttgttttcagcctgaagaacacctttagtattccttgaaaggcaggttagctagcaataaattctcttaatattgatttatttgggaatatttttatttcaccttttttgaaatatagtttttctggacacagttttcttggttaaaaattcttcttttttttctgtcagcactttgactatgccatatattgccttctgaactccattgtttcagataagaggtcagctgttaatcttttgggatcccctgtacatgataagtctgctcttttgctacttacaagattttctctcttaattaatctacacatccagaaagcccaaagaactcaaaatagaataaaaatgaagagatccacacctagatcaatcagagtcaaaatgttccaacccacttttaaaccctctgtttaatattttcactctaattattgtactttcaaccctggacttttcattaattcttcttctataacatctagctctttattgacattctctacttaataagacaatgccatcatacctttgtttaattatttaagtgtgactttgtttagtttttatttataatatctcctttgcagtctttggctgataagtacaatatttgggtcctttctcttgccattttctttgcctgtgtatggctgtgaattggacattttagaaaatacaatgcaatgttcagtattgattctccttcccctaccctggacttgtttgtttatttgtttagtggcttggctgactgttccaatgcagtctgttttctccacagtgtgtagcctctgaagtcactgagcagacaatggcagctttaggcatagagtgcagtccccctgacaatctctcccccaaatgacagtggtttcagcttggctgtcttttactgtggactcagagtccctggggttcaacttttgattttttgacttcacaatgggtttatcaggatgcaacctcatcgtaagtcgagaagcatctgtatttctcacatcttccttttaattttctggttggtctgtctctcttgctatcacactcagctattagactccattaatttgtagctgattgctctattattttagagaatacctcagggcataagttgctccacagtttgctccaattaacatctcagtccctttgcagatgtagtctttgaggacagttagtgagctttggtgtgaccagaggtgttctctttttagcagcctttttccttgattctctctgttaagcgtttcaatttttactatcgtatggctataaacctccacttaattgcttacgaccaaagtcaccattgttttctatagcactgttatgcttttttctccatactttgttctaaacatctccatgatttattctaaataaagtcagcctccttggggacagctacaaagctctctgttcttggtctgcctctgtccctgggcagaatgtctgcactacttctccgaagaacagcttccacttatcttggaataacatagctactctatgagtggagtgctgggttgggatgacagcctctggttctgtaggaatactttcattctataagtgagatggatcaaaatgatgggacccagaataataagctcactgcattcagagtataggttctgtcctacaattaaggttagatggagaaaggaagcctgagatctgttagcattagaatagagtttctgcaacatatacctagggcagaggaaaattgctagtttgggatcttcccttcctgagaagaaaccatagcactagactgggctctgggagaagatggagacacatcttcttggttgtacttggacagagtagagcttctcttccactgagcctgaggggtctgagaacaattgtaactcaattgtcatggtctcttactgttcttactgagatttaatatattttcttaaaaattgtttcttcatttggagtattccctttgtataattttctaactctactatataaaccaaaattttcagtgaattaaagagttaaaagtatatatctcataaaacgttaatgtaatttgtaataagaaatgcttctaatattagatgttagaagaggagaagcaaactttatatgctgtataatccctttaaaaatattaatacaaacattgctgatgacatgataaagtgaaagaaatttttaaaaaacatctgccaaggtgttgaaaataatatttctaagcaaggtgattaagggtgacttgtattttctttgacacatccttgcatattttccaaatcttctatggtatacatatatgtctataataattagagcaataatccttattaaaaatagtgatgccttttttagaccttacaccgtgtttaaacaaattttactaattgcttggtggctgctagcatgatcattttttccacagtcttctgactctacttttgctgactctgccctgatatttcatcttgattgatacagtatgtgatctactccagtcacctttgttcctccattcattaagggaagcatgaggggaagatgaaattcacacctaggcagttattttcttctgctttattctgactccaaactgctgcagctcttgcaggtcacatgcagctctgagagagattcagtcagctcaccttttaagcccagaggttctcagactgtatcaacttttgaataacttagttcaatctaattctatttttttcctgtaaattcaagtagtcatcatgatttctatgatttcttccatgagaaactgttatattcaatataccttatatagttattgttatttacattccactataggaacataaaaactgtagtaggtcctaccactatttcaccttaaattgtattctgtcggacaaaatcttccatcagcaccttctttatgttgaactcataaaatatggcagtctacaaatctatttatctcttcttaggtatccattagagaattggttttctatcactttgaattttgctcaataacacccctcaaattcaacaaagctaaatcttaaaggtaaatgaaagtaaagagagaccaaaagagagacatgtttaactcacaaatgaaatatctaaaaagattttcaaaaaaccagatactactatatacagctaattggagaaaaaaggaatagactctctttatttgtgagtctaaagtcaattttaaagagctcaatacagaaaaatttgtatatagatgtaaatatttaaatataaaattttgtcaaataactaagatgaaaattatgtcttaacccctgctatgattattaaatagcaaagtaaggtaattatagatgatgttgtcaccatgttttatgtttattaaaggtagcattttaattttaggttaaatatacaatgtaggagtatagtagtttatgggctttaatgcacattttatgaaatgttgagtctgtttgcatagtcactgtgtatgctacatttaggccaattttatgggacttgaagaaccatagcactattttaaatgataatgctggtttatagggattgtgcttccttttacgatatcagtgattgatatatttaatggctaatttttgatgtacttcaatgtgtaaaggtagaatacttatataatgtccaacatactgtgtggaattattcacacagctgccgcaatttgtttatttaactacaaattcaaaattactttcctttcctttcttctttccttcttttttcttttcttttcctccctccctctctctttctctctgtctctcttctcttctctcctcttctcttctcatctcttttcttttcttttcctttcctccagagtctcactccatcacccaggctggagtgtaacggcgagatctcatctcactgcaatctccgcctcccaagttcaagtatttctcctgcctcagcctcccaagcagctgggattacaggcacctgccaccacacccacacctgccaccacacctgccaccacacctgtatttttagtggagacagggtttgccatgttggccagcctggtcttgaactcctgacctcaagtgatctgcccaccttggcctcccaaagtgctgggattataggtgtgagccaccgtgcccggcctcaactacttcttttaagcctatagtatcaggcttctgctgatggaatgaagaattcattgggcttagattcaggagaactgaattaaaatcctgtatgtttgggcaatgattaactagacttttttatttcagttcttttctcttagtgagacaaagctgcaaatttgacgtaaaaagtccaagctgtaaattctggctctatcaggtgttaatgggtatttgacattggaatcatttcttgatttctatgaatatcagattcagtttgtaaaatgtgaatcataatatatatcaccttgataaaaacatgaagtaatgaatgtcaaagtgttttgtaaatggcagagcattattctaacttttgtacatagcacatatatatttagtgcttatttttatgctgagttcccattctcaagtgtgacatcttactggaggaggcaaatacaaataatatccatacaaagagtcagataacatacagatgtacaagtattatagacagcttgcagagctaagcaagcatagaagacttgagtaaacaaatggcatttgaggtgggatttaaaaagggaagaaaaatgggagcaagaactacaacagttgtgtagtggtgtgaaattaactttggctaaagtagataacagtaagatataggcaaagacatggtagaaaatgaggtttgcaaagcattttgaggcagacagagagctattaataggagtttggacctttttccttggtttagtggggagctgttagagctctttaataattctccatccagattatggctggttgatacctatgacttacatatttttgacttaatatcaaatggcaataggaggtgccgggtggttaatcctgatatggtttgaatgttggtgttccctccaaaattcctgaaattgatattgaaacgtagtcccaaatatcaacagtgttaagaagtgaggtatttgggaggtgattaagtcatggaggctcctctcgcagtgggatttaggcctttataaacgaagcttcacatagcatttggctttttcttccccttccttgccttctgctgtgtgaggacacagtgttcaagacaccatcttggaagcagatactaggacctcatcaaatactgaatttactggcaccttgatcttggatttcacaaactctgtaactatgagaaatacatttatctttttttataaatcatataatcccaggtattttgttacagtatcacaaacagactaagacaatttctaaaatctggcaccctgagctcaggtgtcagtttaataaaccgagtgtgtgtaaaatgtggaagaaaaaaaaacaccctttagccactatgcttataattatttaacagttaaaaaaaaggcacagtagttgtctcactccgtttgggctattataagaaaatgccttagactgagtaacttgtgaaaaacaaatttatttttcacatttttggagcctggaaagtctaagatcaagacaccagcagatttggtgtttggtgagggcttgctgcctgcttcaaatatggtatcttcttgctgtgacctcacatggcagaaggagcaaaaatgttccctcagactttgtttataagggtactaatctcattcagggttttgccctcatgacctaatcatctcctaaagatgccatatcttaatactcttgcattggagattaggtttcagcctgtaaattttgggggaacacaaacatttagaccgtagctgtagtgaaatattgtcagtcaagtaatgctaaaagttttgctttttttttttttgtttatttttaaaaacatttttatagatagcatcttattgtgttacccaggctggagtgcaatggcacaatcttgctgcaacgtctgcctcccaaactcaagtgatctgcccacctcagcctcctgtgtagctgggactacaggcgcccaccacaacacctggctaatttttgtatgtttttgtagagacaggtttcaccatgttgcccaggctggcctcgagctcctgaacacaagcaatctgcccaatttggcctcccaaagcactggtttacaggtgtgaaccaccacatctggcgaagtaatgctaaaagtttataacagcacactattggtgaacatgactgggcatatgttctgtaggcatacctttttagatgaaagtacatcctggcctcattggagtattttgtagatgtccttccaaggatatgcatgaacataaacaattcacataatatgtacatatatatgtttatcataaagagtgaatgcaaaataaaaatgtatggagtgaatatttggcagagtacatttacttatttagtttacataattatacctcttgctcataaccctgacagaacaggtctaattttcattaagcatgactacagttttcctacactaatcatattaatgttatacttgttttgataccaaataaagtaattaggttgtttttgatggtagtgaatataatatgtatattaacaaattggcatctgttttatttcatttttcatttcaatttaaatgtaatcaaccaataatgaccctagtaagctagttaataattaagataagcattcttccactaaagttatatagtttatttcaaaacttatgtttaatacatttcaaaagatattaatcagaaatgttcaagagaaatggatattctgagccaattgttgacattctaaatccaagtacattaacagcaccttttcaatcataactattgcatcattagtgcacagctacatagtgctaattactttatttacctctacattgaatgaatgctgttaaacctttttaaataattgataatttattaaatactaatatatgcaaaactgaactatacaagtttttccaaattatatctgccatcttttgattatataaatacaacatatactacctgaatgcaaaattaacatattatatttttattatgttaaaacatatgtaacacacagttttccattttaaccattttaaacgtagagttttcagtggcattaattatattcacaatattatgcaaccattaccagaatctatttcagaattttttatcaccccaaacagaaactatgttccttaaaaagttaagcatacaattaccatatgatccagcaactctgcttctaaaaatatactgcaaagacttgacagcagatactcaaacagatgctggtacacatacatatgtttaactttttgagaaacagtgtaagtgttttccacagtggctatatcattttatattcctgccagcaataaatgaggattccactttctccacatccatgacatgctaacatgtgctattttcttgttttttggtttttttttttagtacagtcatcctgttaagtgtcaagtgatatctaattgtgtgtgtgtgtgtgttttcaattttagtttttgtgggtgcatagccatatatatttatggggcatataagatattttgatacaggcatacaatgtataattatcacattagggtaaatgggctattcataacctccaggatttattctctgtgttacaaataatccacttatactctttcagttaccattgtgattttgaattgcattttcctaatgatgaaaaatgttgagctacttttcatatgcttattggccatttttaaatctcctttggagaaatgtctattcaagtctgtattcatcagagaaaaagaacccataggagatatatatttattatacaaattatacatataaatatatataatataaatctataaaaagagatttattgtgagggactaacttatacaattatggaggctgagcagtcccatgacttctgtctgcaagttataggcacagaaaagatgttggtgtagttggccagttcaaacctgaaggcctgagaacgaggtgcactgatacctgatgcaggagaaggtggatgtcccagctcaagcagagagcacattcagcctttctcatttttgctctatttgtgtcttcagtgagttgggtggtgcccacctgcaatggtgaggatgatcttctttattcagtctaccagttcaaacactactctcttgaggaaaccccctcacagatgcacccagaaataacgttttgtcagctatctgggtatctcataatgcagtcaagtttacacttaaaattaaccatcacagagtcttttatttacttttaatttgctttttgtcttcttgttgttggcttgcataagttctttatatattctggatatatattttaaatataaccatatactttttcccttatcaggtatatgatttataaatgttttcctccactctgtgggttgtgttttcactcttctgatggcatctattttgattcccttatttcctttagtttgtgttcagctagtgttttgatatagattttcttgaattccaagtgcttggaaacaaaacaaaacaaaacaaaaaaacacctctcagtgtttgacgattaattctgtgctgggtcactcttttaagatttagccagcccagttaaagctctggcccaacctttacttcctacttgtgctgagtgtggacatcagccaatgatgaaagcttaaggttttcttgggtcttttttgagcatgcatcctatcctagtcatgttcttggtttccaaattccccagtatatacaggcacttttgagtgttctcatttcccaaagaaattaccttcctggctttttctcccaagatttaggcagtcagttgtgtgtcttaatggtaatctctcttttacctcagttggctgcaggttcttcatttgccttccctttttgaatagcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagaggtgtggataagggcgagtaagaatgccacaatttttggctaccatttttaaattgcccccttttttttttttttgattcggcattcatttggttactgtatacttttgactgtttctggagttctgacaaagttggttttgacagttctgcttgttttaaatgatttttgtgaaggcacagatgtttggagctgcctaatctggtgttttgtggatattgctctcctttactgtaattttatattccaatttaagttaatggaattaataagtaaacctgtgaattataagacttgcattacacaaagtactgtaggacgtatgctggtggaagacggaccctcaagaatttgagaggtagatatgacctgcatatacatatctattacagcaggtagtttatgacctgtagtaaatcaggggagtcaggaaaagattaataaggataacttttaaggtggactttgtagcttaactaggatttttatagttagtgataatagggagaaaaagtttagctggaagaactgaatagaatcctgttttatgagtatgtaggctatttgtagagttttggtggaagatagagccagatgatcataattagttctgtctcttatttaaaagacaatgaaaataaaagcttttaagcaaagaaatgctacgatttaagctcctgcttcagaagattagtttggcagtgatgggtagaatgcattgagcctacaaaatgtatattacatacataaaattatatatacaataaatgtgattatattaagacttttgaaatctaggaactcttagtttaagtcaataaataaaagatttgcttattttaaaacccatctaaccattatgacacctaagatttttaaaatactaggcaaatgcagttaaaaaacaaattatgttaaatttagcttcagagtatgtttcaatgaaatatgataaatactaccagaaagttacttattaaaataccatttagaatccgcaatacaaataatcatgctacaagccaatgcttattggatgcttcctatatgccaggaaatatatgatgttaatttatatatgctttctataagtatatttttctaagtgctttatcagtggctgctcatgtaactctctgttacacgtctgccagcctgtcagttaagtaccatttttatcatatcattttatgaatgaggaatctgagacttctataaattagggaacttggcttgccacataaccagcaaatggtagagctgggatttgaatccattcactcaggctcacagattttgaccttaactgtcacatagcactttctccctttttaacagttatcaagaatctagtattgaagtaagatgtcgttaaaaaaaaaaaaaaaaacacaaaatgtgtaaaaagagacattaagaaaactaccatagtagtgagaaattacaatagtctttttgctaagtcctcaatagattagataaaataaataaaaatttatagactttaaatataattaatagtagcaagatattcatacaatagtagatatctatcataggtctgtaatagatgtagatgtatttgtatattaaacagattatatatttatagaatatatatcccaaactttctattcatatatttaaataaataatatagtttattttcaagtgcctatagaatatttacaacgtgaaaaagtgataatatcctagggtgaaatgttagtatcaaaattttaaaaataatattaatatgcataccacattctcaattttcactaacacaaaactagaaattaatagcaaaatgttaaccaaaatacttaataaaatgacaatttattaacatgttcctaaagtaggtctaagataattttaatatgtaattatatagtttttgattaaaggaaatggcaatattacattccaaactgcaaatgatgatgagaaaagagttctcaaataaataccctaaaggcttttataattaagtaaaatagaaaagaaataaatagagtcatatcaataataatgtagcggggaaaacagaaaattcacctgttaatacattagaaaaaaaatgatgaatctaagaataattatttgatagggagaggaaaaattctaccaaaataggtgagaaaaactctggaatgtctaagaaataaatacatggaaagagaaaaattgaaaacacactgtgtttatcaattgctttataactatttactccaagagttagcagcttgcaacaaccatgttttttttcacatggtttctgaaggttaggaatctggtggcagctcggctgggtggttctggttaacgggttcttgtgaagttgccatcagtgttgtttatggttgcacatccaaaagcttgactggagattgaagatctattttcaagcttacatggcttgcaaacttcttcagtatcatgtgggtctcctcttcatacagcttcatacagcttctcatgatatggcatctggctttcctaagagtgagtgatctaagacagtgagggagatatatatatatatatatatatatatacacacacacacacacacacgtatgtatatacatatatatacatgtatgtgcgtatgtgtatatatacacatacatatgtacgcatatacatatatacacgtgtgtatacatacgtgtatatacacacatatacatatgcgtacacatgtgtgcacatatgcatacacatgtgtgcgcatatgtgtacgcatgtgtgcacatatatatatatcagatgatatatatacagaaagtgagagagcagatacatataaatcttcaaaaccagtccttaactaacaggtctcctctcacacacaaatatatcctattggacctttcaagtatattaacttatgtagcaaaaaggacttgcagatataattaaggttaataatcagtgactataaaatagggatattaacctagattatataagagtattggtgggatgtagggtatgatcatgtgcatggagaaattttcttctgctggagtcaggagaggtatagcagaaaaagctagaaaaattccaatgtgagaaaaatttgtgtgccatttggggcccatatgaaaggcttgaagagaggactctaggagttcagggtggcctctggctgacagacaggaaggaaagagaaccttcattcttcagccacaagaaacagcattctgccaacaacttgaatgagtttggaagtggttttgtttgtttgtttgtttgtttgttttttcctaaaacctcactataaaaacccagctggctgacaccttcatttcagccttgacaaacccacagcaaggacacagttagctgagcctaacaggacttctgacttttagaactgtgatataataactgggtgttgttttaagtcgctaaatttgtgagaagtggttacagtagcaatggaaattgaataccatagcatatacttactctcaaagtgatatgccctctcttttgctatattatgttggtcagagaccaagcagggggatatgggagggaaccatacaaagatgtgaataaaactgaggtgagatcatcaaggactgtattggaggttactactatcctctgacctccacaatacaaattccctcacatatgaaaaatacacacactgccccccaggattccccaaaatctcatcccattttagcatcagcttgaggttcatatgctgttatctaggtccaggcatggatgagattcctggagtgtaggcacttaaatacagttccttggataaaattacttaaatacagctccttgaggatatttcctctctatctagagatagaggcaggttactgccccccccatacccaatatcctggcagacaacagaggataatagttgtagacattcctgttcataaaggcaaaaaataaaaggcacaaaggagacataggtccacagcaattttaacatccaactaggcaaatattggcagttcttaattgttgccaactctgattcctgcccccaaatgctctctgtatctttttgtttaagattctgggtttttggtttctccctttgagttaccctttcttttcatgaatggtagtgcatgttcacactgagtaatttttatagcctgccttcttatttatagatttaagggtccaaggacctctttttattttgtactgtcactgttcttttcaattaaaactggcgattctggtgacataatctgcatacaactttgtagatcttctgtggatcttgttaaggatcactccattgacaaaatttatgtccctgcatcttttctatataagcctcttctctaccctcttccactgagatggctgagatactatactctttaccttcttggaatctctctctacttttttttgttgagaggatttatgatgcgcacccttaaattctttatagggctttttttttttcaccacagagtactatgagacaccccttttaacttttctggagtcttaacaaaggcttttagagtcacgtcattggattctactaattctatccttgtttcccgtcttgggacactggaaatcttcaaaaccagtccttaactgataagtctcctctcacattttactctaaacagagtatattcaacatttttaatggaaatttcctcagctggatcaccccatttgttaggtacattttccatcttccacatcactgcaagtaacaggtttgttggacattttgccactaagtaacaagaatattctttcctcaaatttccaataaaattttcctttctttcccttaactgttcacaggcagcctcctcaacgtcaaaacttttgctaacagtctgttcgaggttttcctaaaactcttcttaaaacccttctacctacttcctattgcctggtttcaaaatgattccacatattaggtatttattgtggcaccacactacttccaatttctaaattttgtgttatttgtcaattgctgcataataaatcatccccaaattttgtggttttgaacagcaaacatttactgtctcacatagtttttgggtactaggaatctttgagtagctgagctaggtgctgctggctcagaatctcttgtgatgctataggcacattgttttctggtgctgcagtattctgaatgtgtgattggggcaggaagatctgttttcaagctcggtcctgtgactgttggcattaggcttttcactatgtggacttctccacagtgttgtttatgtgactctgaatagtcacaatgggggttagtgcttcaattcacaggacttcctataagaaaaaaacgatagggcatttatgctaggggagctggctttcctcgggaagtaataacagagagagagaaagagaaagggagggagagagagaaagagaggagaaataaggacggaaaataatatctcttataagctgtctcagaaatgaacataccatcacttctgatatgttctattggtgacatattctattggttacagtgaccaaatctggtacaatgtagacagggtgtacagaagggtagaaatagtaggaggtggggactcctaggagtctcttggaggctgactactacactacaacttctggcctccaattagtcatgtctctctttttaaattaaaaaaaaagaaatgttggggggtatggaattatactttataattcaggaatgtttgtctcagggaaattaagactcttatccaagacattaccaagacaattgaaacctaacccacctgtattgttccttttcctactgctataaagaactgcccgtgactgggtaatttataaaggaaagatgtttaattgactcacagttctgcattgctggggaggcctcaggaaactttcaatcatggcagaagtcaaaggagaagcaggaaccttcttctcagggcagcaggatggagtgagtgcaagcatgggaaatgccagacacttataaaaccatcagatcttgtgaaaactcactatcatgagaacagcatgggggaaaccgcctccctgatccaattgcctctacctggtccctcccttgacacgtggggataatggagattacaattcaagctgagatttgggtggagtcacagacctgaaccatatcgccacctaaacctcatgcctcacctaaaatcttatgccttttctcttgcaataaaataggataccctggagatctgctatgtatagtactgttttccatagtacataatattcctatactgcttgagcttttgaaattgtctatctttgccagtttttctttatctcagccttcaatttctatcttacctcactggaataagtgttccagatggataaattttctctccacccttccagattactatgtttttgtttgcaataaacatgtatggcattgcctatagcatcatgaaagaaccagacttactgaaatcgcatgaaaactaagtgtaggccaggtgtggtggcctgtaatcccagcactttgggaggctgaggtgggtagatcacgaggtcaagagattgagtctggccaacatggtgaaaccccgtctctactaaaaatacaaattttatatatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctatatatatatagaatatatgtgtgtatatatattctatatatatatagaatatatgtgtgtatatatataatatatatagaatatatgtgtatatataatatatatagaatatatgtgtatatataatatatatagaatatatgtgtatatatagagagtatatgtatatatagaatatatgtatatatggagtatatgtatatatatagaatatatgtgtgtatatatatagaatatatgtatatgtatatagaatatatgtgtgtatatatagaatatatgtgtgtgtgtgtgtgtatatatatatatagagagagagagagagagagagagagagagagagtaagctgggtgtgatggtgtgtgcctgtaatcccagctacttgggaggctgaggcaggagaattgcttgaacccgggaggcggaggttgcagtgagccgagatcacaccactgcactacagtctaggtgacagagcaagactctgtctcaaaaaaaaagaataagagtaaatacgttctgagtaaaaatctatgtgggtcttcctgtattagactgtttaggttgtcataacaaaatactacaaactgagtggcttcaacaacagaaatttgtttctcacagttctaaaggctgggaagttcgagatcaagatgccagctgactcacttcttgttgatagctctgttcctgttgtgtagatggctgccttctcactgtgtcctcacttggcaaagaaagtgagagagccttcgggtttgaatgctgctataagaatacaaatcctttcagatcagtgcttcacccttaagaactcatttaactctaatcaattccttattctaaatcatgcttgaatgtatgagtttgtgggggaatcaattcaattcataggacttcctataaggaaaaaatatagtgctttgactttgggatattatagtattcaaggagctctttttttccaatgggggttttgtttctttacattatttttctcagtatcaatccagacagtgagtttttcatatatttatgttcccaataattaagttactgattataatatggagtttcattattgctgctattttagaaatatgtatttcctgagtttcaggttcaaaacgtttttaaaggaaaacaaaatacactcattaaagagattaatagcaatggaagaaaatgaaaatagcgtacctataggtggacttgagtttgttttcattcacttaagtagcttcttattagagggtcagattggttttatattaatgtgaagagcgcaacaaacccattatatataatagatttatattatacaaagccactgatatattgtggtagattatatgaagctattctcatcattccccttctagacatacatacacacatgcttatatataataatcaaatgagttagttgacaaaaggttttaaagtccgaatttaattcatgaaggtatccattttcttggattaaaattctagtttctgatttttttacatttcaaaaacactatacctttttctaaattatgtatatttttctgtttgtaaggaaagtgtagagcttacaacagagacatagagaaaatattgactatactaaagttagcaactgatatatgttatagatgaactgtaacaaatatgtccttagtgaaatataaaatgatgttgttataataacgttagagttctagttagtactacattcaatttgtattcaatttgcgacaatttaaaagttattaacctatattctaaagttagtaaattattttacaacagtaatttcaacaatggaggctcccatgtgcccatgtatttggatacatttgtctgaaatcattttaatgagcaattaaaaaactcacaaaatagtctttctaatatttgctctcaaaacaactctgagaggtcaactgtttaatatgtttaatgtaatatctattatattctcaattttaccgttcttactaatgaattatgttatgattttattgcctttggaattgaaagcaagataaaatatgctttttgtgttttatacttacatacaacaaagttttgaagtattttttagctctgaaaaggaatgataacaatgactatttggaaataaaatatatcttctactatagaaaacataagcaaatacaacttgttaccaaggtatagtttctggtgtgtgtgtgtgtgtgtgtgtgtgtgtgtgtgtgtgtgaaagacagagtggtggtgtctatgacatactacggtatatttgagattataaactaacaaagcaactcaaacacttgacaacataagagtaaaagataactgaacatgagatgacaattggaaagttaaccttgaagtggtctggaaaattatattatttgctttgtttttgatttgtcaatggagaccaacataaattttccatgtaatggtaagtcattaaaaagtcataaaatatagtttaatagcattgcaattattattttaataaatgttacaattactataatttaaaatacttgcctgaaattaattctaatcatccaaaatacaacttctaatgaaattttcactcttgaatgtttactttaaatcacattgtcttccatatattcaatacttttgggagcaatgctgtggaatgtagaataaatatcagttgttgctattgaaaattgtgaactttaaaaaattttaataaagggataagattataactttttgcttatgatttgtaaaaaagaactgcagtaccctgttttacaaatatatgattgataacattatttggaaatgctatatataccaatcattttcaggtcatttgaaaatttcatgttttaccttaaaataagagaacaaatttaaagtgagccaactcaagtttattaagaaaaagtttgaggcagtttgtttttcagaataataataataatagtattatagtctcagattatgctttatgccaaactgtggtattgtcatctttggtttctggataagattttactgatgccttaggtattattttaataaatgtcataatttattataactgcttaatgcactcaaaattttgcaaagcttcttatactgtataattcagactaaaatttaacataattgtgatggtactttgaaaggcctacaatgttccatgaaagaagaatctgggggcaccaatcactgcattatctacaaacaatatgagtttttgtatcaataatttcacactttccccaaagaaagtcattttttcttgagtatcaacaaaattttatagtgttcatttagcttgcttgtcatttcaacattatgtattgtgtaccatcacaatagggggtgttgaagaagcccattacctactattcttgtcctccattgttcagagcataatgtagatagaaaatgataaaaacaataccttagattcctaagcatagggcatgatagtaatatcatagtagtgacattggaacccgcatgcaagtcattataaattcctgcccttatcatatacatcatacatgaaaatagaagagataatgagtgcaaataaagaagtggaactgagtggcattaatctcagtattgagagattttgtgagtagtacagcattcttttcatgtgctagctgaagttcccaatggcaaattgaatgctgcttatatcattatatgcatgaatgaatatgattgaaataatgcatatgttattatatcaaatccaatttcacgaatattatcaaccaactaaaaagtctaattgctgattagagaacttattatggaggttcttcttaatatgcttcaaattgacattgcatactggactatgtctcatttatgatttagggaacaaaatgtttgacagtgtgcacacacacagccatagtacacacatatgtctatatacatccataagtgcaaccaaatatatacaatatacaaaatgctatgcagtatatcagagccttctctgtgctcttcaaacttggaagaatggatagcaaagctcacataactctccaggaccacattttctcacttcctctaccttagtaaaacaattccacgcatggtccttgtctctgttgtacaatgttgtgtctccaaaacccagcacaaggcatgggacatgggaagcagtcagtggatcaccttagttcaagaatcctctgcttcagtcatgctttatggggccacaggtgttttgagaagatgctttagttatagctttaatgaagcaaagggtgcagcagagaaaagccaacatccttaccatgatcctaaggcagatgccctccctcacctacaactccttctccaaccatatatgccatcactgtccccatccctctctctagtgctgacgccactagcctctgcagctcttccaaataagcttatgcctcagtgacgttactgtacctggaaatcccttccacagatatctacatggcttattccctcacttcattcaaatctctctttatgaatcatcttattagagaaaacttccctgactacctacttaagtggtaccttccaatacctttttttatttattgaactttggtaagtttaagcatgtcttaaatatgtatttgcctattgtctgaaaaacacaagcacaataatgtaagctctaggagaggagtagtttgtcagaattgtactctgtcttactgcttagaattgagtgtagaaaatagaagttcctcaagaagtatctattaaaagaatgaataaattaagaagtgggtccctaacatccatgtcaagaaatttttggtgttgtttcattttgtttaacacaattgacttctaggtaaaatttcttttgtaataaattttctgtgtctaaaaatagtttgaatttttaaagtttgatttattaaaacctgtattacttggtagcacaaattctatgtatttttgatgatactgaggataattctatattaaataagcttacaaaagcaaaaggaaaatagtttgtaaaaccattctgacattcaaatactgacaaatctatttgcaaagataaatctaactttttgttgtagcagtagggtcttgataaaaatttatattattttgccagtaggctcatataaacctgaatctgatactttaaagcactttctccaaataaaattctacatagatctttgcacaaaagcatcaaagtcaagtggacagaatttagaagctgaaacaatgaaaacttctggctgaatgcaaactgggacgataatcagcactcttagggtgtgtgggcaaagagagagggaataaaaggatggagtacgcaaatggtaatcattctcctaatcaattctatcatatggagaaaaatagaaagacagacaaggaaatagcagaggctattgaagaccggccatatcttcatgaactcagagaaagagcagagttatgcaaggaatggccctccaacatgccatagcctgcacactagtgaatttgctatattctatgtcatggatactgataaatccaattgacaactcctctttctatatgaaggaatgagaaaaaggagttgttttttgcactgtgatgaatatgcactcgatatgtaaattaacccaatgattaatacaaagcagggagtagtagacgcttaaagaatagggaggcttagtattcctatgggaatacagacaaagagactttgacttttctagggttatatggaaagatttcaaagagaaagtgagatttgaggtagacagtgaaagttgggcacaatttgaattgcccagcgtccaggaaggcattttaagatgaggaaatattatgaactctagaggagaaatagtcaaagaacccatgagtatgtaagattggctggactatatttttcccaccgtttatttcagtttttttctatgtcatgtattgtatttagttataattaactattcaattctctcttatatatttgtcaatataaatatttgtttaacatacatttaaatataattattctaaggggctgtattttagattatgtttatgtttatacattagcttagaaaaatactgaaatccacaaaaaatagtatattttaagtaaaaggaaattaaaaccatataaaatgtcttattgttaaacttatgaaatactagaacagttacaaagaaacaattaaaatgatttgttagaaaacatcagtgacagaaataacatatgctgtctggtagaaactttacctccaaacagctattttcatatcgtactttcgtatttccttaggagacataataggttttaaactatgccttattactacgttgtgaagttgggaaaaaagaaaatagactgtgtatgtaactatagcactttaataaaacatagtgtaagtatttgtctaatttaataatgccaattaactgaaaacagtttctagtcaatttgtctgcctctggtatagcaaaaaaaaaaaaaaaaaaaaaaaaaaatctaagaaactatcatatgtgtttttaaaataaagtttatattttatgttaaaagagggaaaaaacaaaatgctacaaagcatttatttttattgatcttgagatctgagcaaatttatactttatgggaatcccagtagggaaaatagaaggacatctaaagttcatttcctcaaggtgggggaagtcttcttaatttgtcttgcattatatttattcacatactcatcagctatttattaattcatacatgtatttgttcattcattcagtttagtctaaactttgactccttttcacctggccctgtccttggtctaactcgggcatgacactttccaatttcttctgcaatacctactgcctgcctacctcattctgcctttctcattagatccgaattaggacctcagaagctcactaacctgcaggatatagacagtctgaattttggatctagcaatcgtgtaatttagatcttgtttaatggtccatgctacctatgctttcaatctcagactgattttctgataaatcaagttaaaattaaacaagtttgacaaattaagttagactgtatcttttatttccaaattcagctccctaaatactcattcataaactaatataccactattcatatttccatttttagctttctggcttctgcctgagcctagaatcctaaactcggacaattgtagctttgtccacttggccgatatttaatttctcaattaagtatatatttggcactgtgatgaagggactgtactgggatctgcacacattttcaaaaggtatgcatgcctttaattcctaagggcttaaattctaataaatggcataaaagcaatacataacagaaaaactatataattataaaatataaaatatatatatacatatttatattataaaaatataaaattttaatataaatataaaaataatagtgtaaatataaacatatttgtataaatgttatatatttataaaatagataaaatgtaattagagtgcgttataacaaactttgttgagtggaaggagataatgtattttaaatacatacatcttatacttgcaaaaactaaccagctgaagtgggagaaaaaagggattgaaaatctggggatctgaaatgattgtactgtaagatagataaataattagtgagataactgcctaaactgttccaagagagtgtttttaacccctttaaataaaccaagattattcatacaaatgcatgctatgagcacttgataaagctaacagacagaaagtcagtaaagatatagaacttgaacagcactatcagccaaatttccctaatggagatttatagtatactccacccaacaacagtagaatatactttcttcttaagtatacgtggagcatcatcgagatagactgtatcttgggccataaaacaagatcaataaaattaagatgatttaaatcttacagagtatgtttcctgaacaaaactgaattaaattagaaatcgataaagatatctggaaagtctccaggtgcttttaaattaaacaacacattttaaatagctcaaaggttaaagaggaattcacaggagaattagaaataatctgaccagaatgaaagcataacatatcaaaatttgtgggatagtgttcagcaaggttacagaattcaaagtcaacacacagaaatcagtcttgtttctatatactagccatgcacaattgtaccaacattttagatttttttaaattaaaaaaaaaaacattcaaaatagctcccaaaatataaatacacaggtataactctaacaagacatacaggatctgtatgttgaaaactacaaaacacttaagaaatctgagaagacctcaaaacatgaaagacatacagggtttgtggtttgcaagtcacaatatggttaaagatgaaaattctccccaaattaacaagtagattcaatgtaattcctatcaaaatttcagcagtatttttgtagagatggacaaatagttcagttgtgtagaatgtggagttctactattgcagctatggaagtaggcagtgcaaggctgtgcagctaacaggccggagtttcaaggctttgaactggatctaggtttgtgctgggtcaggttgtgggatagtgtcatatgatgaaactgttctgcaatagatttaatatcaacagggaaaatatgtattctacaatggattgagactgctaggacaataagaatgattctccaattagttactgcttgttttgtgggccctgactctgtagcttgggcctggacaacactaagaacacagtatccatctttctgccttttcatttatcaagagtgagttccctaatgtttacttgcctatgatcacccttcattctatatccccattgtctgccatacagaacataaaactaactcagtttgcggaatggaaaagcaagtgccagttgcattatatctacatttatgtctacgtttgcattatcacatggtgcgttatcatggggttttcctgcttttatttttcaatttctcttgcttctaaagctctaatttgatcaatccatttgagcatgcccttactaaaaatacctattccttatgacccaaccagtcctcatggcttcaggatagaccacagccaggaacagtcatatctgaaccactatatttacgtaagatatgacttctagtggaaacaatttctgatggaataatcaaaattctacttccttaataggcaaataaagagttaatactattaatatttagccagcattttgaaaattgtataatgttcaaatcgatgtcagacattttcattttatcttgattatacataaatatagggagtatatatgatttgcctgtagttatgtaaatgacagaaatggttaatgagcccagagtccaagcctagtattctttttatgaaaccttaggaagtacaatgttattaaatagtcatagcagtatatagtgttcatattgcaaaaaaataaaaattgccttgattttagaatagccactaattttatatcatatttgcattgatttcaataatttatatattattcctgagtgatttcagaaaggatctgacatggggtgatctttatgtctactagaaaggtgtccaatctaaactgagtaccttcccctttgacatttctacatctttatttgttgcttcaaaataagggtaattagaaatgtatgtggttacaaatggcagattatataaaaataatatccctagaaatgtgttttatatttacctttgaatattaacatatctaaatatgggtgctaaacttcccttagctaaaatactagagttgtattattgtggagaaagactgtattagagctaagaaattaatcacttttttgcaatacacgtgattcttaaacaatgcaatggttaggggaaccaactgcccacacagtcagaaatctgagtataacttttgacattcccaaaccttagctactaaatgcctactgttgactggaagctttactgataagataattgacacaaataactgataagttaattgacacaaatgtatattacatgtattatatactctgttcttataataaagtaagctagagaaaagaaaaatgttactaagaaaattataaggaagagacaatatatttactattcattaagtggaaggggatcatcctaaaggtcttcatccttgttatcttcacgttgagtaggctgaggaagacgaggaacaggaggagatggtcttgttgtcttaggggtggctgaggaggaggaaaatctatgtataagtggactcatgtagtttaaacccatgttgttaaggttccagtgtatgtttgctcaatatctctaagaagccactgaaaaaagtgccccatatggaatttgtaaaacagctgtggaattttgccgcttgaaccactttgtttcctcacatgaacttgactgatggaaacagcaacagcagtagcttacagggatggcagcaggtataggtctccccagtttcttccttctccaaatccacttatttttttttcttttttttattattatactttaagttctgaggtacatgtgcagaacgtgcaggtttgctacgtaggtatacacgtgccatggtggtttgctcacccatcaacccatcatctacattaggtatgtctcctaatgctatctctcccctagcccccactccccgtcaggccctggtgtgtgatgttcccctccctgtgtccatgtgttcccattgttcaactcccacttatgagtgagaacatgtggtgtttggttttctgttcctgtattactttgttaaaaatgatggtttccagcttcatccacatttctgcaaagggcatgaactcattcctttttatggctgcatagtactccatggtgtatatgtgccacattttctttattcagtctatcactgatgggcatttgggttggttctaagtctttgctattgtgaacagtgctgcaataaacatgtgtacatgtgtctttatagtaaaatataaatccactattttatggtttggcatcctcacattccatttattcatctgaatccatgttttccattccctggtgctcctggacccccgcacttgtcccacgctgcatttctaccttgtcctgatgctctgactgctagggatgaggcaatcatgagtcatgtacctacttagagccagtctgtattttagactgatttaaaaggagagcaataattaatgcaaaattgcctttcctgggacttttaatgggtggatttccaagtctttaccaagcaacacactgagctgtaagaagaaatggcaaagtcagtgtgataattaatctagtggttcaccactctcaaggggacattttgacaattgagagtttatttatttatttatttatttatttatttattcttgtttcagtgattcacgggcactgctgtcatgtagtgggtgcagccaggtaggccaagcatgttgctgcgagtagggcagtcctgcataatgaagacttgttttgtgtcacatcggacttcaaaatgccccatgcatactcataaagaaagaaaaagcctgttaatatattttacaatttttcttacattttattttcaaattttaatttttagcctaaaacccaagtccactttgaaaataaacacaaagccccgtttataaagttttactacatactgttttccaggaatgcaactactatttgaaccaaggtgatattttactgaattttaccagaaccttaccgagaattgtttagcgttgcagaaactcttctccgtgacagtaatgccacttgaatttgaatttcctagacagtacaccttaactgtttgcatttatggtcgtcacagctataatgaatgattccatatgtaggtatgagtcactgactccatcattatgtctcttggtgtagttgggcctgagcatatattttgaaaaacacattttttgatatatattactgactacattttttacattaaagttaggttaatatatccatttttaaaattattatctgttaatttcattttgatatagtagatgggactttaaacatatttgttttctaaaggaacattctttaaatttgatgatttttttaaatcatagaattaaggattactgtttgaagaaattaagcagactagtaccgaataataggtgcaaaaattgcataataagttatttagctgaacaaaatacatgctaattacaaaagcctgatgattggtttgtaataactgacacacttatatgcatcagtcgatatttctatcatgtgtaaattgtgctacatacagatgataaaacaaagtcatataaaagttggccttataatacagatgtctaataggcatataagtcatccttaccaactttcagcctgctgaccagtcgtgtaatgaaaatggatggcacctgaatgagaaaacaattatgtggctatctgaaggagggtggtcataccaaaaggatgaacaaaatacttcaagcaaaactaacagcaacataacgagctaagaagtgacaggcacaaacacaagtggatcatgttgacttgaagcaagcagagtttgagctgtttcactgtctcattgaaacagaagagtatgctcagcgtgaaactaagagacagcttacagagaatgacaccctgcaggtagcagctgctgctgacacccaacgggcagaatatagagaaggtatatttgtttatttatgcaatttgtgaggaattgattgcctgacataattcacccttttcagacccatgcttataactaggaagcatcaaggtcaatatcccagtcacacagtgcaaaatattttgccatatgtacaggattgaatgtaatggcagaagtcatttcaacaggactgctgtcaatatatcatttgcatatgtacaaataatttgttaactatggttgttcttaacatattcacaagtaaaccccctaaggcataattacaatagcactgcctattcaatccctatttttgttctggaaattatacctacattgagcctagttctaggttcaggccaaaaaacaagggatatgcaactttaaggggaagaaatactgactccataaatatccatatagctttttaagaaagatttgcttaataggaaaacggtgttttctcacgtaaaattcaggttttgtttaacaaacatattgaatccaaagataaagtatagtataaagtaataggatgtgcttctgtattgaaatactggtagttttaaattcttgacatgaataactggatatggcatatgtaaatctaccaagaaataaaacagaggtcttaaaatgtaaagacatgataggacatatttatcaccccataaaacaaactggcattttcatatcctaagctggccactttgttgtatttgtgtatgggtcctcactacaaagttctgtccctgatttgggaacatcacacatgagaggtaaaaagcacatggtagatgagggatacaaataccattctgtttatgattctaacagatcgatttgtgatacaaaaaccatgggtagaatttgagaataattagtgtgatacgatgttataaatacaaaggaagtatgtgtgtgatttttttttcaaacttggttttctatttcttacagacagtagttttctttgaaagtattaattagttcactgtttgtgtgattttatgggcaggaggagtgactatccattgtgatggcagtaaaaggtaacgtgccctaatgtagttcatagtaatgacgagggacacatgccaggtgacatattttaatgaaatgttaaatgaattaccaagaaaaaagggaacttaattttcaatatgaaaggaagaggccattgaataaataaagtggaggtgagataacagattctcaaaggattcttaaaaatctgccatgttatatcattctggtcaacagaatgattcatatttcattaactgattatagataaaatattagatcctgttacaagttatgtgtcttacagttcagttattattcacataggtatttcagagggagaaaatgattttccatcctttttttttttttttttacaacattaggggaaaataattactattaaaccttctgtttccattcactggatctgagatgaagtggatttccttacatattcatgactgctttggttaaataccatctattctgaattttattctccatattacagctataatataaaggaaataaatatgctttccttaaatgtatcaatggagcaaaaattgtttttataataaagaacaaatccaaagacaggcaattcagttaatcatataatttaaaggttattgcaaggtcttggataaccctgaatatttatttttccaccagctcactatcttatttgcatcttttcttatgtgttctaagatccctgcaactggaataatttctcttgataaaagaataaagaaaagatttaattatggtatttattattgtattttgaaggtaaatattaaaaatatgctttgatggaatgggctcaagagaaatgggaatgaggatgctagttgagaagacttctcatgcgtcctcctcatttcataagcatagattaattaaattaactagttgctcaccaaagcctgacataagaatgatgaggtgcagaagccactaagttttaatgtgtgttaaaaacagcagcaaaaactgttaggggcttagtgagtatcatggactatctgcaggtgggtttccatggaggaggagcccaggggagccccaaggaagtataaggcggggtggggctcaggaaaagcagatttaaagcttgagagcaccatgctgtgctgatattatagcagagaaaaaaactgattttacctttcctaactcctttctcttcttgccatgaatagcatatatggaattacttttaaatatgtgatgaatacatgtatatccgtgacacatgagtctctgcctgcaaatcagttatgtaagaaatatggcatttccttgtttactagaagtcaagctaatttagacatgactctctttcttatatgtctagctagaaattctaccttagtcattcttagggcatctcttccctatggtggtgccaagttcctggagccttattctacattagtcatcaggagcccttcctagttgttggtcatctgcccactgctgaaataaatgttcagtgtcccagcttcatggtaatgtgccttactttgttgttatacatggaccatctttggatgaagggtgaaacttaggactaggatccagcctctcagatgaatcctgtggtgtttccctctgagatctggctaccttttccaggcaatgcaatagaatgatactaaattctttccttctcacagagcctgacaagcatacatacccctttcctactccaagggaatctacctcactctttctccttgtccttgaaagcttccctaaagccttctcttctttcagagataactagcatgagcttagagtttcataaaagatgagaaacacttctgactccaggtagtttctggtctctgtccatccaatattccagaggcaaggaattacaaagcctgtttccctgcttcactggaaaaaatagggggaaatcaccaggagtataaatgcaaattagtatttcaataaattatactaccattgaggaagaatctcacacatttatgtcaccaggaatactgataatgaaggaattaattccaaaatacaattttaaagcagatacctaatggctaagttctgacaaagagtatagatctgatttgtgcattatgcatgtaactatttcagagacatggaaattaaatcatatttaagacatatttgatgtattatatttactgaaaataataaaattctgtaaaatcaggactgtcaggaaaagtcagaatgtagccactgtactcagttatagaataaaagcagatatatcttggccattgaatcacagtgccttaaaataagatagtaaagtaatgaggaagctctcctactaatgctattctttttttttttttttttttttgagatggagtctctccctgtcactcaggctggagtgcaatggcgcgatctctgctcactgcaacctctgcctctcaggttcaagcgattctcctgcctcagcctcccaagtagctgagattacaggcatgtgccactgggccaggctaattttttgtgtctttagtagagacggggtttcaccatgttggccaggctggtctcgaactcctgacctcgtgatctgcccacctcggcctcccaaagtgctgggattacaggtgtgagccgccgcacccggccctactaatgctattattctaaactaattgccctttctaggtttgcctgcctggattgtgttttttaaatattttttcttatatgttatattcttgttagatggctagaatgctctagggtctggaaagagggacaacatcctttgggtaaatggaaaagttgaactaattgagaaaaatattctgtgtttaaattatgtttgccatttttagtattttcatttttagggactacatatgctgacttaggaagttcaagctaggtttaattttcttcctttgatagcttcacataacccacactttccctccaaatattcctcatctttcacctttgcttatagttgttatagaatttattaaagagtaagaagaaaagaaaataatagacataccaggggctcaggaataatactatatagaaaattacatactgttggcctttagtttttgaacatgattaaatgtgaaatattgctataaaacttttattcagctcagaagggttcggcctacataacagaaagtgggagataatggggaactaattttccaaaaacaaatttcttattttatcattttgtataaagtcatttctgacatatcatggcagcaaaaacatgataaataaagtcaacagtaatgttgtgtacttgatctactgtggcaaaactgaaggtcccctgttagtcctaatatattttcccactttctttttaacagtgaattatatcctcattcaaacattaaaaaatactcttttgctgacattttaaagaagaggtgtccaatcttttggcttccccaggccacattgaaagaagaagaattgtcttgggccacacataaaatacactagtgatagctgatgaggttataaaaaaattgccagtctcataatgttttaaaaaactttagtaatttatgttggaccacattcagagtcattctgggctgcatgcagcccatgggccatgggttggacaagcttgttttgtaacaacacagtggaaaaatggaacccttacattgataccatcaagaatggtaagcaaggtatacacatttaatactcttaaggagcttacattcttgagaacaagagtgtgaattaaagtcagaaatttcagttaactaaattatactgttagatgagaaaataaaaactaaaatactggaagtttctatagtctttactgggcaatcaattattgtgccctttttgttgatcatgtgattaaggtaattaaaatccacgtaaatctcagcaagtatatttttaaacaatagattcaaaatttcaagatgaattccaaagggaaggatactgcattgagggttaaatactgggaagtgatatggtttggctttgtgtccccacccaaatctcatcttgaattgtactcccataattcccatgtgttctgggaggaccaggtgggagataatttgaatcatgggggtggtttcccccatactgttctcatggtagtgaataagtctcacgagatctgatggttttatcaagggttttccacttttacatcttcctcattttctcttgctgcctccataagaagtgcctttcacctcctgccatgattctgaggcctccccagccatgcagaactctaagtccaataaacctttttttcttcccattcttgggtatgtctttatcagcagcatggaaacagactagtagagtaaactggtaccagtagagtgggatgttgctgaaaagttacctgaaaatgtggcagcaactttggaactggttaacaggcagaggttggaacagattgaagacaggaaaatgtgggaaagtttggaactttctatagactagttgaatggctttgaccaaaagcttgatagtgatatggacactaaggtccaggctgaggtggtctcagatggagatgaggaacttgttggaaattggagaaaggtgactcttgttatgttttagcaaagagactggtggcattttgcccctgccctagggatttgtggaactttgaacttgagagagatgatttagggtatctggtgcaagaaatttctaagcagtaaaactcaagcgatgacttgggtgctgttaaaggcattcagttttataagggaagcagagcatgaaaaattcagaaaatttgcagcctgacaatgtgataaaaaagaaaaacccattttctgaggagaaattcaagccagctgcagaaatttgcataagtaacaacgaggggaatgttaatccccaagacaatggggaaaatgtctccagggcatgtcagaggtcttcacggcagcccctcccatcacaggctaggaggcttaggagaaaatggtttcatgtgcctggcccaggatccccatgttgtatgcagcctaaggactttttgccctgcatcccagatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcagggtgctcatgaagaacctctgctagggcagtgtggaagagaaatgtgtggctggagcccccatacacagtccttactggggcactgcctagtggggctgtgagaagagggccaccgtcttccagaccctagaatggtagatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatgtgagacttggagtcaaaggacattattttggagctttaaaatttgactgcctcactggatttcagacttgcatgggccctgtaaccactttgtttgtgccaatttctcccatttggaagggctgtatttacccaatacctgtacccctattgtatctaggaagtaactagcttgcttttgattttacaggctcataggtggaagggatttgccttgtctcagatgagactttggactgtggacttttgagttaatgctgaaatgagttaagactttgggggactgttgggaaggcataattggttttcaaatgtgaggacatgagatttggaggggccaggggtagaatgatatggtttggctctgtgtccccacccacatctcatcttgaattgtactcccataatttctacttgttgtgggtgggacccagtgggagatcatttgaattatcagagcggtttcccccacactgttctcagggtactgaataagtctcacgagttctgacggttttatcaggggtttccgcttttgcatcatcctcattttctgttgctgcctttcactcctgggccattattttgagggctcccctaccatatggaactgtaagtccaatgaaacctctttttcttcacagtcttgagtatgtctttatcagcagcatgaaaacagactaatataggaagtaatggtgtctcttcagagaacacgaagatttgtcgtttcattaaaaataaatatttattgagtacccactctgggctagctatgtacaactgttaagtgatggattgtgacatataaggccagagtcctcatggagtgtttaactctacacagggctgacaagtgtaagagggaacaagaacataaataaataagctaaattcagctagtgattggtgctaaaaaggaaataaacaggataatgtgatagtgatgtgtgttgtgggtccattcgggtttctagctctttatggtcagaagatactgagctttgaaggcaagctctgcgcatgaggaaacaggtgggttaaatagattttttttttctctgacaatcaagcccctggataacctaagcgttttcgccttcatttcagccaggctttttctcctttattctatgcttgctgggccctttactctctaatagccaaactactagagctagagatcttgcctttgtcattaacttttcctgttcccaatatctgctttctaagatctctttcaggaggtagatatggaaaggaaaacagacataaaatttgaatgtatcattgtggctacatgtgaacatattgcattaaattaattgatagaaagaagtttgaataaaatattttagaagaggtttttgaatttagagtttatgaggttatacttctttatcaacttacagttaacaatgaagttattcccaagcatctttaaagctaatttatttccttttgtgtttaaagttttttgaaggaaatatatgcctcaaaacaattctgttgaccttttctatctatctatttatctataaaacaaaacattaaatggttccttgatggttttaagtcatggaatttttagaagctaaaagtgatttaactgcagaacattaaaaaacagcactgtatgattgaaactatgagctttcattctttcttacccaggtctggggttcaggcacatgaaggattgactttcatagttccacatcataaggcacagattgtaaagtatatgtaaccattttacttagtctattaactttcagaaacccaaaccaagagaatcactcagcaatgtgacatttcacttttagctcttactgtcctttataatattcaggtaaaataatattttaaactagtttagactgtggcacatgcagtacataccttgatggtacggatgacaggcatcaaacctaaactctgtaaaaaatctgtgtaaataactcttattttactttacactgaaagtaaagtaaaataaggactcaatggtaaactatttctttattaatacacacattcttattttacatttcagagtaaagtaagagtttgtgcgtattagtccgttttcatgctgatgataaagacatacttgagactgggcaatttataaagaaaaagaggtttaatggactcacagttccatgtgtctgaggaggcttcacaattgtggctgaatgtgaaaggcacagcttgcatggtggcagacaagagagaatgagagccgagcgaaaggggtttccccttataaaaccatcagatgtcttgagacttattcactaccaagagaacagtatgggggaaactatctccctgattcaatcatctcccactaggtccctccacgacatgtgggaattatgggaactccaattcaagatgagatttgggtggggacacagccaaaccatatatttgtgtattaataaagaaatagtttactattgcatccttaagaattgaggcacttacatatagctcacattcattcttactcttctgagtctcagtatcaaatgggctggattaaaaataaataaaaaacaaaacaataaataaggcaaggggaactcaagtgaacacatggataaaatgattagataataaatggaattattcgagaaatattttaaaaattagtgtaattataaaaggtaaataaattctagataaacactgtattaatcagggttctccagtgaaacagaaccaataggagaaagagagagagagagatagatgcaattatggaggcaggaagtcccacgatgtgctgtctgcaagctggaggcacaggaaagccagtggtacagttccagtccaaacctgaaggtctgtgaaccaaggcagtcagtgctctaagtcctggtccaagttcaaaggcctgagaaccaggagctctgatatccgacagcaggagaatatggatgtcccagattgagcaaagagcaaactcaccattttagttatatttatgccctcaatggattgaatggtgccctcttacattggcgagggacatctcctttactcagtctactgatccaaatgttaatctcttctagaaacaccttcacagacatacccagcagtaacattttaccatctggacatacttatcctggtcaagttgacacataaaattatcgcattgagaatattaggcatccaatagtggtgtgcttgcaagcccactctcagaataataaaggcctcgatatgtagcatttgacaacttccgtagtgtaaataccctcaccataacacatttcagaggatcaacctgaagttgctgaatgtgaagttgggaagcaatgtataccattttcccgtgtgaaccagtacgagtcaactgcagtgtaccactgtattagaccagttaatatatttaaaaatgtttctaatccacagaaatggacttatctgacactgtgggagatcggttaatataaattaattttctagatagtggccatttcacctgtaagcaaatagtgtctatttattaaagataatttctatacaatgtatatgttttctgcctatagagcataatttcatcaattcttgatgatctaagttcctcagttgatattaatcttatgtgaacaatcaggaaggtagtataatggttaaaagaacatagtcttaaaccaactgtttgggataaaatcctgcctctactattgtgtaatgttgagtgttactcaggttccttctacctcagtttccttctctgttaattggggaaattataagtgttgttagttcttgttattcaaggcagttatattctataaagtcaccacaaacactgaattagtaaatactggattattgttttgaggggaaatacaggggttaatttcctggaagctgattcatcaaccaatcaatacctgcattgttttgtgtatgttcctatttaaagataatttatttaatatatatagttgaatcattaacatggaccacatagacaacagcactatcacttgtgtgtgaacaaagcttactgacaaatgtacgttctctctaagacacatcacagcctttttgcatttaggatcactagacagcacatagcgctacagccaagggctgttttaaatagggaaatcaccaacaaaaaatcacagaagcatgaaaaacatggcaataaatagactgttaaagccaccctgtttatagtatgagagttgaaacacaaaggtagggctttgcctagtttcaacacaaatgggaacatgcacatcaggtgactcaaatttttcaagcttctgcccatgcctgtgtctacaaatgagcaaaaagggctgtgagtataatttgggagttactgtcaaagatcaacaaagctggacactagttaaagtggtaagatcaggtggtaatcagtaatatactgctgcagaagggaagagggtctggcgtgacctgaattcaacttagatttgtacaaggaggactgggcattttaaagagagaattgtagaatagggagaagggtgagcagggactcagtagagtcagggtagcaaaaaattacaaagtgttggtcactgtaaatgattcaatcctccagcagagacggggaggcaagctgttcctcctgatatttacattttaagagaatggctttcaggtcctttgagaaacatactccttaattgtaggagacacataggtatctcaaagggataaaggaaggatccacaattgtaagacctttgtagtaaatgctctaaaaaaggtgtcggggcttatcatcaggtgtgggctagagtagtcgattcttttggcagccctaaaaaaggtgtccgcggcttatcatcaggtgtgggctggagtagtcaattcttttggcagccatgagcttccccaggcaggatcttaaatggggctgggtcatcctagggatgcaggcttgatctagtgcttattcaagtcttttcataggagggtgggagaatttcatgttcgctgacagcctgtagattttataggccaagcatgagacctagtcagggagttccgaggagcctggctagcatttgagcaaagagagaatatttgtgattacaaatatattttattaaataggcaaattcgcaaatatgaaatcacaaataatgagggtcgaccgtattttcacattgttgttatttaattatgtaaattgcttagaacactaagcactcaataaatgtctgcttaaattataatgtaagatgtaggaagtgttgagttataaagctgtttgttttgatctttatcagcctgcctcaggttgctattttaatatttggtcttctttttgttttatattttcggttttccagtttactgccaagcttccactttttctcactgttagtttgtgctactctggccttttaaccccagccctcctgcacccatattctttgcgaaaatgtttcagttgactatttaacaaggctgagtgaggacttgaaggcactctgagttgctagctctactatgatcattttatttgttcaccttttgcttttagacccaagatcctgcccgtgttccaggtacttgaggttgttaggggtctgccttttatgtgaggtggatttttatgaccatttgggaacaatgttcaatttattagtatatttttatcatcgagggttttggccaagaacttcttttgtttaggagctgtggcctggccatgatccaacctggctgagatgctcagaccacgtgattttcatacagacacagactgtggtgaatcttatggtagagcttgcggcagactccatggtagattttatttagatctcacgtctccactgaataaccaactgaatttcatggctacaaagaaaggaactatcacatgatgaattattttatattatttttgacaatataaaacaaataaatgttttcattataaaagtattcttgacttttgaagtaaaatttgggtgtcactcgaggactttgcctggctaaggtgcaaaattcttgtgaattttaaaaatagcttatatataaacctttacagaaaactaggaggtgaggaaaatccctcatgaacttggatgttatgaattgcagtctagggatttaaataggtttcacttatgttcatgttggattgttagagtaggtatttcatgaataattttatctcagataaactcatgatagattttatcattttattttggttcaattatataaatgctatttaaaatccagctcttactaagggttaatatggtaatgaattctagtattccctttgaaaacacggatagatattttttaatctttttttcatgttcacttaaaaaatatcttgctactgtctttatatcaatgtttcataattctattagccacattttgttgacctgcatattcctacaagcctgaattttaagttacaactttgtattcaatattagtagtattaaaacaaacatatcaaaggaaataaaaaccctaaaatttaatgtttcacaaaggaactctgtgttaaaacagtgtccttttagagttaacatatgtatgggagatgcattttaaataaagatgtatctgacctggaagagtagacaaatctgctttacagcaagttgaaagtttagagaaatatttatcattcagttaccaaaataacaaattaaagcagcaaggaaagagaaaagagaggagatgaaaggaaataaaggaaaaccaagacgtaagttaagaaagagctattgcttgtgaacttcttcctaaaaaatgatagaaaaaaaagataagaaacagaaaattgcatgagacttcagtgtttatgttttgatggaaatgtacaaatcattttcattctttgcagtgctgtcatgctccatcactttagtccattttcaccttccaaagaaattctgaatgggccttccttctctggcagctaattaatctttcacaagcctactcttgcagcctgtctgccagggatgccccacaccttaagccagtgactcacgagcagatttcttaccctcttgagcagtactttcttcccttgagctatgtgaagacctagcttttctattttgtttcggaaactatgtgagctgtaatatatcattgaagaattgctccttcccccccaccaccataagtgaatataaagtgttcctgaatcatttaattgggtaataatgacaacaaagtctgaatataaattatgaatgtgtacagcattttaccaatagtgtatatcatatagatgtaaggacacatattactagattataaattctctgtgtatatacatttgttagattatcattgtaataacacaaatgtacttatatttataataatgttgcatttgcctaaaaatactaataaaactgcaaataaaaataatttttagtctaattaatggaagatttggtatatgaatttttttttaagttagagcataattctttacagattgaaatgcctcagttaaaacaaaacaatatggccagggatggtggctcgtgcctgcaatcccagcattttgggaggccaaagctggaagatttcttgaggccacaagtttgagaccagcctggacaatatagcaagactctatctctacaaaaaaaaaaaatgtgtgaaattaaaaagtttggtatacattctttttgtatgcaaatgtttccatctgttgtcatttcaatttaatctgaataacttcttttcagcctttctggtagaaaacatctgctgtcaatgactttatcaggttttatttatctaaaaaatgttttattctcgttattgaaggaattctgggctgaatattgaattttcagccctcaaaaaagtgatctgcctccattatttctgttaaaatgtcagttgctatttgtataattgctctgcacattatgtttatctgtggctgctttagagattttgttttatgttttgcttttgacagttgactattatatacttaggtgcattctttctgttgttaagcatgtttggattttgctgagctttttcaatcttgatatgaatattgataggaatgttgacatgaaaaatatcaatgttgatagttttcattaaattgcagaagattttagccatcatttctgcaaaaatatttctacctcatctccctccctccttctcttcacccctctctgataacacaattatacttatgttagaccttgtaatatttttctactgattattgagactgtaatccatggtttttcaatattttttctgttcttcaaatcagataatttctattaatctcttttcattctcactactattttttccttcagtacccaatctgatattttgctcacccagctaacattttaatttcacatttacttatccattcttacatagacctctttttttatggtttgcagttaccttctgagattctctatctgtgcacccattataactatatgtttctttaaatctttgaacataataataataaatcatttgtagtcttggtctttgatttccaatgtttgattcagagtctgttctgttctatgtatttttttatttttcttgtgtatggattacatttttacctttccacttatgtacatatgtagcatttaaaaaaaaaaattacatgctggggctgggtgtagtggctcacgcctgtaatcccagcactttgggaggccaaagtgggtggattacttgaggtcaggagttcgacaccagcctggccgacatggtgaaaccctgtctccactaaaaatacaaaaatcagcctggtgtgctggcacaggcctgtagccccagctactccagaggctgaggtaggagaatcgcttgaaccggggagacagaggttgcagtgagccaagatcgtgccactgcactccagcctgggcaacagagcaagactccatctcaaaaaaaaaaaaaaaatacatgctagatgttgttaatgactaatttggagaaatctatattaggttttctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaacagcaaaccatacttagcgttactttgccttactgttagcatcttcttataatttctacttttgcaataacatatatacatacatgcatatatatacatacacatattatattatatatacacacacacacagaaaccatgtgtatatttttattagtttagaactaataaaaatgtcataaagttagtctaggaaaattcaatggaaaaatcaatagcttcttctttgctgacaaaacaaaaacaaaagttaaaagtgcaaattaacaatatcaacaaaaatatcctatacacataaagatgtttgtgtaatgtgaaagaataaatctgcataataacagtgaagtgtgtaaataagtatggacacacgtataaggatatgccaggttctttcattgaaagagacacatttctttataaactaatatataggtttaatgaaattccaaggagatcctaataatgtttctgctttgagtgtatttggtaaataaagttattctaacctttatatctccttagataatagcaattgataaataaagctggagggaaaagattcatgagaaagactagcctaccggttattaatctataaatttactatacagtaaatattgtagaactgaagaaagattgataacccaatcaatgaaatagaagttagagcccttaaacagactcttaattatgtactatacaatataaaatcctttatttaaaaagggaactcttcttgagacttcttcagtaaatcaaagtcatcatttttttcccttcagcctttccccattttgacttgctgattctcaaatccctttctatctaaatcttgtatatcttttgactttgtatatctaaagtttcatctgtttcaaagaaactttattccactgtttgatgagattttatttttagatttttttcattatcacacaagtaaaacactattcagtgtaggaaagagtagactttaaaagtacttagaaacacacccttaaaataagtaatgataaaatattagtatgataacctttccaatttttgtatgctatagataagatgtacattcaaacccttctattcataataatagcatactataaatattatagaagttaattcttctttactgaacagcataacttgaaaattattttaaatattattgtataagcattctcattcttattatcaatgtattatacatatattatagttaatgatatagatgtatcactgtttgcttggacagtcttttcctatgaatatttggatggtttctaagtaattgatcttctaaacaagaatgcagaaacatccttgcaggtttattttttcacatttgtcagttcttttcattgagatacatttataggtggtaaaatttgcatttttaaaaagcatttaaatcatattgataaaggatctataagatgttgacaattcctagctatatactctttccagcaatccatctgtgtccactttcccccattcttaccacttaagttttagaagttagagaagataaaattatcctgtcactgttttagtatataagttttaggacagttaaaatgttttatgttatcattaagcataaggctaccattgacattaatttctatatctgtaattcatatttacattatttgacacaggattttggacagtctttttcaaattagtatggttatctggtttatttgttttgacattcaaactagttgaacattttttctgtttgtcttggaaaattgagtgcttcttggaatgtatcgtgattgtcttaaaggtataatatatgactaagtgtgttattttagctaactaattaaaatatatatttgtaaaatgagcctttattttccctaccatcttcttaactgttttctggaacttttggcatctaggatttgcaacacacatttttatgatgtgtgagattgtggggagctagcatactactgtgcctaaattactttacttgggtccccaattacactgaactagccatgccttttccgtattttctgtattccctggaatttgtgtatctgattataggaaaatggtggtgagtttgtgatgaaatgacatagaataacaaggagtagaactagtctattgtacttcttagataggctcatagagtttgaatcacactgctgtcaatgtcttagttcctaaaagccacagaactcaggatcacttggcagatagatgatggagccttttcacaattcttgactacttcatgaagcaaagctatggcttgactgaatagaattctcaactgaatagaattctcaactcagccaaattgggaatttgtttgtctgttggtattttttaatgtgtttgcatgctttagtctctggttgtatctttgtggatgatacatatatcctaatacttagttataatttcataacaaatgcctcaacccaagattttaattttacatgcatttgataaaattttaaaggatatttaagagtattattaaataagaatcttctgtatttctgatatattaacattgaaatcacttgatgtgaaatcttgaataattttactatttactatagtatctgtgaaaaaaatcatttttgttaaaaatgtatgtatgtgtgtatatatttgtgtgtgtgtgcacgcatgtgtatgtgttgaatgattttattgcattcaatactatatttggcccaaatctttactattgaatgtaatacaatcaatcattcaacacgtaagtactgaatgcctaacgtgtagcagggactattctatggatacaatttttttttaaagactaaagtctctgcctttggggagacttttagtagaaggagaaagataaaataagaaaaataatgagtatgttagatgacacatgttgtggagaagaaatcaggaatcagggaaataatgtaagaaatcttttgctggtggggaaaaatgatgttgtgattctaattaagatacagctagaaccaaggtctaaataaggtttggtggggagccttcccaatatctgggggaagagtgttccagagagagaaaactgcaagtacaaaaactcaggagtagtaatgtgcctggtatgtgtttgaggatcaagcaaggagcagcaggagtggatgagtgaggaaagaggggttggaaaatataaaatgaggccagagagtgttggtgggtaggaagagtgggacaaattctgtagtctggtagactatttggatgactggcatttactcagggtggtatgggaagatattggagggcttcgagcaaagaggtacattatctgcattaccttttatcacactagtgggcggggagaggggaaggcaatggtggaagcagaaaaatccactgtggctattctgatccatctatgcaaaagatgacaatggatgggaccagaatgatagcaaagaggaagatgtggttagagaaaattaaacacacaaaagaaaagaatgtggagaagagaagatgatcagggacttggaaaatgtggaattgccccaaaaacaaatcttactcaaacttaactctatgcctttccctactaattcagccttcaaagaagcgacaaattactcagtcactcacaaaacaaaaataaataaaacgtatgaaatttaatacattttgctcttaacagctgtatggaggtgtaattgatttggtttatttttggaattgcacttgtttaatgtatacaatttgatgaatttggacatatgcataaacctatgcataatatcaccacaatcaaggtaataaatatattcaccacctccaaaagtttccgtgtgtgtgtattttagtggtaagaacaatcaacatgagatctagtctctcaacctaattttaagtgcacaatactatgttgttaactttaggcactcttgtacagcagagctctagcccttattcatcttacataatggaaactttatattcattgactaactctctatttcccccttccgcaggtcctagcaaccactattttgttttcttcttttgtgactttgactattttagatacctcatctaagtggaatcacacagtatttgcctttctgaggttggattatttcacttagcacaatgtcttccaggttcacccatgttgtcccaaatagaatttccttctttttatggctaaaaactgttgcattgtatgtatataccatatgatccagcactcccatgttcattacagcattattcataacagccgagatgtagaaacaactcaaatgcccatcagcagataaatggataaacacacttttatttcttactttggcattgtatattgacattgtaaatagatcttgtcaattaatattttatgtatatggtataaagaggtcctggatttttagtgccatagttagaaatttgaggtccatctgaaatcaactaaaaatgcaaagatttctggtaataacatgtctttcaagttaatttaagtctatgagtctttacttaaatggctctgtgttcagagatgatgaacttacagcagatttgattccaaaataaacctaggagactgtaacagatgccattgatacctctccccctaacctcacgtttatctgcagctgtactgcaattcctgggtcccttatctacttcccacctcaagggttttcatctgcatctctctgtttctctgcctaaggcaatgccacagcttactaggctcaagtttgaggaagttaatgtccctggggacaggtagaagtcactggataaatagctcagcattgttgtccctcagtaggacagttgtgaagcatgttttatatgattcttcagggagtctttgtattagtttgttctcactttgctataaagaactacctgagtttccagtttttctgctctgttttttccccatctttgtggttttatctacttttggtctttgatgatggtgatgtacagatgggtttttggtgtggatgtcagttttccttctaacagacagaaccctcagctgcaggtctgttggagtttgctagaggtccaaccatgatagactggattaagaaaatgtggcacatatgcaccatggaatactatgcagccataaaaaatgatgagttcatgtcctttgtagggacatggatgaaattggaaatcatccttctcagtaaactatcgcaaggacaaaaaaccaaacaccgcatgttctcactcataggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaacatgaaaaaaaaaagaaaaaataaaaagagctacctgagactggaagacctttacgaagaaaacaggtttaattgactcacagttttacaggctctataggaagcacagctggggaggtctcaggaaactaacaatcatgacagaaggcaaagaggaagcaggcatatcttcacagtggtgcagcaggagagagagagaaccaaggggggaagtgctacacacttttaaacaaccagatctcatgagaactcattcactatcactagaaccaagggggaaatctgcccccatgatccagtcacctcccaccaggcccctcctccaacactgagaattacaattcaacatgagaactgggtgaggacacagagacaaatcatgtcagtcttcaataagtccaagttccagttgctcatagtgttcccatagcataccctttactggcttttgcccttctttatttcccttttcccctcccttgcatgcactttctggttcacctcccaaataaatgaacttcaaagtatttgtcttagggtacacttgggggtcccacatcaagccaggcagagacactttaatgaagttgctcatgtctggttgacaaaacaaaaggttcaagaatgttcctcaggaattaagcaaaggtgattgttagctccatctactttgttttacccctctttgatcttattggtctcactgtgaccagcattaaagaaacaaagggtcttgagctggtacagctcaaaatggtgaatctgttgctgtttccataattaatcatttttgtcaatagttataagtgaacagagccatgaaatgcagaatgcataataggaagctgaaaatttatgggcatattgaagacatgtaacaattgcctgtatgaataacaaaggagcaggaatacagcttctcggaggctaggatctgagtttctgacatctagaataaagttaggaagaacttaagtgctacaataacaaaagatgccactggatttacagtttggctgaattctagggaaatcacatgttgtaaggccttggtaaagatcagattcagaaattatttttaaaaagaagaatttggaaaagataaagtaaaaccccaaattctatattaatttttgatgtagatttactttggaggcataccaagtgtttctggcttggaaaagtttaggtgcaaagactatggatgagcaaatgttcagtggtccttttctttccctcttatggcataatctaagcctcaggaacagaaatatccataatccataaaatgctttttttatgttatacaaagaatcagaaagacacgacttgtttagaaattcaaaagactgttaacagagaacacacacatctcctctgacatgaaaattttcagataaatcaggcagcagagaaagacaaagtcagaaaatgtttatcgttttcctgcaattattggaaacatgaaatatttttggtcaaagcagagggaaccaaattaaggtaataatgtgtaataactaataaaccgataaagtaggtgacaactgcagcaaatgcatgatcacttatttttccccaagattactgtcattattcttatgggtatgtgggtgtgggcaaggggaaataaggcccatgtaaataaaatgtaattctttgcttgagatatttatagttttgtggttgaaaaacatatataaacatgttatttcagtacagtgtgaaaagggcactgggtttttggcagagttagatgcagagaagtggcatgatctgattatattttcgaagaattactgtggctttcttgctgagaagagactgagagggggctggaagacaataatccaggcagaagagtttggtggactagggacaagatggtagcagtgagctgatgagaacatgacacaaaaagattatattcaaccatttattcatgccttcatgcatccatccattcactcatttagacataggtccagtcttaccaaaaagttgtaagaataacacaacagacacttcacccagatttcccaagtgttaacattttactatttttttttatatttttctctctttgtctgagagagagaaatagacttatatttctccaaaatattgactaaattgtaggcatgataccccttcacctctaaatacacctccaaatataccagggtataatatctaaaaacaacaacattctctgaaacaatcttagaaaaattatccaattcagttttaacactgatacagctatctaatctacagaactttttcaaatttgttaacctgccccaatagtgcctttataacaaaagaaaatccataatcatgtattgcattcagttagttgtcttgtctctttagttccctttaatctggaatagttcatttctctttcattgtgtttcatgatattgacattttggaaaagtacaggccagctatttatagaatgtctcccgatttgtgtttgtctaatatttcttcttgtttacattcaccttatgcaggtttcatagaaatacctcagaagtgatgctcttttcacagaattttatatcaggaggcacatgctgttgatcagtgtcattaacggtgatgttaactttgatcacttggttatggtagactctgctgtctctctactgtaaagcagaatatttaactttgtaattaaaaaatatcttattattttcacactgtgttaaatatcccatgtgttctccagatttcacctattagtgttacaggatctttggggcattgctttgccagctggaaacctccatggccagtggtgtctttgcttgagttttgcttgggcctgctgggccaactcagcaggctgctgttagctcacacctctggcctggattgcatgcctgccaagggcaagtggagcagcaaggggtgtgtgagagagacagcatggggtctagccactgtgcatagccaggcacgctggctgcagcggggtgggcagctccaggcactgacacaggtgctggctccctgtgaggctgcagccagaccagacatcctgaaagcagcttccacagctggcaccagggaatgctgcagcacctggaagctttaagatgccaggaactgcaaagccccatagaggatgtcacggccctggcttaaggagctcctaggtctgggctcccctaagggctgcagatcttctctccttctttttgcctgcaacatggcaagcaagggccatgttttagccttgctcatgttacagctctttcatccctgccattcggcaggtcctgagttcttgaacctgtgcccaggaagaatgaggtatgtggacaagtggagctgaataattctatttttcaagtggatggtgagcaaggtgaaaaggagctttattgtgtgatgtaacagctcagaggagacacgcagtggatagctactctccacagctagggtgtcacaacaagtattcagctctctgcagagaggagaccgtggggtaggtagctcctctctgcagctggtcttatcatcatctcctcaagtctggctgagtctggggcttttatgggcctcagaggggaggaagtgcacactgattaatctatgagcagcctgaataaagcacaagttcccactcgcgtccatgggcccagcagcccggcccccaggcttcaggccctccccagctcacaggtgggacttcaccagggacctgccccttatgcccaggagcctgtctgctttctgctgccattcatggcgcccaggccattcatgccaagggaaacctgtaggccaatgccaagctgccctcagcagcccctcaacccccctcacatacttgttggtgcccaaagtccagagggggctgaggcaacaggggactggcatgtcagtgctgccttgagagtgtgcacacactggcaacctgcaacagtgcccaggctcagccccaatcttgctccaagattggagtgtgcgccaggagcagggagagggcagacagtaggagcagacacttctgagcccctgggggcgggggtccttcctgtgcccccaagagtgcagagctgccaggtctgcagccatggcttgggtggctgtaactgtgctcttgcctgcttccagcctccaaaagcacaaggaagcccacatccacagccatggctggatggtcagagctgtgcccagggagcacgaagttcctgccctgtcaactcagaaggggatggcacttctgcctgttcccagatcctgccagctccatggagtgcacagccctggcatgccttccccactgcagccggtgtcatgcagtggccgctgtagattaaccaccactgccatgactagttttaatatccattgatgattctcactttcattgattactaccaagatggttgttatgataatttttaaattccatcatttatttttattaatttattttctaccaaaaggaatagcttttccttcatcctaattttcatttatatcagtggattaatgtatttctattttgtacaataggttattcttattgtcattatttatttgaatgttcaaattgtcacattcttggccaatggaaattttttcaagtaggccacagttgcccttttgacatggaccataattctttgagcactctcccaactttcagcacagaatgttgcagggtcctcttgtactttccttggcttagcactggagtcagccatttcttcaagaaactctggttcctttcagtacagaatggtattagagatcaagattagggttctatctgtaaccatcaccacaggggagtcgttgcttctaggcattgttaatattaataaacaaagccagaaatagaaagataactgtgtattacactcactcacctgtctctatttagctaactagctatattaaaaacagttgatacacactggtttctctgcttccattccaacatagcaggataattgtattttctccctttttatacttataactgtcctctctactagtgacaaacagctcccattatttataatatattcacttacatgtttaatcttacaatgtacagaaagtagggtcagtgttactaacctagacatctaagaaagaggcctactcagtagcattcagtatttatttagggttctttttgtctttagctggaaaacatatagtccaactatggttagatcttctcccattacttcttagtgttatttattcaaaatattatttatttaaagtatactgggtcatttgtttctgtttctgttcaattttagaatttttcaccttcctttttgttttattattttcttttttgtgtctgtgaaatactaatattctaaaagtgagatctatattaaatttcacttttaactaaattatttcctttcttgtgttgtcgtttagttgatttctttatatattcatgtatttttaagcagataatttaattcatttaggcatattcatttttattgatgaaatgtttgaggttatagggtttccttttatcactattttatgtgccacagattctcatataaatagagatagatagtatgtatactttaatatacacatatatgtgtatgtttttattattccttgtttagaaattctttaaatttgttttgtattttcatattcacccaacttgtttaataaaagttatttttgattatttattccaatcgtatgaccttttaccttttttattttaaaataatctgttttttgttattagagattaaattgtaatatttataattatgaaatgtacttatgtaacttagtatatgattacattttaagaatgcccaatgaatgtttgagaagaagatgtattcactattacttgagtgtaaagttctgtgtgtataatatctaccttactgattaggttttgcaggacttctatatcctgttctgtgtgcacttgattgatcttatatcaattctgatatattaacatctcctaggcttgtatgtttctatctgtgtctttttgattctccttaattttttgctttataaaagtgtctactatgttattttggtgcatagatattgatagttgtcatgcctattttgtgaattcaggcttttaacattgaaaagaataatttttcccatatttaatgcttcttagcaaagtttaatattaactttgtttgataccaatattgcctttgctctgttattattcccagaagcctggtgtgtgtgtgtgtgtgtgtgtgtgtgtgtgtgtgtgtgtgtgtgtgtgtatccaagtctttctatttagcctttctgaattattttgcatatgttttggatgcagaacatattgggttttactttgtgagtcaaattgaaaataatttccttctaatggttgtgttaatcttatccattcacattaattgacgtgctaaatgtctaatgtcagctctgttattttatgtaataattatcatgtgtactgtgttatatttgctgtgtttctctatacaaagtagagtattgacctcttttattctattttgtaatttcttttggtgtttaggaaagactgtacttttgttctagcagtcaatttttaattctttttacattttcttattcttttgcttttgttttaacatgtttctgtgttgtttgcattttgaatgacatattttaacacaaactattacctacacagcaacttccctattttctctcttctgtcaatttcagttctgttatttctactttgtcagaacatataacacacactatgtagcatataacataaaatattattactccactctcaactttatctttgttttagtcttagatttacaattacatatactaaaagcttaccatttgtaatactgctgaaatttctcaattcatttctttttttttagattttttttaatactttaagttttagggtacatgtgcacaatgtgcaggttagttacatatatatacatgtgccatgttggtgtgctgcacccagtaactggtcatttaacattaggtatatctccaaatgctatccctcccccctccccctaccccacaacaagccctggtgtgtgatgttccccttcctgtgtccatgtgttctcattgttcaattcccacctatgagtgagaacacgcagtgtttggttttttgtccttgtgatagtttgctgagaatgatggtttccagcttcatccatgtgcctacaaaggacatgaaatcattattttttatggctgcatagtattccatggtgtatatgggccacattttcttaatccagtctatcattgacggacatttgggttggttccaagtctttgctattgtgaatagtgccgcaataaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatcgccattctaactggtgtgagatggtatctcactgtggttttgatttgcatttctctgatggccagtgatgatgagcattttttcatgtgtcttttggctgcataaatgtcttcttttgagaagtgtctgttcacatccttcgcccactttttaatggggttgtttggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactccaacaaatttacaagaaattcatttctttgttggattctgtggcacttaaaactgtttttccatagcattgatccttgactgaccacttaactggctataaaatttttcattcataccatcttcccttgaattatttgaaaatgctactcctctctaccttattttgctttgtttttgtatttggcaataaagataaagtttaatacacatgaagctggccataccacagtgagatagagttattactcaaacaacctctctgagactttaggggctagggtttttcaaagatagtttgggtgagcggtgggggtggttaggcttgcagcctagggttgcttgcagctgattggctaggggtacagtcatagggttgtagaaaattgtccttctgcacactcagtcatttctggtggggccacaggagtggttagtgggcccaggtggagccaatggtcgtcagacatggaaaaaacctgaaaagatatcttaaagggccaagcttagcttctgcaatagtgatgttatctgcaggagtaataggggaagttgcatagcctgggacctccagaataatggctggcaattgcttatgtctacaccttagcagaattcaggcccctctatcctcctagcctggtggtctctcatttgctttagaagtgtagttgaatttgggggaaggactgatatctctttcttccattcttttaaacttttattttaagttcaggggtgtaagtgcaggtttgttacataggtatacttgtgtcataggggtttgtttcatcacccagttattaagcctagtattcattagttgtttttcctgatcctctctccactcccaccctttaccctcccaaaatccccggtgtgtattgttcccctctatgtgtccatgtgttctcatcatttagctcccacttataagtgagaacatgtggtatttggttttctgttcctgtgttagtttactaactaaggataatggcctccagctccatccatgtccctgcagaggacatgatctcattcttttttgtggctgcatagtattccatggggtatatggagtaccttattttgtatgtagcgttttggaagtctgatgccaactatttttcttgtcattgtttttatttctttatttattggctaaagtctgcatatttttcttcttcatctgtaaaaatttggtatttttactttaacatcattttgaactgattattactaatcaattttctctgctactcattgagccctttcagcatttagattcaggacttcttttatttctgaaaggctatttgaattgtcctttaaaaattaattcttttccattattttacttatattccttggagactccagttatagtaaattggatcttctttgcctatcttccattttaagcactttctttctgagcctttttgtttattttatttttattttctttgttgtttttctattttttaaatgaacattgttatacttttatttgaatatattctttcttgggtatctcgtaatttactttttctgatatgattttgtctttttaaatccttttttttctctttttagtgtttgaatttatggtttaagttttttgttctgttttgctttgtttttgctccatacctcaaagtgtttgttcattaatttagtttggagtattgtgttaaagttttcttctttttcactgttactttttgggggttgcagaaggaggattgtatcagctgaattgtttatattctcattctctgatttctttttgtagtttttaataaacaaagactctttgcacttctacattttaatggtctaggttggtgatttgtagtagtttcttttttttttttaaatcatggctaaaaaatgtcctatgtagtcagtgtgaaaaaagcatagtttcattacaaagtgcatttttttttaggggaagattttataagggactaagttattagtcttccaattgtattgtattgtctcttatcttgctcaatctaaatttctctctcgcttctttttcacttcaccatataatttccaaagggcacttatttcttgcttttgattctcttcttgaagactgatgccaacctcttgaagactgattccttgcatactgtatgcatattctttccctgtgatcactgctctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttctttttctttttctttttcttttttttttgagacagagtctctctctgttgcccagactgaagtgcagtggcacgatcttgaattactgcaacctctatctcctgggttcgtgggtccaagtgattctcctgcttcagcctcccaagtagctgggattacagacgtgcatcaccatgcccagctaatttcagctggaagttttctaaaccttggataccaaattaaacttgacccggatatatattagtttggtgcaaaagttattgtggtttttgcattaaaagtaatgggaaaaactgcagttacttttgccccaaccccaaaattttatcccatgaagaagtaaaaacaaaaacaaaacaacaacaacaacaacaacaacaacaacaaaaactccttacctctattttatacatgtttgaggcttcatattcttttctgtgcccaaacaaaatttctttatttgttttccccctatctcatcataggaaaaatattatcctttggaagagattctacaagaaataaagatagttcaatgtttcctaagattgaaactttggcgaagatttgaacatactaagtgaatgatgtcttcacactttcttttccttatttctgtgcttctcattcctgatttgtgttacagagtctaaaaatcttctcattctagtacagagagcaatgcaactctcctaagagtctcctgcaaatttatctacccaagctaaagtgctcagcagtaaaaaaattccacctttgttagagggaagttttgatgaaatatagcacatttttactttgttagtatagtgggttaaaaaaggttttatggtctatatattggttgttaacagaagaatctcttgaggacagtgagctaacataaaagaatgaattttcaaatcagacttataagaatctgagatcttacctaatattcaagctttactaaataatgtcaaaaaaactcatgcaaagtagagtgaggactctggtacaccaaaggtcacatatcagatcctgtattttcaccttagtcatgcagttctgcccaaggatactagatcagatctctatatgacaaccttgagatcacctcatgcagtgggaatatttaaattatgaaacaccctcatttaataaatctaacactagtatagcctatttcacattttccagggagaagagcctgatatatcctggtttctatagtttacccttagttaggacatcttgtgaagtgcatttcagagattaagtctcttctttctagcaaatatctatagtccatttaaccaaatatctcattagcaaggaggtagaatggggtcagctgccaacatttttccccaggagcactcaaccccccaaaaggaaattaatcaatttcaggcaagctgctttaatttctttctttcattgatttgctgtgattttctcttttgtatttttttctaaaaccgtgggtattaaatacataattgtcagaaaaattgatgtaatggaaatggggaaaaaactcagtcatatattgtgatgttagaacaattcatttacctggttgcagctctggtctatctgtatataaatagcagacttcatgccttacgattcagtcacctgaagaacagtgtagtggccgaattgcttagataattgatattatatttatggtatctgagacagaatgaagattttttattaaatccctttgaagattagaaaataatgtcaatagtttgtatatttaatactatatatgtttatatattcatataacatatacacacttatatgttcatgtaatacacacaagcatatgtatacatataccatataagtcccttattattattgtagtaaatcaaagttctatatctatatactgcttaactacacataacttcctattattcttccctgttctttagtctctaattttatatagagtaagaattatatattattgtcttattttctgagcagaggtgtggtggattattccccaaaggtcttgttttctctgtttcttttatatttcatgtcaacattttcttgttgttttccaatttcttccataaaaatgtaatacaaagaatatcataatagcaatctttacatatgcattatttttaatttataaaggactaagaactgtttctgtgttctaaatactctaagtaatacattttctaagtaataaaataattttgagaaatgctataaatgtcatgttcatctttccattcataaaatactattctttctgctaccgtgctgtggtttctcccaatcaacagagttgcttatagacactctctgaagtcacgtccacccctggacaacttgatagatggcttttaagaaagaaatgaaacattatttgggggagggtggaacaatatggaagaatataaagcttcatccatcatcccacccacaagaacacaaaattaacaagtatctacaccaaaattgccttcatcagaaccaaaaatcaggtgagcattcagagtacctgcttttaacttcatactgaaagaggcactgaaaaggatagaaaagacagtcttgaattgccattgccacccctccttcatcccctggcagaggccacatgggatggagagaaaatttttgcacttaagagagggagagttcaacaattgtgaggcattgcattgaactcagtgctgccctgtcacagcacaaagcaaaactggactgaactcagctgatatctgcccttggaggaagtgtttaaaccagccctagccagagaggaattgcccatcccagtggttggaatttgagttctagcaagccttaacactgtgggcggaagtgctctggggccctaaataaacttgaaaggtaggctagaaaaccaggactgcagcacctaggcaattcctagtgctgagctgggctcagagccactgcactttggtggcacattgacctactgagacaccagtcagggtggtaagcgagtgcttatgcagcccctcccccagccccaggctgcacagcttgtgccccaaaagagaccccttccatctacttgaggagagcagagggaataataaagagaactttgtcttgcatcttaaataccagctctgccagagtaggatagggcaccgtaagagttgtgagacctcctttccaggccctagctcctggatgacgtttctagatataccctgggccagaagggaacctgttgccctgaagggaaagacccagtcctggcaggatccatcacctgttgattaaaaagctcttgggccctgaataatcagcagcaatatccaggttgtatgccattggccttggatgacaccctgagactttctggcttcagctgagactcagcacattccaagatgtggtaactatggggagagactcttgcttgagaaagcagagggaaacgtaaaggggactttgtctttcaccttagatatcacctcatccctgggggttagagcaccaagcaggctgtcctgaatattcttgggaatgatcaatgagttaatgaagtgattaagaagaaaatttaaaattttcttgaaacaaatgttaatgaaaacacatcatactaaaatgtgtgggatacagccaaagcagtactaagaggcaagtttatagctttaagtgcctacatcaaaaaaagaagaaaaacttcaaacaaataacctaacctagttcttaaagaattagaaaagcaagagcaaaccaaatgcaaaattagcagaaaagaaataataaaaatcagagcagaaataaatgaatttgaaatgaagaaaggaatacaaaagatcaatggaacaaaaagacagttttttgaaaagttaaaattgacatactttgagccagactaagtaaaaaagagagaagatgcaaataaataaaatctgaaatgaaaaagaagacactataactgataccatagaaattgaaaggattattagcagccactacaagcaattataagccaataaatttgaaaacctagaaaaaaatggataaatggctagacacatacaacctaccaagattgaaccatgaagaaatccaaaacctaaacagaccaataacaagtattgagatcatagttgtaataaaaactctcccagcaaagaaagtccaggactcaatgccttcactgataaattctacaaaactttaaaaaaaagaaataatccaaatcttactcaaactatttccaaaaatatgtgaagatggaatacttccaaactcattctgtgagaccagtattaccctgataccaaaaccagacaaagatacatcaaaaaaggaaagtacaagtcaatgtcactgatgaatattgatacaaaaatcctcaaccaaatattagcaaattgaattaaacaataccttaaaaagattattcctcatgaacaagtaggatttgttccaggaatgcaaggatggtctaacatacacaaatcaatcaatgtgatacatatcaacagaatgatactgaatggaggaaaactgaaagcttttcctctaagatgaggaacatgacaaggatgcctactttcaccgttattcaacatagtgctggaagtcctagttagagcaatcagacaagagaacgaaataaaaaatatccaaattggaaaggaagaagttaaattatcctggttcacagatgatatgatcttatatttggaaatacctaaagacttcacaagaaaactgttaaaacttataaacaaattcagtaatgttccaggataaaaaattaatatacaaaaattggtaccatttctatatgtcaaaagtaaacaatctgaaaaaaaaaaacaatttagcaatcccatttacattaggtacaaataaaataatataactaggaattaactaaaaaagtgaaagatctcttaaatgaaaactataaaaaattgatacaagaatttgaagagaatgccaaaaatggaaagatattccatgttcatggattgaaagaatcagtattgttaaaatgtccatactacccaaaacaatctacagattcaatgcaatctttataaaaataccaatgatattcttcacagaaatagaaaaaacagtcctaatattcatatggaaccacaaaagacctagaatatccaaagctatcctaagcaaaaaagaacaaaactggaggaatcacattacctgacttcaaattatgctccagagctttgattaatcataaccaaagcagcatgatactggcataaaagcaggtacatagaccaatggaacagaatagagaacccagaaacaaatccacacacctacagtgaactcacttttgacaaaagtgccgagaacacacacctgggggaaaaatatcttttcaataaatgttgctggaaaagcaggatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataaggtattagtaactagaatatataaggagctcaaacaactctataaaaaattctaatactctgatttaaaaaatgggcaaaatacctgaatagacatttctcaaaaggagacatacagatggcaaacaggtatatgaaaaggtgctcagcatcattgatcttcacagaagtgcaaatcaatgctacaatgagatatcatgtcaccccagttaaaatggcttttatccaaaagtcaggtaataacaaacactggtaaggatgtggagaaaaggaaccctcctcatacactgttggtggtaatgtaaattaatacaaccgctatagagaacagtttggaggttcctcaaaaaactaaaaatagagctatcataagatctagcaatcccatgcctaggtatatactccaaagaaaggaaatcagtgtatagaggagatacctgcacttccatgtttattgcagcactattcatgatagccaagatttggaagcaacctaagtgcccatcgacacttaggttatcaacagatgactggacaaagaaaatgtggtacatttacagaatggaatattattcagctattaaaaaaatgtcatcttctcacttgcaacaacatggatgaaactggaggtcattatgttaagtgaagtatgccaggcacacaaagacaaactgcatgttctcacttacttgtggaagctaaaaattaaaacaattgaacctatggagatagagagtaggatgattaccagagactaggaagggggtagtagacgggtggcggggggaagtaggaatgattaatagacacaaaatatagaaagaatgaataagacctagtatttgctaacacaacagggtgactataataaaaattatttaattgtacactgtaaaataactgaaggagtataattggattgtttataacacaaagaataaatgcttgatgtgatggataccctaatgtgattattacacattgcatgcctgtattaaaatatctcatgtaacccataaatatatacacctatgtacctacacaaattaaaaaagaaacaaaaaaatcttattattccatattggtgaaatataaggagaatttagtagtttagactccctccctccctcccttctttcctttcttccttctctccttcccaacagggtctctctgttgcccaggctggagtgaaattgtacaagcatagctgactgcagccttgaactcctgggctcaagcaatcctcctgcctcagcctcccaagtagctaggactacaggcatgcaccatcatgcctagctaaattttaaacattttctagagatgaggtctactatgttgcccaggctgatctcaaagagtttagacattttcaaaggagaaaatgtgcttatagcaatctgaaaaagcttatctcaattgactgaaaaggaacagttaagaaattaaatggagctttgttgtattaaaggaagtcttgatcttgatcacatgaaccgaagcacctctccttttccgtcaatatttgacttttaaaatctggattacccagactataaacatgaaagttgcttttttaaaactcctgtcatgctctctgacttgcaataatctcttgagctttctttcagaagtgacagtgctagtttggagaaaattttattttctggtaaagtgaattaatttttctagttacatatatttcattgtaaatatatttctagtgctagttgatggcaggagtttctgttgatataaattgtgaacttcaaaatacatgtttttaaataaatgttttccatcataccatatagtattatttttctaatgtgtctcaaaatcacatttgtggttgtgcattcagtgggctccatggcagagctggggaccagcggggctgccccacagccattgtaagtttattgtgagaaagttggacgcagccctggggactcctgtgagcagtatctcaggatggcagcactaggccaacctgaaattaatttttgaagggaagttatatttacgtcacaaattaaaaggttaaacttttttaaaaaaataccttcttatacattttatagaaacgtcatttgaaaaataaaaaagagatataacatatgttctgaaacagagtttctggaaatagtttctggaaaagaagaatgtgtaacagattttattggtatatttcattcctttcagtgagagcttttatttgaaaggtgtcttgatttctacacctttggagacaatcaacacggctggtgtggtcccattagaggtcatattaagaatacccatgagtgagctcctcttagtgggaagaggcgagaagtgaagccatatggaaaaaactacctctcttagggacacggtggtaatctcaatcatgaagatcaagaagtgaaggcaagtctagcccaactattctttagctgaagaatcagctaatgaagttatgtttaaatccacagtcctgggccccagctaaaaaaaaaaaaaaaaattcagtttatcttgcggatcccaggactgcatattttaacaagcatcctgagtcaattaagctgattctctgaacacactttgagaaacattcatctggccctttctgtatcagcatcaatatctgagtggtctgatctgagcaactgaggcagaacacagcagaagagcttcaagtcgctatattcttgtccaagaacttaacgtaattcatattacttaagtaattaatgttattaatgacatagaacagaattgggactctttttaagtctcatagaaaattagaaagcaatgtatgtactccatatatgtgtatatatacatataaaagtattatgtattttaaaaagcccatatgtttgcctcattatcattgcaacaaatcaaaattccagatctatatacagtcagccctttgtgtccataggttccccatcctcccatcttctttttctccctctctgtcaccagactatttcttctcctgagttatcagactaaattattttcctaccaaaatcatttcagcttttgtaaaaaaagatcaacctgcaaaagagattatagggtgtgagccaaaccatgacagtccctggtagaacactcttgcacatgttttactctccaacattatcgttgagtagactcagaatgcagaaggatgagctctgccaggaacgtggggttgcttgtttccctgaagactagttatgactgtcttttttgaaccatgcaatcatagcagtgtcttgacctttaatattgatgacataatggtttgttatgttttaattaagctctaagaatatttctggcaatttagtattacctctcctgtggcctacacccagaagttaccctttcaaggacgacgtaaaatatgattctgctaatgctagtgttttacatgccagtcttttattcagctcatggtgttttcttttctcctaaaaatactttatagcaaaggaatcacatctcaaaaagaaaaggcatttattaaactaagggtagaaataagaagaccaaaaggaattgccaagaaaagcttttactaatgcttcacattaggaatctgcagaagcctgtgaatgaggaaatggccagatttagggaacttgaataattgcctttggagagcaaagttgtattaatctcattggctttttgatttgctattttcctccccatcttattcacttcaatttttgtattttcttttttcttagagtgctaactttcatgttgcttttctaaattatgcactacccctgctgtctgtcccattctaattaggccttttctatttatacttacaatagtgtaaaatctcaagacacaacttttcttgctcctagagtaggtgagccacaaatgagaagttcagatagatgcagtttaacagagtcagcaagaatactgacatacccatgagaaatctgccttccaggtctgacaggtgacacctttgcaatgatcagccttaatggttgatctgcattactaacatttccttggtaatctgatgtcacattgcaagcagctcaatattatagggtttttatcctacatcattagacgtacttcataaattttgcccaagaggcagacttggcttttacatatttctgtttatttaatgaaaaatagatttcccttttttcttcctatgtgatttgtaatactgcatattaatagatattgaatagaaaatacttgtatcatattctcaaacatttgaatgtgctatataagctctattcatgtcaagtaggacaatgattttatttactttttcaattattatgacatcatttttattggtaggactatttttgcatggagtagaaaagggcagccaatttaaaaagcttcttacgatagaagcattgtcattgttctccacctagtacctattgcagtttttcctaaagtaaattgaattaactggacaaggagcttggtgacccaaattttacttcagctatcaggcgaccttctttgtagcaaaagtgaatcccttagaagtcttttgacctttgttcacagttacacagctttcaacgttttctggtttaactcagagcgcagcacagagttacaaacgaaagagacaccttgcccctggggcacaaccaattcatttccagataattcatacctgcaaaactctgacttgcctgcaccagccacagactccactgttgattgcagtgttgcagctaaattatctggaatcaaggtccagtctatatatcccagatatagttttggagaaatcttttctctttatatcgtatattataagaataataatataaactcaatcaagaaaagctatttttaaaatactaaactgaaaaatttatctgccaattttaattgcactttggttccccctgtatatgctgatacccaatctcaatgtgagactgatttttcttctcatacttcccctctgtttgctccttacagcaaagttccatcaaaaaaatgaatattaactaaaaagagacgaaaaaagggaaacttcataacttactgactttctataaaacatcctttatttcctagcaatgtggttgaggtgcgttagaggaagacaagaaggcaaaaactgaaaacgtcttctctagaaatgacagagttttttctgcctacattcaacttgaataggccttaatgtttttgatctgtttgagaccactactcaaatattctgtagagttcacatgggaccaaaaattgatttaagacatgaaaattagacctgttgacaaaagctaagggaagtgaggttatttcacctggaggagaaagacaaggaaggcatgcaattcgagcatggaaagggtattgcataaaatacggatgacagctattccatttgaacctgagtttcacatttaattccatttgagcaaaaatgcagttcagttttaatttataagaggagaaatttggaatctatattaaatcttcttaactagaacaaaaaaaaatgaaaattaaacattcttcagttataattagaaccaagattgtctttgcttaataaggcctgaaagcaaagacgttttttagatgagaatgggtatgactgtgtgcttagtacttaccatatctcagaccctttgaagcaggagtaggcctctagaaaattatgaggacttctgtgtagtctcactgctttttatgtatggcagagaagtacaaagcaaaagaaacctttccccagaaaaacccctggaatacaaccaattcactcaacaggtaattcatacctagaaaaatggtttggtagcaccaaagactccaatgctaatttcaacgttgtacacaaattatcaggagtcaaggtccaggctaacacagcttcgccaatgtaatgatcacaacagtacaagtgatgaaacagaggcagaaagaagtagcttgaccagactcacacagccagtaagtgacaaggttagctgagaatcagtctattcatgccaaagcttatattctttccattattttacaatatatacctaagtgaagtttaaaagtcctttgcaaactctggattctaccaatacatgtcattaatgatagataagaatattttagttttgttttatgtgctaagtagaattcaaggttaataataggacaatgaaataactttctcactcacccccactccctttttttttaaaaacggagtctccctcttgttgccctgtacggagcctcccttttgttggagggcagtggcacaatctcggctcactgaaacctccgcctcccgggttcaagcaattctcctgcctcagcctctgaagtagctgggattacaggtgcccgcccccatacccggctaatttttgtatctttagtatagacggggttttgccgtattggccaggctggtctcgaactcctgacctcaggtgatccgcctgccttggcctcccaaagtgctgggattacaggtgtgagccactgtgcccagccctcacttccccgttttaaaattctaaaaccctatatctccttatggctaaatataaagtaacaattaaaatctcagagagcgttcataattcaagcttttatttatccaattgttcttatcagaagttcttaaactgttttttatagagcagtaaagagtataaaagagaatatgtgagaataaaatacttcctttgcaaaattcaatatatttctgaggcctaacagaccccaatgaagaaaatatccaccaaattattaacttcaatgagaatgagagttgaggcatatagtataatatttctataattttttttgctgaacatagcatggtttaatgaacaataacctttgacttcttacagagaatccatatctctaaatcaaaatgtatttgtgttcctctctgcttatatagttacatatatcatctcagcccaaagatatattttttgttgcaaatttaaggtgattaaatggtttttaatggtagcaatgttgcagttttaattacagtgtttattatcatgaagaatttaatgtaaatatatgacaattagcagtattctattggggaaagctgaaaataatttgtcccaatctggagatttgctgagacccataatatgcatacactaattcctttgccctaacaccaccactgtataaaatatctctagggattttaaaaggtaaaagtgatattcacagcaggagtgacacagcatataagggaaacttaaatttggcaggcttttagcaggattttcccccattaaatcacagtagcataaaataagatatgtaaaatcacctcattacatttattttttaactaggatttgtttgtttttaaagatccaggaaaaactcaccaaattcctcttctcataccctactctacttgaaatcctgtaagaattaccaactacatattgatgatttccatttttgatagataatttgagtatgtaactttaaaaacatgaatcctataaactaatgagcaagatttcattatcgaatagcccattttgcattactaaatggactacttttcttaactaacttggcacttttaagtatataaagaagcaaacaataatgatttttaaaaatatttccactttccaagcctttattccatttcctgaattttaacctgtcaaaaatgaaacgcatgcctatggaaaaggtaattacttttctccttctttaacttcttcttaattaacttttaatctatgctgttacagagggagcatgtcttaatactaaatgtgtctaaaatgtaggagacagagatttaaatcatttagataaacatctgcctagcacagaggcataaaaattacaaaattaggatatgggtggctgagtgccaacagtagctgccagcaaaagcaagatattgccttcatttaaaaaaaatcttttgcttacaaacaaaccaacttaataaatgacttctaaccatacactcttatattggagcacatttcttgttttatactacataaaattctaaaaacatgtgaatgagaaattgaagggaaataaccatgcaatcatttatgaaaggcatgttttaatagagaaaaaatcaataaattggaaaatttttaccatgaagtgaagcactattgctttgtttagttggagtggattctgtcaacagtaatttaaagtaatcagttcaatgatatgatccctggttggtgttcagataattactatacttatgtctagtaattttcagctattaaatggaatatagagtggcaagtaaagacaggaagctttgacccttaataccccctttactatatgtgtgtaatttgtcttctaataactgaaataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataaagcaagtcacacaatttttttttgtttctctgtccatataaaagttatgatactgtagtctattaagtgtgcaatgaaattatttttttaaaaaatgagcattccttaatttaaaaatacttattggtaaaaaaaaaaaattctcacaatcaactgagccttcagcaagttgtaatgttttcactggtagacagtcttgccttgatgttgatgactgctgactgatcaggttggtgactgtggaaggctggggtggctgtggcaatttttaaaaataagacaataaagtttgccacatagactgactctttgataaatgatttctctgtagcatgtgatgctgtttgataacattttacccacagtagaaattctttaaaaattggagtcaatcctctcaaacccttctactgctttatcagttaagtttatggaatgttctaaatcctttgttgtaatttcagcaatgttcacagcatcttccccaggagtagattccatctccagagaccactttctttgctcatccataagaagcaacttctcatccattaaaattttatcatgagcttatagcaatttagtcacatcctcaggcttcacttctggttctcctattttcaccacatttgcagttaattcctccactggagttttgaacttctcaaagacatccatgaaagttggaataaattccttccaaactcctgttaatctttatatttcgatcccctcccatgaatcttgaatgttcctttccagaaggttttcagtttacttttttttttttttttttaccttttcaagatccatcagaggaattattagctatggcagctataccttataaaggtatttctcatataataagacttaaaagtcaaaattgcttcttgatccatgggctgcaggatggatgttgtgttatcaggcatcaaaacaacactaatctccaatatctttatcagagctcctgggtgacctggttcattgtcaatgaacagtaatattattaatcttttttttggagcagtaggtcttaacggtgggcttagaatatttagtaaaccatgctgttaagagatgtgccatcatctaggctttattgttccattcattaagcatagatggactatatttagcataattttcaaaggccctaggattttttgaatggttaatgagcattggcttcaacttaaagtcaccaactgcatttgccactaacaagagtcagcctgtcctctgaagctttgaagccagacatcgacttctcctctctagctaagaaagtcctagatggcatcttcttccaatagaaggctttttcatctgtactgaaaatctgttttttagtgtggccaacttcatcaattatcttagctagctagatcttctagataacttgctgcaacttctacatcagcactggcgcttcaccttgcactttatgttatggagatggcttctttccttaaacttcatgaaccaacttctgctagtttccaacttttcttctgaaggtttttttttttcctctctcagccttcatagaactgaagagagttaaggccttgccctggattaagctttggcttaaaaaaaatgttgtggctggtttgatcttctatccagaccaccaaaactgtctccataacagcaataaggctgtgtcactatcatttgtgtgttcacaggagcagcactgttaatttccttcaggaacttttccattgcattcataacttggctgtttagcataagacacctagctttcaccctgtgtaagtgtacatgccttcctcctccagcttaatcatttctagctttttatttgaagtgaaagatgtgtgactcttccttttaacttgaacacttcgaggccattgtagtgttattaaatggcctaatttcaatgccgttgtctctcagtgaatagaaagtcccaaggagagggaagagagatgggggagtggctgttccatggagcaagcagaacacatacagcatttattaattatgtttgctgtcttatatgtattcagatcatggtgcttcaaaacaattgcaatggtaacatcaaaggtcactaatcatagaccatcataacagatataataataatgaaaaagtttgagatactgtgagaattaccaaaatgtgacacagagacaaaaagtgagcacatgcagacggcaaaatattgctgacagacactgtctacacagggctgccacaaacctccaatttgtaaaaagcacaatatctgtgaagctcaataaagcaaagtacaataaaatgagatatgcatgtatctcctctccctctccatatccaaatgtagtaaaggaaggaaaacaaacaatatatttattaaaatactgtattgagaaagggaggtagaggcattacaaaccagaaatttccattagcttctgagattcaaaaggtggatgaagggtattaaatgtataacacaagttaagggaaccccaggaaactgctacagtggtgctgaaaggttaatgaattcttgacttgttgcaggacatggggatcacagtccttttctctaaatagtttgtgttccactgtcttcttgcttccagtagcaaatgtaaaatctgaccagtcagtacaatggttttacctttcaaaatatcttgctcgggaggctgaggcaagagaatctcttgaacccaggaggcagaggttgcagtgagccaagatcatgccactgcactccagcctgggtaacagagcaagactctgtctctctctctgtctatatatatatatatatatatatatatatgtatgtgtatatatatatatatatatgtatgtatatatatgtatgtatatatatatatataatcaagaatttttgtaaaaaatttcatcctcagacttctgaatggttgtcttttttttcagttagtggattattatttgtttgttatttcaactccatttgttacccttttcttcttctgaaatactgttggcatgttagatctctgggatctgtttcttatgattatcatattcttgtggggtttttggtctttgttctaagttatttcttccatgtgatcttattacaaatacaagtctgagccatacctggccttttctaatttaaattccagtgttttattttataatttatgaatcacaatcattatagattttctgactatatccgtttgatggtcctcattcattttatgttactgttttctttgagttcttcatcagttctagtaataatttattgggaactatcacttaaagaattttggatcactcaccattcctcaggttacttataccctttaaggttatttttttttttgccatattttcattatatgtgcccccagccttcacacatggggatattatgggttctgagctaaggcagactttcagtggaggatggtgaaataaaatggaaggcacagtcatttttgctcccgtggtcaggttatgttatctgtcaaatgtgttattctctcttgaagcatctgggtactgcatccccagtcccctctttttttcaccctgagtataagtaagagccctgtatcactcacaggacctgcgggcaatgcagcccagtaatgcaggtgagtgcaaggtgactgatttcctccaagcctaagagagtaactgggatcaagcaacctttgaaagactacacaaagccagtgtgccctctcatcagggagatttgtagatttcagttgattctccttaggaaaaaaatttttccctataccatctgcagaatattagattcatcctccggctctacccagatgcctccagcttgcatgcaccatattctaaatgactccaaagagagttgggaggaagaaggagccagggatgaaaaccttagttcccaaacattccttattttgaaaaggagacaaaaatattgtttattttgaataatgtgactatatatctctaaaacctaaaggataaaatgaaatgctttttaaacataagataattcagtaagattatgggttactataatgaatgtccaaaaataaaacagaaaacatagcaaaataaaaatcgaaagaaaaaggataatgtataataacaatacaaccataaatctcttggaatggaattaataagcaatgtgtaatacttataatgataaaactataacactctcttagaaaacaaaatgacatgtaaagagagaggttttctttgttcttgattggaatatttagcactgtaaagagggtagatatcttaaaaatgtcttcatgaaatcagaacaaatattcagaattccaataggattgcttttctcgggcatgggagtgggacagagagttggaatgctacaacacaaataaatctcaagtacctgatacattacatatgagaggattcagaaaattccttcccaaaataaaatatattataaaactagaattaaaatatgatgtaaatgaagaaatacattacagaagcaatgattttcaagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagaggtaagtccttcatagagaaactcgaatatcttcaaacggatctcctgaagcatttagcagagtactaatcaacacatatttatgaggaaagtacataaagcttggaaagaacatgtgaaaggattagaggaagggaagcagtgccaaaagctgagatatggtgctgggaattatgcgtgttataaccagacagattggaaaaactcataatccacagggcactaggttagtactcaggaaagtctcataatttcatttggtgtattagtatgagttttccagagatatagaaccaatggaatgtatgcatgcgtgtgtatacatatactttaagaattgattgtggaggctggctagtccaaaatctccagggcagaccagtaggctggagactcacagaagggttgatattgcagttcaagtctgaaggcagtcttgatgcagaattttctcttacatgggggtcctcagtttttttctcttaatgctttcaactaattggatgtgacccacctgcattatggaaggtaatctgctttacttacagctactgattgcatctaaaatataccttcatagaaacatctaggcctatgtttgaccaaaaactggatactatagtttaacaaagttgacacataaaattaatcaccatactcagtattttacagtactcagaagttgcttcagtagtgaggagtaagcagccctaggttgagcactgctctggacccatttaacaagttagaaggcaagactcaaaaggatggagctataggaggaattttaaaaataatttaacacccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggccgaagtgggcagatcccttgaggtcaggagttcgagaccagcctggacaacatgatgaaaccacatctctattaaaaatacaaaaattagttaggtgtggtggcacatgccttaatcccagctactcaggaggctgaggcaggagaatctcttgaacccagtaggcagaggttgcagtgagctgagatcgtgccactgcactccagcctgggcggcagagcacgactctgactcaaaaaaaaaaaaaaaaaaaaaaaaaagaaaccaaaaccaaccgcctgacctcactacaacattaccacatccccaaacatgcatttcccactacacaacccatttcaattgatggcaacacaatcttttcagatggtgagaacaaaaaccttgaagttattattttactcctctctttctctccagttccacatctaattcatcacaatatcttgttggcaccaccgcacctgttgtaatagcctcctcttttttttttttttttttttagtctctgctctcttatagtttaatctcgacatggtaaaacagagtgattcttgcaacatgtgactctgatcagtcactcctatggccagtctcaagaaaggattttcattttattcaaatagaagctaatgtccttccagtgacctacatgatctgctcctccgcttttcttctgacaacatctcctatgattctcctagctcagcactgtctaatgatgaaatgtaatgtgagtcacatatgcaattttaaagtttttagtagcacattaaaatgttgaaaataagtgaaattaatttaataacattatatttaacccaacatttcaaaaacatcatttcaacaacatgaaaccagtataaaaattcaacaagtaatcaatataaaaatgatttttggtatttttttcatgcacagccttaaaaatcagaaatgtatgttatactaatagcacatcttaaattggtttagctcaatagccatgtgtgataaatgggtactatatcaaacagcacagtgccagctcttgcctctccaggcacattggtttcctttatattcctggaacatgccacccatacttttgcttcacaacctctcttatctaatgtgctgaaatgccataataccacatactgggtaatttataaacaatgaaaatttatttttcatggttctggaggctggaaagtccaagatcaaggtgctggtgaaggcttccctgtctgcttccaagatggcgcccttttggtgcatcctatggagaggaggagcactgtgtcttcacatggcaggagaaacaggtcaacaatggggcaattactagttccctccagcttttttatcaggtcactaattccattcatgaaggctccacccttatgacttaatcacttcctaaagccccacctctaatactatcacatgagcaattaggtttcaacatatgaattttggggacattcagacagtaacacagcctttgcatcagttgtttcctcttccaggaactgcttcctccatatataaacatggattgttttcttacctccttccagtctttttcaaatgtcaccatttccatgaggccatgccagattactttatttaatgtatcatttattatgttttaataatacataaattacttatttataatgtttattatctatctctcctctcactgtaaactctcctatgagggcaggaattttcgactgttttgttaatttatatactcccaacttctcataatctctattccatagaagttcaataaatacctgctgaatgaatgagaagaattaatgcagtcggatattatgctctcattccaacaacctagagtcatgtactgattttgagagatattcaggatattttggcaaagaacaaaatagacatattgaataattgtggaaacatatatccttttattatttcaaaacgtgtctttggatatgagtatagctgtgattgagatgacatatcatgtttataaagaaagcataatatctagttgctataattaattgcgtctgtctagagagtagaaatctgtggagagaggacactttcatagtttttaattatacttatatatatttagctttttaaataataagtatgctccttgtgataatttaaaaatacttataggtttaaaaactggtaatgtcataaaatattgggagcaattattctcttgttctaaaaattaactcatttagggtgctaaaatctatttcttggaggtcccctttgtaaaaccctgtaggtatttttccagaaatattcggagacctctacattgtatgtgtattattctgacctccttttgtatagggctatctgcgtttcatcattttaattccaaggagtgattttataaactgttcctcagttcatagtctttgcaattaaattgtaagttgacccactaactgaattacagaaatcagatataaacaaatgaacagatttcagctgttcatttgatatattggtttgaattagttttaatgggccacatggcagttttctagcctgtaattgctattaaacagaattctgtaaattcactgaagatgtttaaatactctgtgtggtaatacaactgatttgtgttttgtacaagttaataactatagattgaattaaaaagaaaatatgaccaaaaaagagggtctatttaatgcagtttttgttttattactttggaagattcatatgtcttaatttcaatttttcttttatttcattttttcaaaataaaattataagaatataagaataaataataataacagtaacttgtatttctactgtgctaagagctttaaatattttttctcatgtgattcttacaataaacctataaagttgatataaatattatctcagtttttacagatgagaaagttgaggtttaagaaggcagaataacttatctatgtccacagagctaacaaggttagaatcaacacttatatattattgttagtttcattctaaaactgtgtttttaagcattatgtcactaatatatttatcctagtgaaaataattcttctgatcatctttaaaaataaataggcctaaaattgcaaagggattttgacctcaaatcgattataaatccattatatgaaactgttatatatggtatcgcatcacaatacttagaacaccgactggaacatagtaggtatacaataaataattttgaattaatgaaattatgaaagttctcatctaatattctaaatctttacagtgaagggaaaaataccttttaaagtgggaagaacaaaagcaaatggcacagggtgttagtatttgagaatggaatagtcaaataaaagggattcaaattcacttgactggatcatttagaaaaactacaaataaagctggaaagtgtcaggctattccatagtatgcctactttacagattaccaaatacatatagtttatgtgagtttgtatacttaacaggggaatatttatttcctctgttaattttatgcatgttgaaatatgtgagggcctggttaaaataagaagccctctctgtagcccagataaaatgagcctctcattcttctccattaaattaggagacattggttggcctttaaatatcattctggactagttaagcaaactcataatgtttgacttctgtttgaccagctcctctctccaaactttgtcaaccacaaaatatcgtatgacacattatatatacctgatgatactcaaatactcttcatctttttattctctaccactttactagtgcagattatcatctgttctagaactaatgatgaaatcaccttcaaattattccccttgtgttagaagtccagcttgttgaccacttcttcccactatcaccatatttatcttcctagaacatgtgtctgttcttaaatcttgctaattccctgtcaccttttgctaattccaggaggaagtgtaaagcttcctcatgaaattaaagaagtctgccacagccacctttcctggctcaccttcccacaatcctccagcaaacctgaattgcaatcataaagaccaactctggctgccccagataaccaagcaccatctgaggctgaatcttgtttctaaaatgctgtagctcttcctttgttatcagtcaaaacccttctcaaacatcaaggctcagaaaaaatgccatctgtttcatgatgtttttcctagtctcccctattttactcctaccttaaaattaagcatttccataaaactttacttatacctacatttattgcatatctccttcccatatttattatagttgtcattattctttccttattggtttcaaactctttatggacaggtaaagtggctcatgtaagtgtttctcttccagtgcctagaacaggacaatatttgcagcaacaaaatattcaatataataaaaatatgttgtttactgaaaaaacactcaataaactcaaaaactacaataaaatattttgtacagaataaagatagcaaagaaaaaaacataattctccatataatggaaaaggaacatgttaaaacttgtattgataactagatgaatatagatggatgttttactggaaaagggaaatagaagagcagaaaggaaaacacatcaaaattattctttgatttcaactttccaaggaaaaattattttcaggtactaagtttgtctgcattgcaaaggagtgattttgtaatttccagaactgtcatcctttgttccactgttgtccttcacccagtatgctctctggggggttttaggagattgcacaccaggagcgctgggcacaatggcactgaagtcttgcagtgcaggaagcctcagcaatcaattcccacgctttccaggtggtgctgtttggttccattcacattaacttttcagctttctatgtgaagaaagcctccagatagtgaagagggagggagagcaataagaccagtgattacaaatccatcactttcattgttccagagccagtagcagaacacagctgatagacaaagcactggttttgttcaataattaggttgtttcttagaggagaatatgaagccttttcaatattttactctttttagaaaatatgtatattgtatcaaacattgtgtagcacacaatagaaatggaggttttaatagtagtccttattgtgaacatcaaatattaaaggcagttttgattagatttggggaagaatcagctctactgcatgcataaagccaaaatatgtgggacactggtccacctgagaagcaaggtagatatttcccaaattaagggtaattcaggagaggtattactattgcgtacacttataaaatatactcaaaatttgggcaaagataagaaaaggatttttaggcatatgggtatgtgtatgtctttctgaaaaaaaaaaaactaaaattttaagaatgctatcataatgatatacaagtaaaatagtctggatgtgaatacatccgggtcttttcaagatggtccttgccaggattttgttgaaatattattttcatgctatcaaacgtcctaagtaaatgtcattgtggtttctttatttactttttgggcccctactttctcaccgtatttccaccaagtctgacaccatgttagctgtaagtggggcaaagagatattataaaacattcttcagtgattagagacataaaaactataaaaaataatgtgttactttgtaaatagaattcaaattagaatttaaccttcaaaatatttttttttggaaagtgatgagaaaacactgcatctatatggaagccgtgcagtataacagaaaatgtcctgttgtataaggatggaacacagaatttatttccacaactatcactggctcctaagacattaaagctagtcacttaatttctggtgtctatcaatcagttcttaaaaatggaaacaatgatgcaaattcataacaagagatcatacaaatattgggatgataaataatatgtgactgtattttagttgcccagtatgccattttgtgattatttttcagaaaggattcattcctgaaagggaattacagaaaataagcactattggtgtgtactgtattattagatatttttacacaaaccattatgttgaactcagaataaaaggcatattttaactggacatagagccttgatttgttctaataaaaccctaatttgcccaagttttatcagtaaccatggttcccacatagtactcatggaggtggccatggtttttattttctaataagactcactgtggtacaaggtctgactcagagcttttcctaggaatataaaaaggataaataaaaatgtaaaagaaaaattatcaaactgtcccttgataactaaatggttgatcataaattggagtgtctatgcaaatgaagtaaataattaaaatctccaagaacagcattgactaggtggttgatgactggcaattataaaagctgaatttttaatatgcatacatccaaggagccagtaaaaattagctcccagactaatggacttgcctttcttccgaagcagaattttaatgagagcattatttataacggagagcccaagaaccagggtattcttgcttagtctcatttttttttccctgacaccttatccattaaactatgaacttctttacagaagaataatactttattccctaagaagtaaaggtcaaaatgacctcagaaattcgttgcattatatatactctaaagacatgccacttaggacaaaagaaatcataaagcctgtgtttctaaatacccaagttgtatatgcttttaaaatatatttcataagatcaaattacattccatatagttttgcccttccacaaattttctgtgtgattatttcctacataagataaaatgcaaaatctttgaaggacacttaaatctttttgcatatatttttataaggcttgagaatggttttaatcattccgatacgtgtatattgttaagctgctaatttctttgaggccattgaaagggtttaatttttccctagaaacaccattttgttattggcagtctgtgttataaacatcacagagtttaggttgccactttcctttttgatatttcaaccggagcgatgtctggttttgctttcatgactctttcccccacagttgtaactaagcaaggactgtttggcagatagcatctaaggagattttattgtctgggtgacagctcccttaaactatgagtcaggcaaaagcctggtccaaggatgagtcagagagtggtttactcagagctgccttaaacagaaagtcactagttcccatccaattctatcccttcaccctcattccagtgccaacctaaaatcatatgaccaagggagatgggtggtaaaagcattatcaggaggaacatgataaatgaggtctcattagtctaagcttgttcccttctgtcacctttttttttgttgtttttaagccctcagtattttagaaacttctatatctactcatatatactgaagaacctaaattttctaaaaaaaatcatagattttattaaaaatctcagaatgtaggtacctttctaatgtccaatatcagatagacaacagacaaatgcttaggataattaggttctttatatcaaccaaggcaaggccaggagcttctcactgagactctttgttcaataaactggagattgtaactttggttaataacattgaattgtgagtatagttaagtttatttttatatgtgttttggcaattttgtgtttcttctcttttttaattgcctatttttatcctttgcacattttcctcttggggaatttttttttttttctgattggtttgaaatacctctttgtgcattaagaccatgagttttttccttgcaacaagtatttttcaagtttgttatttgccttttaatttttatacttgtaatgcataagtatgtttatgcttctgtgtgatcaaatatacctatactttccctaatgttttatttcttatttttatatttagaaaagatgcccctactctgataccagatgaatatttacttatctttttctgtaattcttgtttgtttacaacaaatgtaattcattttggcatatggtatggagtagatctttattgttttccaaatactaagccagttgtccaaaggctacttatcaaatgtcattctttctccactgctttgaattatgtgatttataacatagatcttcgtagctttaatatatacaaaagcaattttttttctagtcggttccagccatttatttgttttactccagtattaggaatattttactatttctagaaaactggaatatttcctcacctagtaagtattgttttttgtctttttagcatcaaatgagctgatcatatagattccctcttttgatatatcaatatactgatgtaattaagtctatattatatcagtagagtttctaacatataaccacccttgctttcttagaataaatcctacttggttatggttttattatattaacacattactaatatttttcagatttctgcatatatatagtataactgagaatgttatgcagttttctttttgatctgtcattgcccagggctttataattttttcttcttaattcataatataaattggaaaatatagtagagaaagttataaaaatatggctgagtcaactaagaaattcaatgattcaccttcatctgccctacccggaaactgtacaaataaccaaagcattataaaaatcgagaaaatctaaaggtctgcaccagtactggaaactaggaaaggagtctatccacacaaagaatattgagtagtttctgctgtatgtggtgcatataacaaatgaagacttttgtgatagataactcacaattccacatcccaagaaaatagtggagtatctcaggaatatagttatacagctaggaagatcttcaatagcatctcctgatttgaataggcaagggctcaaagcaagggcaggtctgtagatagataagatgcaaaacttctgcccaaatagtctatgctcagcacattaaatacaagtatagtcatattagctcaaaagccttcaggcagtcggacttctccctggtatggcattaaaagctataaataataaagtaattcagtaaacagtataaggcatgtagaggataagcttgagatgatcatacagaatataggagaaaaagaaaaaataatgaaaacaaccaaaggaaaaccatttgcatagatgaccgaccttgaaaaactaaggtactgatttttctatattaacccaacatgaactccaacataaaattgggagttactggtggatgtctccatgtttactgcaccaattatacagaagaggcagctgtcagtcagcctttcctatcctccttcaatttggtgttgtagattgctgaaatacactacaatgtttttgtgagtatcatctttccttcatcatcagttcccatttgttatatatatttctttggtcattgtaatcaggatctaggatgaagaacacaatttttgccttattcttttatgtctttatttacttaaggcaataacactgtaatttagttagaaacttagttcattaactcaaaagagaaattataactaattttaaactctctgagtttaggttttaaaaattagtgaaatttctcattggtttcaaaataaattaatcataaatatgtacaagctattttttaagaaacaatatcttaatcataaaagtcacaaattgaacttttttaaaagcattatttacaggaaggtgctttttttcttgctgcacttttctaaagataaatacatgacccttaacatttccagtttccagttgtcacacatctttacaaaggcaagcacaaaatttgcacctgttatatgagagaagtaaatgtcctttgagatactttgacagatacattataacaaagtaaagcaaaatttttagtctttatataaaaataaagtagaaatatctaattaaggatatgaagaaagctggtactatttctgatctttctaatgcccaaatgaatgttgtattgtttcaaagtttcaaattctattaaaaaattgctggcagatatgttcttattaaacatataacatcataccactcctacaccccgaacaatcccacccaccttgagtacaaatcattttcaaaatattgtttgtcaggaatttttcttcagctatataccatttaagaatgacactaaagggaaatactagactagggaatctgtttagggaaatctgctattgaataaaattggcatagatttaataatatgagtttgaagatagaaatgtaggtgtttgataaaaatttaggtaacagaaatgaaagcatttgaaaatagacatttaagatatttaaaaatagaatccaagatgatgtcattaaaaactgtattatcagaaaaagtagaagacaatatattttaattaggaggggtaggactttttaaaaaatgtttaaaaataaaaatgtaatgtattttaacaataggacaggacaaacatcagttttttaattaaaacccaacttggatttagtttctatagtactttagatacttgtatttccaaaataatatacagacagctactcagcatatgtgtgaatatgaacacatacaaatatattaggccatttcaatttttcatcacaaagttaaaatttctagtgacaattagtggttcattattccttttagaaaagtggctgaatataagatcaacatgaaaagataccttgcagtcctatatacttgtaacaaacaactagaaaattaaatataaagtaagataacacttaaagtagcaataaaaaatcaactacctaccaaaattggtcaacaatatggaatttctctatgctaaaaactaaaaaatattattggtggaaattttttctttttttttttttctttttttttgagacagagtcttgctctatcaccaggctggagtgcagtggcgcaatcttggctcactgcaacctccaactcccctggttcaagcgactctcctgcctcagcctcctgagtagctgggattacaggcgcccaccaccatgccagctaatttttgtatttttagtagagacggggtttcaccatgttggccaggatggtctcgatctcctgagctcatgattcacctgccccggccttccaaagtgctgggattacaggcatgagccaccacgcccggccggatattttaaaagacctaaatatatgcaggaatatttcatgtctgtgcattggaagaactcaatagcataaagatgtcaattcttctcaaattgatctataaatttagtgaaataccaaataaaacattccagcagtttcttttatagaaagacaagtgattctaaaattcttatggcaatacaaagggtcagggatagtacagacaagctttaaaaagaacagagttggaaaacttacactaccagatatcaagacctactataagtcttactttaataatgacatggtgatattggctcaaaaatagacaagtagagtaatggaacaaaatagaaggcctaaaactgagacccatataaatgttgccaccacttcaacagaagttacactgtaattgcaatggattgaatgtttgtgtcccttctaaaattgatatgttgaaatcctaatgcccaatgtgacattattaggagtgaggctattgggaggtaattaggtcatcagggtgcacctacatccacgcaaatcatattagtgcccttaaaatggaacacaagggagttctctcactctctgctatgtgagaataaaatgagaaaacagctatgtgtgatccagaagagggccctcaccagaacccaaccatgctagcactctgatcttagactgccagcctccagaactgtgagaaataaatttctatgttcatgaaccactaagtctatggtattctgtcacggaaatctcaactaagacataaatacaatggaagagaggttgtttttatgaatgatataggatcaatttcatattcatatgacaagtaataaactattgctccaaacttatacaatacacaggaattaatcctagataaactatataccttaaagtgaagtgcaaagcaataatttttaaagaagataatggaagggaatagtctaatcatctttgacttttgggtatgtgaggatttattaaatgggccacaacatgtattattactgaaagagaagatagaaacactttcaattatcaaaatcaagaaattccattcattaacgccattatgaactgaaaagacaaccagagtgggagaaaatacctgaaaaaaagctagggtacagaaatatgaagcactcctgtaagtcataataaaaagacagttttcaattaaaaaacaggcaagagatttgaacagtacatatacaaaaaatattcaaaggactaataaatatattaaaaggcattaaacatcattagtcatcaaggaaatgtcctttgaaaacacaatgagataccactataaacgcaataaaatgccccaaagtaaaacagcagataacgcaaactgttagcaaggatgcagagtgggaaaagaatattaataatagcattattttcaatagtcaaaacctacaacaactttaaatttccatcaacagtagagtcagtaaataaatggcatagcttcatacgttgaaataccatatacaatgaaaaataatgaaatactgccacacaaaacaattgaattttataatcttttaaacattataatcttttaaacataggagtgcttcatatttctgtaccctagcttttttttttcaggtattttctcccactctggttgtctttccagttcataatggcgttagtgaatggaatttcttgattttgataattgaaagtgtttctatcttctctttcagtaataatacattttgtggcccatttaataaatcctcacatacccaaaagtcaaagatgattagactattcccttccattattgtacattaattatgtacaatagtacataattaataccatttatgtaaaattaaaaactttattgataaaaatcaaaatagtgtttactttatggggagatagttattgagaaagggcatgaaggaggcttctggacgccgtaatgatctacaagtcaacttaggtattttcacttgacataaactcaccaacttaaacgcttgtgatttcagcactttgctgtaagtatgttatatactccaacaaaaatgttttcttacaaaataaaacagaaatatgcagaagaaaaacttcatatcctcaggggaataatgaaccatacgtccttaacacagaggcgaaattccacagcagccccactcctgaagtccaaggcagggaaatacacacatgatgataattaagtgaaactgatttatttttatctcagtatacatttttgtagcgctatatgacttcatgtgttgtgcttaaggaaatgcattcttatatctaaagtaaggatgaacagattgtaaattcaagaactgtgctggagtttaagacttttttatagtaattgttaattttcttaagtaaagatttctgccttgattacaactaattagcaaataaattttctttctgtcatatccccttatatggaatcaaaaacttattaagcatatgtctatatttgaatgcatttttacatgtgaacatctcttttatatatttaaatgtatatttgacatagtagagtatatatttaaatgcagacacacacaaatacatatgcatttaagttttaaatgaatagtaaacagtgatatggataacccaaaaatcgtttctatttgaatttggaatgtcttgcatgatttttgaggtatatttatcttcttgattacagcttgtttagactgatattaaaattagtctgcactacttgaagacacaacacctgatcttgaagaattatatctaaaacatattagttaacagaaagaaggtatctagggattaagtgttttacactaatattcatccagaaagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacctcttgtagttcttattatagaatgtgccttgggctgtgatcgtgagaatttaaccacaatggcatatgagttcatagtttgcttttggttgggcaaagttaataagtaagcaagggacagatcatgaggtagagagatctaggctgaaagatgataaattcactttgggatatattcagtggaaaccatcaacttgtaccctgatcaatagcaagttggatttagtgatatgagctggagacatagttcagagtcatcttatatatgatggactttggaaatggaagctttggaaatgaacccaggccgcctggaggagtgtgcagcatgagaatagaggagagcctggaatctagaagcctaagaataacaacatttaagggaggccaagaagagatttattttgcatcttataatctgatgatacagatgtcattagtttgattacatgtacaaataaacagagcaagtagagaaaaaatatttattaataataacaggcaaccacaacctccgggtacctaggggcaagaatataactgtaccttgtgagggactggagccaggaatgagaagccttcaagggatcccgagaggatgtccctcactcttgtttctgtttcaacctgaatatcttctttattcttctacaggcaggcttcatttgttcttctaaacacatgtttaaaaaagttaacactgaagattcccagttttatgtctcatctatgcaagaggccaactcaaaacaaaagtagagttaaaggccttattctcagtttttgggaaagggcattatttcagatacatatcttaaggcttttcactgattttcccagcactgctgtctccaaagtcatctagtcacttgtcctgagagtgctgagttctcccctccccttggctgcccctgtgcaggcacgttggccagccatgtgccaataattctgcctcaatgaccactttcagacttcaattaaacaccatgaaggcgggtatggaatcaggcacattgtgcagctgccaaaatatccagatgatgtaccctagaaatataggggagtttgatttccaagaagcaaacttgaactgaatcccattccttcttccctcccaggattagtcagagtcatagttttccctgcattctgcccaccaaaatcctgtatggcaaaggatataactctgtagcaacttgctgttccttttgtgtagtagccaatgcaggaatgccttattccctgtctgtccctgcctcacttctctttctctcattgcagctgctctgggcttgcatctcttaagtaaagcgtttgcacattaatccttactttagcctctcttttctggggaactcaggtgatgagaggcagcttattgcttagatgtgttcctgtgtcccctctgattctttctgcaagggagaggaaggcaaagtattcccaagaaaaagacccttccacatgcctctgtgtcttagaaggcacaggggagcttgtttccagaaaagaaggaagcattgccgttaggagagagaccccaaaaatatctgacaaagattaaaagtatagtcatcaagaattattctaggccaggtgtggtgtctcacacctgtaatcccagcactttggtaggttgaggcaggaggattgcttgagtccaggagtttgagaccagcttggacaacatagtgaaaccccatatctacaaataataaaataaaaattggctgggcatggtggcgcactcctagagtcccagctattctggagggtgaggtggaaggatttcttgagcctaggaggtcgacgctgaagtgagccgagatcacaccactgtaagagcctgtctcaaaaaaaaaaaaaaaaaaaaatctgttatttattgctccttttctgtgtgtctcttaattgcaattatcaatgcttttattttacttttctctttaaacagttcaatgaatttgattagatgagttattactataaatatagtatatttctgtgaaaaaataaccctttgaggaaatttattataattgatcacttctgaagagtgaggaaatgacatgataaatatctttaggggttgttgttttcagagtatttctctatgaaattaagaaacaaaaccttcaaatgtaattctacgcccttatcaaaatgatttccttacaaggaatattttggatttccagaaaccatacaatcactaattcagtttaattcactaaggtaaagtagggaagatactgcactattgcccttcctgcagtagaaaaaggcagcaacaaccaacgagaagctgggttagcgcttggtaacagtcttggtgtgatctgtggaatacacgtttaggtctttcatggcacctcagaatctctgcccttccattgcttgttctaagcctaaggtacatctaagatagtcaagagaaaagatcatcatagcaagatagaaagacatgacatacttcaaaattagctctcccaaccactgagaaaaaaagaaaaatcactaacttttctctacttcccacctcaccatcagaaggcagtgtttagctttctacctttcctttttatgcattcagcaagttgtataaagcttatgatatgtagggcaccatttaagaactataaatatgaactaaattatatatcaatgccctcgagaatagtaattttcacaatctggtaaagaaaagaaatctctttgtttgaataatttgttgtgttctgaattcatgatatttaaaaagctaaattttgctacagttaaaatgttttcttatttatagcaattcttaaataagccatgttagaaagtttggattccagagaaggcattaatgcaaaaacttaatcatcatgttaaaattcccaacaaatttcaagcaatacctagaacctggcaattcctattgaaatggcagtgcttagggcaaattggaaagccagctaagaagttttctaccggcaagatgaaagataatgtgggaccaataatataaatcattggcttggaccacctattttattaattgccttattttagaagtcagatttttgtctcagaagaatctgggaatgggagacaagagaaaagacactgactttttaagtgtcttcccaaccccaggtttttgtccttgtttagaagagaaaagagaatttcaaaaacaaaactaatttttattattttaagcagctatttaggtctctaaatagaagccaaatagggtagatgaaggaatgtggactctgcagtcagtcaaattggatttgatatctactttttatcattcttcactgaataaatgtggacaatttacttaacctctgttaagacaaacctaacagaaatatctcagtttgtccatccttaaaagggtcatgataaatatttatgttaatttgtaagaattcaattatatcacttaataaatgacacatacagggcagctggcatacagtaaacaaaagtgaggctgagaattcattggcagcagaattatctgaagacttgagacattaaaaccatcaacaaactcagtaagagactctagtcccagaaatttctcaaataacaagttctataaaacaagatccatttgaaaaattctaaccacattaaggccaggcacggtggctcacgcctgtaatcccagcactttgggaggccgaggcaggcggatcacaaggtcaggagatcaagaccatcctggctaacgcggtgaaaccccatctctactaaaaatacaaaaaaaaaaaaaaaattagccgggcgtggtggtgggcgcctgtagtcccagctactcgggaggctgaggtaggagaatggcgtgaacctgggaggcagagcttgcagtgagctgagatcacgcctctgcactccagcctgggcgacagagcgagactctgtctcaaaaaaaaaaaaaaattaaaataaaataaaaagaaaaaagaaaaattctaaccacattaaagctattttaaatattttatgaataacttagggtaacaatattttaattgtctaatttattagccgaaatcttcaagacacaagcttttcagactaaagtacccaatcaaaacaaacataacctttacttaacacctgtttttgtaattgcaagtttctttaaccagaatcacatggttctcaaatcagactgaacaggaaggcttataaaaatacagatatacagatggagagtcagccccagagttttcaattgaataggtgtgggatgtaagtttttcaagttctcaggtgatgttgatatgcctgatccagaaaccacactttgagaaccactgaataagaaaatagtatctcagatgctttcacatacagggctatatattaatgtaaaataaacatggacatatattatgtacataaaaatataatattagaatttaaatataatatatattacatttaacatatatatatgctatccaattatctcttttgcttcactgaaaaccataattcaactgagatatctaagtaacatacttccagaagtaggatcataccaagactccaagccgcattagccaaattttacctaacaacaaaatctctgttgttggttgaattgtgttcccccaaaagatatgttcaaatcctaacccccaattacttatctctgttttcagtggtacagaattgggaataatgacactctattgggtgtttgcagatgtaattacttaagattagatcatactgaagtagggggagccctaattcaatatgactgatgctctcataaaaagaagaagggacagggacagagagagagaatgccatataaagacagaggccgagattgtaatgctgcatctacaagccaacaaccgtcaaggactgccagccgtcaccagaaactaacagagagacataacattctccctcagagacctcacaacatagcacacaccttgatctcagacttgtagtctccactactgggagaaaattcatttctgttgttttatgccacccagtttgtgatgttttgttatgacagccctaggaaactaataatgcccttcttcccccagtacctgatgattctgtctgcctctaaaatttgcctcacattgcaacattttttagtgctctctcctactcattgtatttttttttttcatccttaggagggtttctttaaagaaggagaggattcagggaaagagggtggggcaaattgtgaccatctctgcctaaatcattagaactcaagagagctggggccaccatggagacacttctggccacttccttctgattccacatcaagttcctcaggctctgggccctgttttaattgtcggcctgtggctttgatatcctcttcttatgtctttttggcactaaaccttgcctttcttcctggctcttcttgcccctcgcttttggcttggatacctctgccatgtcctgcagctggatcgaggaaaacgttccacttgcccttcatttctggctcctactgctctaatttacccagttcttctctgactatccctgagtccactcttaacaatataacaatctcctcacccaagaggtccactcaactctgtttttccataaataaatttctcctcatcaatcttctttcattaaataaaatgtgtctgaaacccaaagacacaagatcttttaccttctcctccacttcttactgtctcatgacttttgggaacctgatacgttgactcttaatactactttagttatactgccatttttaggatatgattgccctgcttctgctcagtaatctccactatttttgatgtctacttctgccctcttctcttccttgtcctatccatctttctgtcttcaggacagcatgacccattcatcactgtcacactgttcgtcttttcatcattgccagatacagtggttctcaactctggctgcacattagaattacctggaaagctttaaaaaactagttctccgatggctttaccttcagatattctaatttaatgggagaaggccttaacatcacatttcttaaaaatcatttatttgcctggtaataatcactggcctaccattatgctcaacagattcaacctttatgatatttttcttacttcctagcctcatagttcttcactttcaatgttaagcattgccactttgtttctcccaccccatcactcagacttgccttacaactcttgataacttgaaataactctaccatttaccaacataatcacaaactctgacactgaaataattgcagtcttctcctcacctttctcacttccagtaaataagctctaaattttttattttgaccctattttgttctttgacttttaaaaaattaccttacatgatgaatttactttcaggtctaccgaaccagacatgtggtcaaccttgtcaataatactaccatctattaggaaggagggtttattctgaatttgtcagatttccatagaggggacggaatgtgtgatttctaggatgaaagttttagaagaatacttgagacctcttgtccagggcctctcatagacacatccccaaaggagtgtgtgattggtaatcatctgactggtaagctaagggaaagaacctgtgggtatatggatcagtctttattcctctcctgagttaaggaggcagttttttttttcttatttaccaggccataagatcatttttcaactctgccaatggctatgtgggtaagccattcattcatggagaaaatacttagatttgggtttccaatctacattttctaattcagctatatccataacaagtctcgtgttctgatttctgtgtgattccagtgattttcttaccattgtttcccaacttatgagaggaagaacctcaagaacagactcaactaattaacttccattcattctgcttttgttgcatatctgacctggggatctggggatctgtcccccaacaactctttttttaaaaaataaattcaagttttattctagatttgggggtacatgtgcagatttgttacatgggtatgttgcatgaggctgacgtttggtatatgaaacttgtcactcaggtagtgagccataatacccaataggtagttgctgtatcttattagagaaatgcacaaagtcctgcttcttggatccactgtaattcttttaaactaagctagactcttattattgcatcctttttaaaattcctagtgtatgcttactattgatgtccttcctcatagcaattcctaccttttctattctactaaagctcttatactaaatccacatcaccgagactttcagtgaataacttcagctcatacagttttgagaaaaccatataacatttatactctttattttcccttcactttaaaatttattttcatccatcttctcttcctttacatgcctcccttaagaataaccattctttttccctcagtacctcttcacaagggaaagattgagattctcagtctctcccctctctaagacttcatttcatcaagtcctctcatttgtttacatctgtaacttctccttctttacaaaataatttctctgcctaagggcatggtcataacaaacaaagccaggaactaaaaacaaaatcctcaattctgttactctttgaaatgacttttttgttttcctcccttcagcacgtaatctttgaaaaaaaaatcatctagattttatgacttttttctcacaccttacaacatgaactccccctaaaccaatggaaatacctcatttataattcatcaatagaatcataaagagcctatcaacaggttttgcttttctcacattcagtctctctcctttctttcctttatccaacccaccagtgttttaggcttcagatccttgtatagatgataatatatggttgttgtcactgccccaactttatatgtacatttacaattactgacctaggctctaactcagcaggtctctcccccaatttatcagcttactctgaattccctacttcaataagtgacacacttatttcctaatgactcaggctcaaaatgtcaatgccatttcatacattcagttactaatttcttcatcattcattatgtacctgcttcttgccaaggaatattttatgtcctggggattacaaagcagaataaaacaatatctcttttcaatgagcttatattatattgaagaagaagactgacaagtaaacaaagtatgtggtaagtgctgttttagaggtagcactgaaagactgttagaagacaaagcagagagcaattcatgttgtgtgagggagttggaagaaatgcttcacagaaagcaggtgctttacttcagtctttaataagaactaggcagttaaaaatagagaaggtaagtccaagaggctggtagggcagaacttataaagtcaaagttgcgtaaagccatgagaaatttggtttgactggaatataaaagcaaaagaaagtaggacgaacaagagtgagtcaaaagacttataattagccaggcatggtggtgccttcctgtagtcccagctgctcgagaggctgaggcgggagaatcacttgaacccaggagacggaggctgcggtgatccaagatctgacatcaagccaatgcactccagcctggttgacagagggagattccacctcaaaaaaaaaaaaaaagaaagaaagaaagaaagaaaaagaagaaaagagagttatcatgaaagtctccatatgttggtatggagttagtgatcaaaattgcttttagggcaatggtcctagcaacaacatggagtgagaaaaatacaaaactttgattatacttcctcaaattcccaaatataaaatcatctgttacatcttgcaaatgtgtcctttacactgcctttaaaaatttttcccctactgtttatattccactcctcccattctggtttagtagctcattacctttcctttgaacatccagactacaaagagaacaattccaatcatgccattcacatagtcataagctgtccaggacacttcactgtctaccacactgaaggtcagttattcatcatgatgttgaaggcttttcacagtgacatagctatctaattatctgctaatatgaagtggacatggtcagtgtcacaaacagcacttttgcgtgatatttatacgtggcagaagcttttcctcccctacatctttgatttgtgtttctttaataccttgaacaccatcttcgccctctgccttttgaaagcctgtccatccttaaaaattgattttaaaatacatctccttttgagattaaaattttaaattactccgaacatatgtgattgtttctttatgctttcatgaaacattgtactttttatatgtgacttaaaaatttatctgatgcagccatcacaccacttattctcatacagcgtaaacttctgacagtgacactgcatgactctggctttcattttctttcatttcatttcaaaatattgccttgcacaaaactgtattaattaaggttgttaccaattccagaggttactacttgtctttttcttcgaaacttcatagttcaagataactatatgtttagtcatgataatttattatgtaccaagcaagaagtaagcaccttaaaaactatcctcagttgctgatatggtctggctctgtgtccccatgcaaatctcatcatgaattgtaatccgaattgtaatccccatgtgttgggggagggaccttatggaggtgatgagatcatggaggcagtccccctgtgctgttctggtgatagtgagtgagttctcatgagatctgatggttttataagaggcatttcctcccttattccctctcttgctgccttgtgaagagatgccttccaccgtgattatgtttcctgaggcctccccagccatgtggaactatgaacaattaaacctctttcctttataaattacccagtctccagaagttctttatagaagcatgagaacagactaatacagttgcctatattttcgatgtctcctccctactctactgcccctagaaagcattaaaaacaagcaaattggatcaatcacatttcaaacttcatgctcagaaagtgtcttcaggcactattgtactgtatgagaaaaaataaagttactttcagtgaaagaattggcatttttaactttgcaatgcccaatgaacaacatgattttgttctattttttactgctcaactcattgatgtcaagtagttactaccagattcaaagagagacactttacctcaaactgcagtgtttacactttcttgtgatttttcattcttagattctattatgtggtttcttcactcctttactcagttctgtcttgatatatcagagcctcaggcactgtactaatatatatcctaaatatttttcttgattccattatataaaggctcccattcttgcaacaaaatgataatggtgagaaataaagagttaaatgcagatttttttgctatcttaactttaaggacgctatataataatgtagaaaaaatgtacagacacacatatagtgaccaaataaaagtaaggtgttattatgtaaaaaagtgatggataccattcaattcttcattttttacccctacttaacatgacaataaactattagcaaacatggaaaattgattatgatatggattatgttaattcagtcattcagcaaatatttattaagtattcattatgtcccaggaaactgtgcaagttcttaaaggtatatagataagaatatatagacatttttctaaaagatgtcacatgataataaatgtaaatcagcaaaggaaagagtggaggtgggaagaaattgagaagtaatgtatgttgggaattataggtgattattcttaagtaccaaaaagagacagaaagccagaggagatgagaacctaattcctattcaacagcaggaattaaccagggaattaaaagaaacttccagttataagcttgaaaatgggagtcaaaaattacagcataagtaaaatttagtgtgccaaccagacactgggtgctatagacaaaaaaatatctagacaaatcttgcccttttttggaagctgaataaaaataaaacacatatggaggcaatgaacaggaagaacatctagaagatctagaagaaaaatactaaaaatagtattctgcacaaattagaaaaataaattaaaaaataaatgatgccatcaagaatatccaaaggacatttactttaaaagacctgatatgtaaacagaaaagtatgaaaaaatgcagtgtgaaaaggaagaggaatacaattaaaaataaattgaaaggttattaactatgtaatagcagatctgatacaacagcaaaggaatcgctatgtggaagattattttacagaccttttccagggagtggaggaagaggatggaagcactcacattgtgcaaaggaacaaaaatattggaaaaaaaaattagataaaagatggctgttatggaagtctgtaaacaaagagccatcaccgagatgaatggtattctgaagaaagtgcaaccatacctattcccaatcttacttaacatctgcatatgcagtttgaaagagctcatcagatacaggtgaaaaaaaccacactgaagcctgttccacaaagttgggcacctgctcccagcactcacagaactatgtttattctaatagatacattctagaaggacattttaattgaaagaataaagaaaaatgtacaagcttacaggaaaaaaactacattagccatactaaacaataaacaattcacttccaaaatatgaaaggccagggcacaacaaagacagatgcctgacaaaatatcactcaatattttttgaaagaataatattctagaaaattataaattaataaaattgaaaaatcagaaaacaagtagaaaacttgaatagaaccataccctggggaaaaaaattgaaacagctgaaaagatctaacctctaaaacagatgctgggaccagatggctttatgaatgagtcctctcacccgttaagtgacccaataatgccaatactgtttaaactattccaggatctgaaaaatagaaagatagcctgctcactgtataaagctagtataacaatgatactaaaatatgggaaagaaaatgaaagaagtaaaaatggcacaccaatttcactttggtatatagatgtaaaaataatataatatttgcaaacttaaatcctgcagtatattgaaataacatcagaatcaagcatattaaagaataagtaatagattcaaaatagagaatatattaatatgctctgtatctattccattcccaccttctcaaacacttcgactgtagagtcctttatggcagagtgggacagaggttgtttttttgggcactgctgggtcttctgtgcctatcccagtatcttgccagagtaatcaataaatctctctcagtatgtggaaaattgaatggagaggttgttggaggctgaggggaggcatttgtaatagatacaagtaaagtttagcaaattaaaaattgataaatttcctcaacagggtatttttacattatgtaccaaaagccttagaaattcacaatttctgagctagtaacccatcttctgagaatttattctcaagaaatggtaaagatcatgtacaaacactttcatcattctccttgtttattatacaagattttcccctgactttcctttaaatgatgcaggttttcacaatacatgcttcggacctttctctacagtgtttctaagcctctttatcctggctcatagtttaaattaccatctctcaccgatgatctacaaattttgcctctcattctaacctatattccaagtccagaacactatatgtaacaacatttttagcatcctcccgcccccttggttgtttcaaagacatcttagcacagtatttacaatattgaatttatgatcttctctcccaaagtttgccattctctgaggttctctaagaaattccatccagttcttcaaatttagaagtcatcactaaaatttcaatccatgaccctccctaaatccatccataaatccctttaccatattttattgatataatattctaaatatttactaaatatcaacttctctttaagacctctactacttctatccaatgtcaagttaatgagtgtctgctccctgggcaactaactagactctgtacacatatgcctgccattctaatacactgtttacactgctatcctagagattcaattttttaatgaggaatatattcattgataacatatctatacacaggaataagcttgtacaaataataaaatactcatctatatacaaatcaataaaagcttttgcaaaagagatatatggagatatgaagtgtgatgatggtgataaaggagaatgaacaaagagaaagaagtggaagaggaagataaagatgaagacgaagaaaaaaagaagaatgataataagaacaagtataagaaagacttttaaaataaaataattatctacaaataattttaaacactaaaaaagatgaaagaacagcaatattcaatttcttcgcaaactctgagaagctcaacaagtctttcaaaagcaaccactaccggaaaatagactgtgacgatcagatgtagtgcctcagagagaggcaccttcactgtatgtcattaatacgtctcaatcacagtgtcaagggtcaaagaaagaaagagtaaaatatgaactggtccaagcagaagatagaaccaataaaccaaccaaataaaataatgggctattgtgacatggatttagcaccagcagttgcttgtatataaaatattcccctcaaccccaattttctttgcatactttattccttcttcttcagatctcagctcaaatataattttcttactaaagctttgcatgagttccaaaccccatgtaacattgtttcgaatatcctgattttactttcttagtgtttatcacagtgattatttgcagacattttattaaagtctgtttcttcctcattagtctttgcgtcctttgagagtaaaaatatatactcatataaacacagggcctatagagtgccttaaaggcattctataaatatctgttgatgagattaataaacaaaaaatgagaacaaataaatgaacaatccaaaatctcgccatactggattattacttttagtttagtttctgagtttaagtctgtcttgaggtcataaaatgttggctacaattaaatgtttcatgtgtgataaaaatagaaaaaggaaatctgtgatacataaaaacaaaatccaagtttctccctctattccctacttcaatcccactgagctaaccagtgctaattaacaacatgtgtataaattcttccattcctttttccttgttcataataataataatagctgatatttatggagtacttattatatcccaagatttgttctaagcattttacattattatttcatttatttctcaaaaatctgtaataaaactactaatactactccattttgcagatggaaacactgaagtatgaagatatttagcaacttaccaagctgggaaagtcacacagctggtcagaaacagagccagtattcaaataaatactcagatgatttggcaccagagtcctctgtgactttatgctgggtctttctcaatgtacacactaacttgctgtatatacctgcataacaatgtactgagaagcattcaatcagtaatgtgtttacaaagctgttagaaccacgcctggcatatagtaaacacttattcagtgtatgcaattattgctataatgtttatttgttttaatgagatataatcttgctatacattagtctataacttgcttgtattacttagcataagtattggatattctctcttgttttctagtttacttatgcatttaaatatgtctgtacacacatagaaatcattttacataaataggttcctgtatgcttagaatctcctgtttcctacaattcctatcttcttccctttatccactctaatgaacatattaacaacctgatcataatgtgttttatgaaatattattattaatccaactgtacctccaaattcaacagaaaagaaaaaacatttccaagaacaacagcaaaaatcccacaaacacacttccagacaaggtcctttggtcattgtacaatacaatacctacttctgtgcattttgctttacttgttcaaatgtatctgatagaaataactcaaaatcaatcaataggattctattttattattttattgactatatagtaggcaaaggagtaagagtttatgtcaaaattattttcttgatgagcagtcacttcatttccaggtttttgccaccataaatggtgctgcaaaaacatactcagatataaatttacacatgctgcttttattgcaaggttaaggagcacatcattttaaatgttaatagatgttaccaaattgcttttccaaaaggctgtaacgattcacatttctaccatgagtaaatgaaagtactctcttccccacatgactgccaacagcaggtgaattggtagttgtcactttattttgcatttcactgactagtgagtttgaaaatcttttcatacatttattgtccatttatatttccttttatgtgaatggcctattcatatcctttgtctgtgttactatgaatatatatataaatatatatatatatatggccctttatctgtttatctgtcatctgcattgcaaaatttttaacaaatcaaattttttcctgttaccttatttattgtatcttttgccatggaaaagctttatttaaaattttgataattaacttattcatattttatacttctgccaattattaacttattgcctgtcagcttcatacccaaccttctaaactcagctctgtgatcctggagctgaaattgcaatttccatttctgtttaccagtagggtccgtgttgagctctggccacagtgggagctaagggagatggcaaggctggaggaggaagccaggacctggccttttctatgtactccttgtctacttcctgtgtgcctccagaggactcttgtgccttgattcttcatcccagcagctctttttatggcagcagctaaatcaatttcaatttttgccaaactcatagaaccattctcattgcaccctcttcagagacactaacagcacctgaggagcacctcattttagaggtttgagtttaagcccttcatctaagtcttttaagatttaataactcaaacttttatttggcccctcttccctaggtattgtagttgcttggtacagttaccacctctctgatcctttagttctctcttttaacactttcagctacctagttagtaattttatatatataatagttgtatcttaaattatatgttttggaataaatgatgtggtttctcttcaacagtgatataataattcataaattaagttgggttatttgtattttcttaggaagtaatctatttgctctggattttcaactttattgccatagtaatgcttgtattttcttattttatatgctattccttctatacattttatttaatctcttctatcattctaatgtatatatatatatttcacttgattaaaataactggattatctatattattggttttgtgggtgcatatgtgtatatatgtgtgtgtatgtatatgtgtatgttgtgtgtccatgtatgtgtatgtatctttgtgtgtatgtgattgtgtactcatgcacgcgtgtctatgggttgatgtttgtgtatgtatatgtgtggggttttttaacagccatatagcacagcataatgataaaaacattttgtagttgttaagagagtatagctattaacttaatgctctagtgcagaattcaccaaactttttctataaaaggctagttttgcaggcctatagtctttgtctcaacaaattaactctgcgattgtaataccaaagcatccataaacaatatataaatggcatgctctggggtcactctctatttgaatctttgccctctatcccatgactttgcccaactaacttaccttttagtgtctatatctcatcttaaatatcaccttcactaggagcattccatgtttctctactggatccttattatttaaggtgtggtctgtgcacaaggaacgaccatatcacctgggagcttatgagaaattcagaatcttgggctccatgcagtagtgtgtcagagttggttcacactgatttgtgaaagcagaatacgcacaactcttcccaaatcagagttcagtgacattgagttggtagcttgaaattgtccacggagggaatatttataccatggcagtttgcaaatgctacaaatgagagtgttttatttaagaaaacaaaaaaaccttgtttcttgcagagcattggcttaccccagacctactgaattggaatctgcattttaataagatctccagggcatttatattaatattaacattaaaatttgagaagcactgcagtagatcattttttcccaaagtacatgttagaatcacatggcatgctaattaaaatacaaagtcctgaaactcatgtgtacatagattcagaacctctttaagtggagcctcagaaatcctttttctgtaaaaatatgcgttataaacaagctttctgcttggttcttaggcaccctaaaatttgacaattattgttctacaatatctgtgcccagggcatgctttgttttctaatttataatagagcagaactgtagaatcataaagaattattcccaggccttgagacctactcacagaacttacacaatttgtatggctgaattttggaattattatggactaatgacccttttatgccttcattttcctccttttagaacaggaatgtatacagttgttattctgtgcctgcccaacaatgtatatttggtaatatggggtagatgatttgtctattttagtttcacaggtctacagatagagaggaatggaatttaaggagctacacttaaactacgtcccaggtgcatcatccacacctggatctagttaggtagccggtttctggacgtcagatcgttgccaattggatgaaacttttgagaggacttggggaggggctgcatgtgggaggactgcttaaggactttctaagttccctcatttgcttaatgatggtttcagaatcatcagggttggagtgtggggaggatgatgaggtggaaggaactcaaaagttcttagcacattggaaatctagctcagcactttgtaaaataaccatatttttaaagccaacccccttcatagcgtttatcaaagtccctacattgctggggatctcacatgtgtaattcacctcttgagaattgtgtgtttctctggccggttgttttttatcttttttccctagctcatcacatataacagagaaagcagacacacacagaaacccccccagaaaccttttctccagttcaactactaaccctttcatatgctccacatggaaaaagagcttcaaattaatcacacgtgtctatcatacacggtgactggtgttcactttggagtgtggactctgttgttgtcaggcttagctcaaactttggatttaaatatgctattaactctagtagtgtatttgacacttagttaattttaaggaaatatttgttgagcgaaggaaagccacctattataaaactgagaatattttatatttcagggtttttcctttctgaatatgtgttttcatcctattttaccaatgatcttaaaaattcatgtattatagaaaaaaatgaaaacttgtattggcttcataatttgggaagtaaatactatcatataaaatatagatccttaatgtgcataaagtttcagttatgcaagatgaaaaagttttggagatctgttgtacaacattgtattatggtaaacaatatacagtagagttaaacatttgttaagatagtacatctcttgtgctttttaaccacaataaaatatttacaacccctcagaaaccttggaaaaatgactgtttctatgggggaaaataaaaccctattaaaaataataatagtatatatatcctaaagcaggcagtaaagtcaataataatgtaaaacaattttctgaatttgggaaaattgaattatagaatgtaatggtgagaataattaattgaatatataatagaaaaagaagtatttaaattttgactctatttgctctgagatttcattcttattccctttggcttatcaggggcaagtgagattgactctgaactttaatatttatttgtattggtatattagtgtttccctctgccattatactatatttcctttgcattatttccagtgaattttatgatgctggtagttttacatagagaggttggtttttttaatgcaaaaaaaaaatgtagaatttttttcaaggaaaatgtaattctgccaagtactttggttcatttgatgctgcctgtttaactctgttcggctcaatcactgtgttggacatattgtgacaaaggctcattttcatcaaaaggaatccccagagggtttgctgcttcaatgaaagggaattcattaaatatagtctaatgtaaggtgattggaatatatatattccgatacacatatgtatataattgcattttagtcagttcttatgctactgggagcgtttttttaaacactcacttctaaatgaagaatgctgcatgaaagctttttctctttctgaaaaacagctggtttcttcagcaattcaacctagaacaaagaaataaaaaatactacatgctaaagcagatccgcagtaaaaattttgtagaggcaaggcaaagtaacattaataaatgaagctaattaggcttgatttgcatatttaactcatcttaattacacaaggattcagcaaacattttaaaagctgcaatcaatctttcacagatatggttagttatttacatgaaataacaaaaactaggagctttgttaatgattactctgtttctaatttatatgccagtgagatcatttcagtattaataatggaatatattttttaacaacctgtaaacccataaggttaaaattccaaagaattttttcacaaatatgtttttgagaatttccagaatatatgaaatgttatataaattgctctattgtattaaaatgttttaccttgttcaaataaaaaaagatctttataaaattcttttgacattaatttttaaacttggaaactaaggtagtagccataatagagacaagcagaatatagtaggtgataagtaggagaattttttcttgcagctggcataaactttaattctgctcacccttggatacaatttgctttctcatctttaatagtacttttgactggtcacagaatttgaaattaaatagggggcataatgacacaatatgattctttttaatttcagtgttttatttagataaattattttgtaaaaatatacgcaggaatgctgtctctgtgttgtgatgtgaggggctggcaggtgcacttgaagtggctaagtacagaaggttctgtggacaagaacgcaacagtgcacaaaactttatgctgtgcagctgtcagatggttgtgacattccattattagggctccatttcttagatttttctctccatgagtgtccttttataacatcaaaaatcttgacccttttgcttaaattaccttgaaagggtggaggtcatgtggttaggaaaggacagctggtgaagggtgcatttaccaaacttgcaatgtgtgtgtgtgtgcgtgtgtgtgcattagtttaaaaatatgtattaaatgcttcccacgtgctaattcatcgttgtggttataattatgaagtgataaagacggtacactaaatgtcatctctgctatcatagagcttgcaatctgcatattatgactatgtaattgttaacatttattgagtacttgctttgtcacgggcagcaatcaaagcactttacaccaattcacttgttaaatccccaaaatggcactatcatgtagatactatattatttctattttacagatgagaaaactgaggcttagagtgttccaagggcacagtaagcagcaaagcccaaattcagacccaagtagtttcgctccagacactgtgcttttaatcattacattatatgcttgtatgatatccaagtctgtttagatatgtattcaaatatgtaaaatatacaacttttcattttgagactgcatataagcccaaaatatattcatgcaatataggtacaatacaataaatagtataaaataatgtcacagtttaccttttgcaaccagttaatgttctaatggctattgtattcctaagacattttatgagtagtagaataaagatatctgtagctctttgcaaggggttgaattgtgtccccttaaatccatatgttgatgtcttaatcctcagtatcttggaaggtgactgtatttggagataaggtctataaagagataattaaaattaaatgaagtcatcaggttgggcccaaatgcaatatgactagtgtcctcataaagagattaggacacagatagacacagatgaaaggccatatgaacatatagggggatgacagccatctacaagccaagtggaaggactcataatgaagccaaccctgcctacactttgagcttggatttctagcctctacaactgtgaagaaataaatctctttcgtttaagccacccagtctgtgccactttgttatggtagctttagcaaactagtataaacttaattgtgtctaaggatgagaacaccactcaatatctgaaaccaaaaagctgaatgtataatacacttaagtgtggaagaattatactggtcagagttacccattgagcaaatccaattgctgattttatatccagtttttgtgaagagtttactttggattgtgctggttacagaggcaggagttggttgaagtcagttttagaaaagtagcttgtattggtcaatgagactttttttttgccagttacagaagtagaaaaaagttgataatagcattagaaacatgttcactgtagtgaatcctgaaccagttggctgactttcaagtcgtgtctgttgttatttgacttttacaggagtgctcactgaagttacttgtcattgattaattagataggtttaaaacccactctgattgtttacttgtaagcagggctgtagaactgttgctaattgattagatgagtttataactagttctggtgcttgtgagcatggatagagaacactgagtcttttcctgggagagtggtgacttttaaaattctcagcagccaacaaaaattaataggtataacaaggaatagagaaaaagctacaaattaatctataaataacaatatcccttacttgtgtaggcattatgttaattgctttacataaatttctcccactgtaaatggagatttaaaatattactaatttcctatggtagagatgaaaagaattgctatacacaaagtacttagtaaagtgtttatacgaataagagatagtatcaataattttccaataagctgagttttaaactctgcaacttcactcaaatatcacattcttaaccaccacaataataataaaatgcatatatattatggtttcatttatatgaactaaggtagatacatgagacagtgaggaaaggggattgtatatgtatgaactagtccatgaaatatacaacaaacatgatttatggtagttgcctctggaggtggcctaaaatgggagactaacttttcattggagagtgttttgtaatatttgactttacaaccatatttttatatttcctttctcaataaaatatagttaataaaaattgtagggatgtttttactaagaagggcatgagagaatgttttggaatgctggaaacatttcatatcgcaatctgaataacaattacacagatatatacacagataaaaatgtattgaggtaagcccctaagatttatgcattttagtgtatgtaaattatatgtcactgatatggtttggctctgagtctccacccaaatctcatctcaaattacaatcctcataatccccatgtgtcgaggggagacctggtggaaggtgattggatcgtgggggcagtgtcccccatgctgttctcatgatagtgagtgagttaacatgagatctgatggttttataagcatctggccttttccctgcttgcacttctctcttgcctgctgccatgtaagacatgcctgcttccccttctgccatgattgtaagtttcctgaggcttccccaggaaaattaaaccttttttctctataaattacccagtctcaggtattgctttatagcagtgtgaaaatggactaatacaatcactaatataaaaattgatttaacatatcaaaaaggcattttttttgttttctctgacatttaatttatttcatttgtttaacttttaggttcaggggtacatgtgcaggtttattatataggtaaattgcatgtcacagggatttggtgtacagattatttcatcacccatgtaatacgcatagtacctgataagtagtttttcaatactcgtctttctcccaccttccaccctcatgtgggccctgatgtcttttgttcccttctttgggtctatgtgtactcaatgtttacctcccacttaaataccaaaacatgtggtatttcgttttctgttccttgttgctatgttagttcacttaagataatgacctccagctctatccatggtcctgcaaaggacatgatctcattcttttttacgcctgaatagtattcatggtgtatatgtagcactttttttcttcatccagtctaccattgatgggaatttagattgatttcatgtcattgctattattaatagtgctgcagtgaacatatgggtgcatgtgtctttatggtagaaaggcattttaaaatctagccttggaggaaaaaaaatgagtgaagtggactcacttcatatttttgtcttaaaattttttcaaaagaatatggaattcattgattaagtaagtcattataatgagaaaggaaattcataagcattagcactttaatgattttagtgataatatgcttggctacttattttatgatttaattttggcctaatttttaagagttttaaaggtttttttgtctgaaatatgacttttgatgagtattacttaatttttttttcaaattttcacatgacactattgacactaaaaagacttttactattttgagggaacaagcttaatctttatacatagggttcacggtcagtcaggctaggctagcttgtgttatggtaaaaaacaacctccaattctcacaacatgtgtgtcctgcttcagttctatgtccttcatgggttggaagatgggtgtggggcattcctgctggtcttcccagggatccaggtggatctctcagccatgaccttgaatgttgtttgtttctgccagagggaaaagggactcctggagggcatttgcacctatcattaactgctgaaaatgcgaagttgggaagagcctgagaggagtattctatgtcatttccattcaccactcttaagccagaactcattacatggtctctcataagcccatggagggttaggaggtgcgtatctacccagaaaggaggaatattggaaagatttggcaaacagcctcactcactccatcttcttgcacataaagggctaggggactttggaatcaggcaaaactggaaaagtgtcatgactctgccactttttatttgtgggttagatgccactgttttcatctctagaatgtgaattacaatagtacctatctcctagcattgctgtgaggattaaatatgataacaactgtaaaacatttagcataatgctttaggtatgtaataaacacttgatgaatgtaaagctgcatcctccacctggaatcaccatttccctatagttgtttaaaatgttaataggcaatggaaaagtcaatgggtgaatatgctcccgggttagaactacactgaagcaaaggtgttggggaataagaaagtgcacgcatttcatgtcatgactgatcagaatgaaaataaatattgagaagactaagctatttgtccaataataaagcatatctggtgagggtggttttttgtttttttttttttgcaatttcatttataatctccatgtaagtgtgcttactttttcattcaataactgtatcgtatcttaccagagatgtcttaggccttggggatgagaagacggaggagtggatgagtttgtcttgtggagcgtaattttagaggcaggagactacaataaataaggagaaaaattcatgaagtaattttgttaatgaggagtgatatgaaggaaacaaaatggggtgacctatttgtcaagtattggcatctgtgaatataattgaaccctgaaatatcagggatgtgacacagtggaagctcagttctcattcatggactacccaattgtaaggtcccgaatggcagcttttctctctgtggtggttgagaaacccaggttccttccagtttatgctgcctcatcatctagaggccttctgcgtatagcctgcaaagaacggaaaatcaggagtttggcagattatggtggatattttctaagggccaggcctatgttggacttacttcacaactgtctgtgttagcagtggaagagatcagagttaccctgatttaccgacggcaaatccataggtgtctggagcaaattcagcctttgcctgctcagaagaaagaattcgactgaggggcataaagcagaaaaagagaccgagaccggggcaagttccagaacaggaagaggagtttattttaaaaggctttagaataggaaagaaaggaaaattcgtttggaagagacctaagcgggctcatgaaggatcaagggagaaaagggagcaaaaaaagggaggcctttaaccttgttgctaggacttcatgggcttgcctctttcccatgattcttcgcgtagggtgggcttcccgcatgcgcagtgttttccttaccctttggaattgagcacaggcatgcagtgtgtttagggaggtatatgcatgcccatctgaggttttttcctttctccagtggcatgtgccccccagaatgtcatacttcaccgttttgtctcttaacacacatgcccaagaagctgcttctccctggggcctgcattcaattaacactttaatgttcacaagcgtggaccatcaggagattgtctctctctggctaatagattaaatatcatttttagagaggcaatattgtggaaccatcacccaacatttcagtgggtgatgggagaggcttctcctgcccagctcttgcctaactacctgtagcacctgcatttcactgagcagaactcagtcacatggccacgcctgacctctagtctggctgtgtgcccaggaggaaaaataaaagtgtttcatgaaacagtttctgctactctaatgactggttgtaagagagacgtcaggaaattagatctcagacagcatgaaaaaggttgtgtttgagttgaaagcagcatgggaaggataaggacatgtgtatatctagatgagaacatctgcaataaaggaaacagaaagcacaaaggcgggagcattccaggcagttagaaaacaggaaggccagtgtgacagctgtatgttcttgtatctaactgtacttagagttattatcctgacagtacaaaggagttgtctggatcagatatcaaaccatttactcagagagaagactgtttattttctattcctcaattccttatgtagggggcagggagggctgggtgagaaccgggtgtaccttgtgggtacagaaggaaaggggttatgtaccacgagaaaggaaaccccaaaccatgaaactcaattttctttcttccctctggggagtgggggttggagggagagagggaaacagagagagagagagagacagtgagagagggagggagagagagagaacattaaagaaacctttgctctgaaatctaaacaaatcttcccaaaaagaaggaaagcatcggtttgcaatccttggatgtgaaagaatgcctcagggtgagatgtccctgtatctccccaggggtctctatctttagggttgctattcagtcattctttaactcaggtgccagaactctgcttagaaagccctgaccatgaagaaatatgaaaatattcgaggaacacagtgaaaaggaagagtggtaaaggatgaggtcagatacagagacaagagccgaacaatacagggccttaagacacaggcagagagtttggagttcttttagtgcaatgataattttttggttggctgtatgcaggagcgtgacatggtctgattcagcttttgttggttgctctagtggcggtgaaggggatgactgggagtggggtggagtgggagaaggaggctcctgccatagtcagggtctgtaggatgatggcctgcccccagagtggtgatagtggcaagggatgaagctgggcagagtagggctgtattttgaagaaagacttgtagtagataagggttggggctggagtgggggaagaaaaagaggtattcttattcccaggtttttggttgccttggtttgtttgtttgagcagctggtgatgccatttatatgtataaagatttcgtgaagatcaaaatagacagttgggaagtagtaaatcaacaagtcttcttttgcttattatgtctgacgtgctgcatcagacaggtcaccagcaggaaagaggggactcacggagtaagctcaagtttaatgtttacagaggtatgggcggcattaagggagctagcacagcagccagggactcgcaacaatgggaaatcatcactgcccactaccactgtgtctgaaaggggaggggaaggaaagcattactggatgcagtgtgcaagtggccatgagaaaggatacaggagctgtggaatttggtagagaataaggccaccgacataatcacagctgaacgggaggtagcagaagtggcaatttatccattctctctttgtgcttatccatatcctacaggcgcttccctctggctgaatccaaccagagcccagaagtcctaagaacataggcaatgtagttagtagagagcctggcatagggcggggcagagccatgcggagaatgaatctgagggcaacagaacaaacagcacccatgtccacaagagctctttaagaaggcaaatagacattcaaagttggaactcagggagaagtaagggtggatatgtcaactggaaaatattcagcatttcaatagtatatgacaaatattaagagccaatatttgtcaggcccttactctgtgctaggcaacataccaacatttcctgtgcattattatctcaattaattctcctaacaaagctataggttaaatgccattatctcattgtacatatcaggcaactgaagcacagtaaagcaaagcaatttgtttaaggtcacacagctattaggtggcagatccaaaaattaaatgtggccatttctacccccagggtcagtgatagagatcattattacacacagcttctctgtctgaatcaaatgctggagcaatgcatattgggtcacattattattattttttttgtaaactcttctttcttttttattttttctccttttgaaagacaactattctgacaagaattcatcaaagaagagattccaaattttaatgtcccagtttgagtattgcttttgattaaggctgtttgcagactagaatgttagtaaccctcacattccctataccacaaaaagaggagattcacttttatcttgggaacaaagctgtgtagaaaagctttttaaacttattttaattcatgaaacatttatcttcgagtcaggttttgttatagcagcacaaatgtggtccgtcagcatttcctttataaccccatatttccagggtttttcaagagtgccatagagattctactttgaattaaaacttggcattcagaatttgaaaaaaaaagctactacacttttcattaccaattaatcaaatagtttagcgattctcaagttagaaaaggaccaaatgcaaaactttcattaatacaaaaatattttaagacaatttgctaatttatatctttgtaaaaatattaccactcagtatacaagtattaatattacatcactgtatattagttctcaaaattaaccaaaaaatttctaagataatataaaaaactatgacatcttatgctttgcctttttggctttgtaagtaatttatttctattttgagaattgggatgatttgaagttcttagcataattggtttaaagttataacagtgtcaagatactgagccataataacaaggatggttgagattctgagagagtatcaaagtgtttcaatttatttttgtgaaatttaaatttatgtggggaaattttgcactctgtgaacaaagatttgtagcatgaattgattctttaaattgatatttggaagttaacttgctgagtacaatgacgataatgaggaccaagtagagattagtttagttataaagcctttccaactttgcttggttcagagatactccatgaatggccaataacagtgaggggcatcatgatgatctacctttggtagctcattttgcaatctcttctgtaatctctcccagccttcaaagatttaaggttaaataaatacaaggtagtgaatgagagtagatgaagacttttgagtgaatctactcttctgactgacttctttccagccacactggcttccttgttgttccagaaatgtgtgaggcaaacatctacttggagacatttgctctagtttttcttcctacctggaacacttttcctccagaaaaactcccttcctatactttggctatactcccttactatactttcattggctaactcccttactatactttcattcttggctaactcccttactatactttcattcttggctaactcccttactatactttcattctttattcaaactttatcttctgggtgaagccaaactggataactctacttgataatgtgatttcccttagttcccaaatcccaaaattcctactattactaaccctgcctgacaatttcttctcttcagacttattatcttctagtacattttatgcctttatcacaaaatgcccatctcctccactagaatataaggtccgtgagaataaggttctttgtctatttgttgacatatcctaagcacctagaattgtgccgacaaatattaattactcaaaaatatttgtcgaatgaacaaatggttgaatgaaatctgaatttccaagcacatagcaagactctccaagcaatagtccacatatgactttcccttgttctacagaatttgggttatttccctacaagagtcaagaatgcccgttgaacactggtgttcaaaatgaaaggccccacatttagatatttagatccctattataatgtgttataggtccatctttcccggaaacatttaaactgaagctgggatgtttttgtagttaattttaattttagctattatttggataagttaaattgaatgaatagatgtgaagtttggttctcacaaaacaaatgcttattctgtatttaaaaatgccactgtatatattttataaatttttatacaggtaataatgttaatgctgaactgtgaaaattcaggagctaaaatgtgattctatcatttaaaaagaaaaagagagaccccactgcctacccccagcagcagtagatatgctgtgctgaaaataacagctttctaataagggagttcttaatagtctttggcctcagggcttgaaagctatgctaattgagaaatgcagccacttagtgagagtttactaccagctcagtggtgtaaaagcaacaacagtagaatttcagtgtagataccagtactatggtatgctccccgctctaggtctgtactattctgaatagtagttgatagcaaaagctagaattttctatggtgagaatgtattaattctgggaggaggggctaaaaattactttaaaacttaaaagcatctttgaattcctttttacgttccaaaagaaatttatttgactctgtttctgctttgtcttcctagggtatatgtgagcagtcactttatggtcacatgcattctatcaatgatgccatttttgatcccagggtaagttcagttctcccagtaaactgtttttaatgcttcatatatacaaattcatttttataaaacaaatttccaagctaaaatggtaagttaatgaggtgagaagaacaactttaggaattagttgtaaacaataggaaaagtctataggtatatagggttgcagaattttaaaattcacacacacacacacacacacacacacacacacacacacacccccacacacaccccaagtcgtagcaggagtgacaaggaattctactgtagtcaactttacttaaacacatttttaagagccttttgtccaatttgggcttcaaaaaaataggtgggctatagactgcataaaattttaatgaaaaatcattaaaataactataattgctctgtaatttttctgtaagaaaacctggagaagaaaaagcagttaaagaaaaaagttttctccaatttagaacagaacagctttgatttgacagctttttaattactcatggaaaagtttcaaatatgtccttcttcataaaaactgatgacaaaacaaaaatattttatctgccacttgaggtattcattcaggtgtaaggatgatttcacaaacaatgaaaattgttggagagtcctttgagttttctgtggtttgaatgtatccctccaagtttatgtgtcgcaaacttaatccccaatgcaagagtgtttggaggtggagccttataggagatgtttaggtcatgacactggcgccctccctcctgaatgggttaatgtctttgaaggaagttgaagctgcaagttcagtctttttgctctcttgctctttttcctccctccttctgttatgggatgacacagcacaaaggccttcatgaaatgatggtgccatgctctgggacttcccagcctccagaactgtgagaaataaatttattttctttaaagttatccagtttgtggttttctgtaatagcaacagaaaatggattaagacagttgccacgtgaattaaggatgtctttaaaagggttcagatagtaatcaaagaaggatgatttaagtctgttctcagatgaaagagatttgactacatagatgacctctcaggttcatttaaactctatgatttaattatatctaacattttggttgtctcaaagttcccagtagagtgagaatcttaattccaaattccacttcttttccaattagctataaaagaaatctgatggattacttacatctaacatcacaatgatagcatagtcaaaattctgttaccatcctgctagtatcattcttttagaaagaggaaaaatgctcactaaaaattatatctactaagggaatgttgattgctccaattgaaattgtgcttgtgtcattgtcaggcctgggaattttaatgatgggctcaaccaaaattacattttaatagattggtctttgtaagaaatattctatctaattttctgtagtgagccaattagttggaaagtattatagattagttctagataccaaggaatattttatttccagcagggtatggaaaaatttaagcactatggacccattatgaaatagaatatagttttatgctgaaagtccattaagtggcgtatagcttcacatgccctacaaaaattaaatgggagctgaaatgaataatattttgtaaatcaggcattttattttggcaagcaatataataactgcaaaagacagcattttacattctaaatattaaacttaataaatatggaaataagcaaattagatttattgaattagcaatcaagagagacatacattaatttcccatatttcaaagggcaagataacagatatgaggtttaggtgtccaatatcaaagtagctaattttttttattattatactttaaggtctagggtacatgtgcacaacatgcaggtttgttacataggtatacatgtgccatgttggtttcctgcatccatcaactcatcatttacattaggtacttctcctaatgctatccctcccccagcccccacccctgacaggccccagtgtgtgatgttccccaccctatgtccaagtgttctcattgttcaatcccacctatgagtgagaacatgcggtgtttggttttctgtccatgtgatagtttgctgagaatgatggtttccagcttcacccatgtccctgcaaaggacatgagctcatccttttttatggctgcatagtattccatgttgtatatgtgccacattttcttaatccagtctatgattgatggacatttgcgttggttccaagtttttgctattgtgaatagtgctgcaataaacatatgtgtgcatgcatctttagagtagcatgatttataatcctttaggtatatacccagtaatgggatggctgggtcaaatgttatttctagttctagatccttgaggaatcgccacattgtcttccaaaatggttgaactaatttacactctgaccaacagtgtaaaagcattcctatttctccacatcctctccagcatctgttgtttcctgtttaatgattgccattctaactggtgtgagatggtatctcattgtggttttgatttgcatttctctgatggccagtgatgatgagtattttttcatgtgtctgttggctgcataagtatcttcttttgagaagtgtctgttcatgtcctttgcccactttttgatgggattttttttttcctagtaaatttgtttgagttctttatagattctggatattagccctttgtcagatgggtagattgcaaaaattttctcccatcctgtaggttgcctgttcactctgatggtagtttcttttgctgtgcagaagctctttagtttaattagatcccatttgtctattctggcttttgttgccgttgcttttagtgttttagtcgtgaagttcttgcccatacctatgtcctgaatggtattccctaggttttcctctagggtttttatggttttaggtctaacattgaagtctttattccatcttgaattaatttttgtataaggtgtgaggaaaggatccagtttcagctttctacatatggctagccagttttcccagcaccacttattaaatagggactcctttccccatttcttgtttttgtcagatttgtcaaagatcagatagttgtagatgtgtgttgttatttctgagggctctgttctgttccattggtctatatctctgttttgatactagtaccatgctctgttggttactgtagccttgtagtatagtttgaagtcaggtagcgtgatgcctccagctttgttctttttgcttagcactgtcttggcaatgcaggctcttttttggttcctgaactttaaagtagtttttttccaattctttgaagaaagtcattggtagcttgatggggacggcattgaatccataaattaccttgggcagtatggtcattttcacaatattcttcctatccgtgaccatggaatattcttccatttgtttgtgtcctcttttattttgttgagcagtggtttgtagttctctttgaagaggtccttcatatcccttgtgagttggattcctaggtattttatctttttataactattgtgaatgggagctcattcatgatttggtttcctgtttgtctgttattggtgtataggaatgtttgtgatttttgcacattgattttgtatcctgagactttgctgaagttgcttatcagcttaaggagattttgggctgaggcgatggggttttctaaatatacaatcatgtcatctgcaaacagggacaattcaggagcaggttgttcagtttccatgtagttgtgtggttttgagtgagtttcttaatcctgagttctagtttgattgcactgtggtctgagagacagtttgttgtgatttctgttcttttacatttgctgaggagtgctttacttccaattatgtggtccattttagaataagtgcgatgtggtgctgagaggaatgtatattctgttgatttggggtggagagttctgtagatgcctattaggtctgcttggtgcagagctgagttcaagtcctggatatccttgttaaccttctgtctcattgatctgtctaatattgacagtggggtgttaaagtctcccattattattgtgtgggagtctaagtctttttgtgggtctcaaaggacttgctttatgaatttgggtgctcctgtaatgggtgcatatatatttaggatagttagctcttcttgtttaattgatccctttaccgttatgtaatggcttctttgtctcttttgatctttgttggtttaaagtctgttttatcaagagactaggattgcaacccctgctttttttttttttttttggctttccattttcttggtagatcttcctccatccctttattttgagcctatgtgtgtctctgcaggtgagatgggtctcctgaatacagcacactgatggctcttgattctttatcgaacttgccagtctgtctcttttaattggggcatatggcccatttacatttaaggttaatattgctatgtgtgaatttgatcctgtctttatgatgttagctggttattttgcccattaattgatgcagtttcttcatatcatcgatggtctttacaatttggcatgtttttacagtggctggtactggttgttcctttctatgtttagtgcttctttctggagctcttgtaaggcaggcccgggtggtgacaaaatctctcagcatttgcttgtctgtaaaggattttatttctccttcatttatgaagctttgtttggctggatatgaaattctggtttgcaaattcttaaaggatgttgaatattgtcccccactctcttctggcttgtaaggtttctattgagagatcctctgttagtctgatgggcttccctttgtgggttacctgacctttctctctggctgcccttaacattttttccttcatttcaaccttgatgaatctgacaattatgtgtcttggggttgctcttctcgaggagtgtctttgtggtgttctctgtatttactgaatttgaatgttgttgaatgccttgctaggttggggaagttctcctggataatgtcctgaagaaagttttccaacttggttccattttccccgtcactttcagatacaccaatcaaatgtagatttggtcttttcacatagtcccatattgtttggagactttgttcgtttctttttaactcttttttctctaaacttctcttcttgctttatttcactaattttatcttcaatcactgataccctttcttccacttgatcaaattgtctactgaagcttgtgcatgcatcatgtagttcttgtgccatggttttcagctccatcaagtcatttaaggtattctctacactgtttattctagttagccattcatctaatcttttttcaaggtttttagcttccttgtgatgggtttgaacatcctcctttagctcggagaagtttgttattaccgaccttctgaagcctacttctgccaacttgtcaaagtctttctgcatccagctttgttccattgctggtgaggagctgtgatcctttggaggagaagaggtgctctggtttatagaattttcagcttttctgctctgttttctccccatctttgtggttttatctacctttggactttgatgtcggtgacctgcagatggggttttggtgtagatgtcctttttcttgatgttgatgctattcctttctgtttgttatttttccttctgacagtcaggtccctcagctgtaggtctgttggagtttgctggaggtccactccagaccctgtttgcctgtgtatcaccagcagaggctgcagaacagcaaatattgctgcctgatccttcctctggaagctttgtcctagaggggcacccgcctgtatgaggtgtctgtcagcccctaccgggaggtgtctcccagttaggctacacaggggtcagggacccacttgaggaggcaggctgtccattctcagagctcaaatgctgtgctgggacaacgcactgctctcttcagagctgtcagacagggacgtttaagtctgcagaagttgtctgctgccttttgttcagctatgccttgcccacagaggttgagtctatagaggcagtaggccttgctttttgggcactttgtttacctactcaagcctcagcaatggtggatgcccctccccctgccaggctgaagcctcacagttggatctcagactgctgtactagcagtgagcaaggctccatgagcgtgggaccccctgccccgagccaggcacaggagagaatctccttgtctgccggttgctaagaccttcggaaaagcatagtatttgggcgggagtgtcccgtttttccaggtacagtctgtcacggcttcccttggctaggaaagggaaatcccccaaacccttgtgcttcccgggtgaggcaacacctctacctgcttcgggtggccctctgtgggctgcacccactgtccaaccagtcccagtgagatgaaccaggtacctcagttggaaatgcagaaatcacccgtcttctgcattgatcatgctgggagttgcagactggtgctgttcctatttggccatcttggaacagaactcgctaatatgtttttatttgcacactttgttcataccaaaaggactattacaatatagctccaaatcagtatcccacagcctcattaaaattttccattaattgatcttttctttgctgcaaatatttattaactactaatatttttaaaaaataatgtcttgttatgatgactgacattttttaaggaaatttttggtcacttatattaattgttttaacaattatgttttatgtcacatacctgctaagcaatgtcaggaggttgagaagcagctgtgactgcagagtgcagggactcccacaggtctcttgaggacatggcattgagacacagttcatattcaaacaaactattaaagttgtatttaaaaaatccatatgtggtacatatatagaaggcaaaaattttagttatttggtattagccttgctcattacttggtgcctttagggatagacattcatgttgcgttaccatttaaagttgcatttagctatttacataaacatagtttggggaaaattctacaatttcagatttgtaagtaggaatcacacatgtaaaactcaatgttatcaagctagcaatctagattcacagaaacaagggtaatgtcagtaagatggtggaataaaaagtaaccctcaactgggcacagtggctcatgcctgtaatcccaaaactttgggagactgaggcaggcagatcatgaggtcaggagatcgagaccatcctggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaaaaaaaaagtaaccctcctatctccgcccacaagaatcctgcacccatccacagacaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcctccataatgagttcactaacctccatttcacagcagattttgaggtgcaccagactcagttccagctccccttactacttttggggaactatgctgtctatgcaaagacctgctgggaattgcacactcacgtgggccagtgagacaggttcgtcagctgctgtcacacagcagatcctgagagggcccagaccacttgtgcaggacctgccgggaagcacacctgtatggacacagttccactgcgcagagacctgctgggaagcacacctgtgtgggccactggaaaatatttcagtcttaggttcctgctcagctttcatcaacagcctagggaccctccttaagtcttccccaggtccatctaggacagagagccatgtcatccttggaacctttgtgagattcacagcaaacctgggctgagaggttcctctagtgctaagacaacttcagtgatcacaggctcagggaacacaattagtatttttagatctctggaagacgctctgaaaaatgataggcacagtaaagccagactgtgaagactggaacaaatacccagtctttcaaaatgcagacattgtcacatgtccactattatcagtaatattcagggaaatgttaccttaccaaagagagaaaataaggcaccagacactgattttaaagtgacagggatgtgtcatctctcagacaaagaattcaaaaatagctgttttaaggatgctcctcaaacttcaaaaaatatagagaaacaattgagaaatttatcagggaaattttatagagagattgaaattttaaaaaatcaaacagaaatcctggagctgaaaaatataatgaatgaaataaaagacacagtggagagcattaacagcagaattgatcaaacagaagaaagaattagtaagcttggtgacaggctatttgaaaatacagtcagaagggaaaaagagaaaagaataaaaataaagaagttacaggatcctacaacagttgcctgtcaaagaaaagctcagaagtaggcttcactgctgaattctaccaaacatgtaaaaaaagagctaataccaatgtttctcaaactattccaaaaacttgaagaggatagagttcttactaactcatcctatgagaacagcactaccctgataccaaaaccagacaaggacccaacaacaacaacaaccaacactattggccaccattcctgatgaacatagatgcaaaaactctcaagaaaacactagcaaaccaaatccaacagcacatcgaaaagatcattcagcatcatcaaatgagatttatcccagggatgcaaggatgattcaacataggcaattcaataaatgttatatatcacattaacagaatgaaagacaaaaattatatgatcatctcattagccatgggaaaagcattcaataaaattcacaatccctttataataaaaaccctgaacaattaggtatagaagcaacataccacaacacaataaaggccatatatgagaaacctacaaacatcatactaaatagggaaaagctgaaagtttttcctctaaaatctggactaagacaaatatgcctatctttactatttctgttcaacatagcactagaagtcctagccagagcaattaggcagcaaaaagaaataacgcgcatccaaattggaaaggaggaagacaaattgtctctttttacagatgatatgatcttatatagagaaaactctacagaccccactgaaaaactgttagaactaataaattcagtaaagatggagtacacaaaatcaataaaaaatagtaacatttctatatgcaatagcaaactctccaaaaaagatatgacaaagaagcccatttacaataactacaaaaaatctagaaataagtttaaacaaaaacatgaaatgtctctgcaatgaaatctacaaaataatgatgacaggaaatagaagaggacactaataaatggaaagataccctgtgatcatggactggaagaattaatattgttaaaatatctggatcagtctcttctcacactgctataaaggactgcctgagactgaataatttataaaggaaagaggtttaattgactcacagttccacatcgttggggaggcctcaggaaacttaaaatcatggcagaaggggaatcaaacacatccttcttcacatggtggcggcagaagtgctgagcaaaagggggaaaagccccttgtaaaaccttcagatctcttgagaactcacacactatcacaagaatagcatgagggtaaccgcccccatgattaaattacttcccacccatccctcctagacatatggcgattatgggaactacaattcaagaggaaattgagaggggatacagccaaaccatatcaatgtccatactgcccaaagtgatctacaaattcagtgcaatctctatcaaaatactaatgacattctctataaaaattgaagtaaaatttcaaatctttttggaaccaaaaggctgcaaatagccaaagcaatcctgagaataaagaaaaaaactggaggtatcatactacctgacattaaaatatactacaatgctaagaaattcaaatattcttaccataaagaaatgacaagtgtttgaggtgatagatatgataattatcctgatttgagcattactcaatgtacccatgtatcaaaatatcacattgtatccataaatatgtagttacatgtcaatgaaaaacaaaatacatctttaaaaaagattcacagaaacagataggcaataaacaatatttatatatggccctgaaaaactattgaattgaattttatttgttaaattgaattttaattctcttatggtattagagctcggatgtcttaatttctccttgatttctccattggaagtagatatttattttaaacctccttttaaagtaatctgtcatgagacattttaaggaactataaaagctacttattaagtcatttttataaagcaaagccaaaaccaaaaaaggaagatgacagtaatttccagaaaattattaatagccacagaaaattcaatctaaaggaaaaaataaaaacaaaaactgtaaataatacgtggcaggaaaatgagcagggagcctcacctgacttcaaatttccaggaagttgacctaagtcttactaggatggacattccatagggccttctagaagctcttgctggacttttccatttttccttatttttattttgcattctagtctcatcttgaaattagtcatgtaaatctttgatatttatgagatataccaatatgttttattatttctttgcctataactaatttctttcttttctctccttcctgcagggtttcattttatcttgctaacgatagtctctcatagttctttcagggaaagtgtgtgggtagtaaactttttttggtctttgtatatctggaaatgtcattattttattttcattctgttatttcctctgtcactattgttgctgatgagaatcaactataaatctaatagttgatcctttgtagataaggttggatctttctcatacattttaatatcttgcatatttagcttttaatttttctatgctgtgtctacatgtagatttgcttcttttttgtttttctctggacttgatgtgtcttctcaatatgagcacttttgtctttctacaatgctggaaatttttcagccattatgttattaaatattgtgttttgtcaattctctctagtatctcttttaggaattccttttatatctctgttgaatcttctcattcacttcatgtttctttttatatttcctgtgctttactactttgtgtggcatcccaattaatttcttcccaactgtcttataaatcaatctttctttagctgaatcctgtttaattttattctttctactgagtttttctatttcaattactacatttcttatagaaatgtagtattttagattcttttcaactttgtccatccttgtttcattatgtctagtttgattttaggcatatattaatttctttttttactttttgatctataatttctataaattttgagtggcaggaatatttcttcattatcttatatttccttgtttcctagaaacctgcactagcattttcacctcaactattccaatatgaattccaaatcaaaaagttcactgaaactcttcttgagctctgtattgttgtacccaatgagtaattttcattgtcacttaaaatgttctcctctcttgagccctgagaaataaaatatccacaggcaccgcttctcaatctactgtgctggatcctactttattacttgactgctaaatattatagtgtatcaaggctcaatcttaaatcctgttatctagcagattctctttataattcatattatttaaacttgtaacttttaattttatttatatgatgatgattttcaagtaaatcccactctgacccccaaagttaccattagtcattttgcaactcagcctaaacatctgatatctcattaaaatatgttaaaaatgaaacttgctttcccataatccacactgattcctttctccattatgtcatcttaataaatattattctattcatctagatgcagaagtagaactctccgtcatagctagcaattgtcttggggatttttgtctgtttacttttttcaaaaatctctctacaccagaattcagggaaaagaaataagaaaaggatatttccaatttcattttacccaatatctccactatgtagcatagtttgttttacatatttaatattcataaaaggagatgaataaataaatgaatgctgaattcggaacaaatataagcacaaggctttcattatagcattgtatcattagatcttatttatttcaacttgattaggcttccaaattctgcggatgcttagctgcaaactaaagttatttaattatcaggacagattcgctgttccttagaaagctactgtggcatcatagtttaccatgcctttggagtctctgtacaattgtccaatttcagttatatttttctcctattggtacttttcggattctggctttgctattcataagacatatgatcttgagcaaattatttagctcatctttaaaatgagtgacaaaagaacagagaatattagataatacatacaatgtgttttaaatagtgcttagtaactagaagatggtactactgctactactgctattattattactaaagtctgaacatctctaatccaaaaatctaaactccaaaatgttccaaaatccaaaacatgacaccgtaaggtgaaaattcaacacctgacacctttgctttttgctaatttagtgtacacaaactttgtttcatgtataaaattatttaaaatgctgtataaaattaccttcagtctgtatgtataaggtatatatgaaacataaattaatgttttgtttagacttgggtcctatccccatgatattacattatgtatatgcaaatattctaaaatttttaaaaagtcagaaatctcaaacatttctattcctaagaattttgtataaggcatactcaacctgtactattgttaatggagataatgttcctttctagccatttgttttcaaataagtagaagtaaataaaaaataatcacacacaaatatgtataatataaattccttatagtctataatttaattttctataacataatagtagtgtaaacataaacttgccatacatattttgcacttaagcaaagttcaagaacataaaatgttaaaattatcctaaaaaagaatgtgtaactgtatgaaacctgagctaaatcctactaaaaaaataggtataaacttcagagggagtattttgtttcttttatatctggatatgttatacaataattaggcagttaaatgttttaaatttgatctaagataggttaattgcttttcctaagttgccggtaagtagacataaatgcatcaattcacattacctttttaaaaaaccagtgataaacaaaaaactgcaattgcctacctaaaaaagtgatcctgtctccactttagcaaaggaagttgaatttctgatttctcaattttgtttgttacctaagttcaaacagcaagcactcaatatcaatctctggccattttatataaagaaatgcaaacaacaattaggtcatacagtgattgatcccctgaaggacaaatgatgtcaggcagtatttatgcaccaaaattatttcaattttgcttacttttccagcaatccaccttgatgtcaactaccatttagctgggccaataatattgatatttgatgtcagttcttattcattactgcaccaagatgatgcataagtcaaaacttttagatgtgtggtgaaaaacactaaagcaggttctgtctatccaaggaaattggaaacaacaatagaatataaaattaaggcatatgtaatctccatttttattttagaaaatatttaaattatgtcaatattcctacatattcaaaaaataattttatatctcaagcccatcctatactatgtgattttttaaactaaatattttatgaaattaactttttgccttaatactttttgtactttggaaagaaaataatttctagtaaaaagtgaaacgctttaaaaaagtaaagcaaaagaaaagcatttgtataagcagccattaaaaaaattaattagaatataaggtaactataataaattaatagaagtattctatctttatttctactttgttttggtgttagaaatctaatactgtaaatgactacagataaaaatgatacatttaagattctattgcaccacccccaaattttaacctccaatcactcctatagtcaaatggagttcatttcatacatttgtcattttgttgatgggtctatgaaaattgaaagcaacataattatgtcatatttcttgacatttcctctttgaccaaaaaaaatcaatcgtttgttttctatatatgtatctttggataactttaaaaccttttggcatatatgaaaacagttcagtagtgaaatttctacttagcaaccctttacatcaactgtgtcctggcactaatctaaatagtgagagttcagcaatgaaaaataccaagtcctgtcctcaggaaccttatattctcttaataatcagagacaataaaccagtaaataagtgaataatctcaggaatatgaagtgctacctatcaagaatcaatcaggtagaaaacagcaataaggtgagagttggggcttaaaatgcaatgatcagagagagattctctgagagaataaagaaatcctaaaagttctgaaggaagataactcaagcataggcaataagagaggccaagttcctgaagtggtgacaacatggtcccgtggaggaatagcaaaatcgggacacatagagtgaactaggaatagattaaacaggtggaatatcttgaatcatatagataactgattggtaatgtcacctatacaaagataacccagctatgagaagtttgtaatggatttttttatgtgactaataccttaagtttttttaaccctagaattcttagcataattctcagtatagaagcactaatcaataaatattcattgactaggaagtgtcagaaagtcactgtaggtcagaactgaagggatatttaagaggacataggaccatgtttgctgtgacacaacaaaatttattttctatcattgattttaaattttattttgaaatttaatatactttgcagactccccatgattgttttgagcatatgactgccaaaactagttcaaaatattttatttttttataagaaataatgtcactgatcaggatatttgaccactcagacaactggtcttccaatacagtaaaatctcatttaaacaggtttcacagtacgaaattgttctaagtaacgtgaaaatatcaacataaaatgatacactcctctctaattaggatttattatagccagtcttaatttgcatgtgatttaaaaagtataaaaaactacatgtatgataaacagcatgaatttttaagattgttttacataacagggataatgtctaatgcatgaaacattgtttttgaagcacataattagagcaaaaataattgtcacaccaatttactcataagcacaattacaagaaaacttgattatcccctttaatgtaattttccccacttaattgtatgttggtggatgaatgtgaccctgtgagtccatacttgaagaagtgactgttagttaacatgcaaaaccacgggcagaacaagagagtctgccctttctctggaagagatttaatttgtataccaagtggctctgcagggaaactgttttaaaaggtacatcttccagcaggatgggctggaatttcctggagcacctttcaccttgcccttgggctgtcatgtgcatcatcaccttgctctgccatttactcaatagctagacctaaacactcaacagttttctaactaaaggaatttaatctgctacctagattgcattcagaaacctaaattcattgaatttttttctgaaaccattcaagtttttatatatgttttctttttttttaagatttagcaaatattccctgacttgttatttgggtggttgtgaagtgaaagaaccttttgtttctaactttaatacctggttgcatttagatcccttattccacctgagctggagaaagttaggaccacagagaatcttaagtatacactctgtttctttttcatgaggcttgatactggaattggctgcagtcatttaaaatgttctctttttagtctgagggatagaatttttttctaaggaatagctggttttcaatttttacagactgaaatacaaagttatgaaataaatcaagtcattacattatgaattgcttttctatcatgttatgttttgtatacctaaaatggtaaaaacagacttttttggatgtgtgaggttgtaacttcgccctctccagggtattatggatacaattccatatcttcaaagaaatatgattgttttactagtgaaaaaaaatgtagaatttctaagaaaaaataaggctagcaaacagaaggacagtctgttagaaataattcttaaaaaggctctacattttagttaaatatatatagctccaccctgtaatctgtttttataaatcaaattatagattttggatattttatcaagtcacttcaatatgaagtacaggaagaaagatatggcacctttcctcacccatcttaaggatcatagccaaaagtcctgtaacaaaagacaggtttacaagggaaaagtataacaaatgtatttaatcagggttttacttgacatgggagccttcaggaatgaaaacttaaaagacccggggaaaattgtctattttgatgcttagatttaatgaagaatggacaatcacgtagaaatgtgattgggcaaaagaatataatctaatggtaatagaccgagggaagaaatccagtaaggcctgactttcttttccttccttctttccttccttccttccttccttccttccttccttccttccttccttccttccttccttcctttttttttttttttttttttttggcgtttctgtatagcatttctttcacctggcaatggggcaggtcccacctcgaatcacgtcttcaaaatagaagagatggagtgagcttgctaggctttacggagaagggagaagggagaagggatggattgagcttcctaggttttatggctttctttgggggagagaagtttccgtttctatgactcgccttagggaagaggagttctggtttctatgactcattcatgggagaaggagggtcggaagacaggaaggtggagaaggtcagaggcccttccaatttccttcatttcaaagtattcagcacaccaaggagccatacttcagggtgtcgtgttctgagctccaacagtggcaacagccaggcctggtttatggtcatcaacatgaatcttggtattgtaaacattatgatgacacaaccctattcatatattatcaactttatgtatataatggaacttctctgaatttatgtgactgtacttatgcacatattaagagaaaataaatccattgcaggttatcccagcaatgttattgcagtgagcactatattaatcaataataattagctactttaaaagactcttgccaaattgaggaacaccttaggttactatcacaataaataaacagatcttacagattgtgtatctacatcatgtaatatcttctgcaatgatcaaacagcaaaagtacattgttgttaacaatagtaattaacacattgctctcatctttgctagatgatttgttttatttctctatggtgtataaaacatacatatatatttttaaaaggattatccccaagtacttaagaaatgattattttgaaattactagaaatctgaagttgtaaattttttgtagtaagttctctgtaagtgtttgtgaaactgaattcagtagataaaaatattttttcccacaagggaaaagaaatagatttgatggaattttgcagtttgccactatgtcagctgctaatatggacattcaggattccaaatccctctttgacctctaatcactgctgcagaaatctagtgcttctctaattgtcaatccctgccctctgcctttcatatcttggagaatataaaaggactgacttcctccctggataaaggacaacagattaatgaaattaagtgtctgcctcattaaaattgtcatccctggtttactatttcaagtgcagtatcaactgtggctagcttttactcttcagggggtccagtgatgttcagtttcttatgtaaatttatgcaaaaactactccaacaatatcacatgctgttcctttcaaaccccaaaaggaatgctgtgtttctttatctggtagatggaaagagcagagtgggagtgagctgagttacaggttaacaaacagaatactggtctatccaaggaggaggagagtttggaaggaaaacacaatatttattttcaattgtgttaaatcaaagattcacctgtatgtatttcatttttatctgtaaatatttccaaaatgtaaatttacatggcaatgcattttattttgtttaggaggattacaaattagccaggatgattccatagctcatgaagatctagaatcatgtcttacccttttccctactgcatcagtcctgtcctcttcctcaccacacaccctcacccggcactaggccattctggcagggaaagcttgtctgggtgatacttaatgaatgactaatcatgttttcaaaactctttataaaagaagtttcatcatcttaaagtatgtacaaatttctttggtcagtttgttataacaaaataaaaagtagaccagtggtgagatagaaacagactgttctagaaaaaagggtgggttagagcagcttgattaaatgtattaaaaagtggtagaatttagtatttggcaaattgatattttaaagcacttaaatgtcctttaattctcaagttgaatcacccatcatcatgggttgttttaggaagtaaaattatcagtgtaggcttcattcaaatgtaaataactatggcataagtgcctcatttaaaaatagttgttcagaagaaaataagctgacgggcagggggaaaacctctcaagttataatcatttcaggaaagtacatcctgtgtatatgtctatctgtgtgtatgtgaattgcccagttgggtggccacattaattgtgcatatgtgtcatattatgattgctttaagattggttgggagagttattggcatgttttagttaaatcttatatttctcagtttaattgagaaagcaacaagagagattttaaaactctaagctctactcaaggcttttcattgtctggttatgctcactagtgagccacaaccttctccactgtcccctaacccttcttatatttaccctcaactttggccagttccaagattgctgtgccaaaatcaattaatatgcatccaaattgaatgaaaacactccaaagaaatatctttaatctgatttacatatgaatttattcctgtcttcttatctaacggatttcaattcaaccagatttagtttcagatcccaactatcacttaccagttgtgtgaattagaagtagcctaaattttctcatatgtaatatggtgatattacctagtgcctcataaattcatcaagtttaccttgttggatgctagatattttgtatttttacaaatagtcttgaactttgttctggaatgctgtcaagttacttagaaactggttagtacttccagatttgttaggtgggaaagaagcagtgctcaaactagggctaattacttccccgctactaaagcggggaagtaccccttctttgtcttctaatctacccagtgacctcaaatcttgaaatttttcattctgtctgttagggcagtcctcactttcccagtgtaatctgaacatcttttcgtgttccctctaatcatttcaggtagttcttcctaggcccctaagtaatttcctcacagtcatatgccaatcattactgagctaaatactagaggaggtttctctgcagatctccagggttttctctgtgcaactctcacctcacctcttctgtacactctgcctcgcaaattctacctgccttggcatccctggaccctcagcttcgtttctttaattagggagtctgctgtgctttgtttcagttccctgtccttgtgttatgggatagaaatcgtcaaggtagtatgtcaacgtagtcttctctggctgacttcattcgttttcatctcttgatgattattgccctttgttacctaatatgcagtgtcttgtaaaccattgttttctatattttgtccaggtttttggttgtttcaggcaggaggatatacctgatccctttgactccattgtgactggaagtcttttttagcatctgtttttaagtgtcaacagatttcaccagaagatatgcaattgtaataataatagcattatttttaacatttatagttagcccttcctcctatacaaaataaaagttggcagtatgtttgaagaagaccttaattatagttctgcttggaccatgaatttcatgcgaaggcttagacaaatcccttaatttctcaagactttacttttctattccatggaatactttgatctggacaacttttatattatctttcagaaatatattgataatcactaacattttccttttgaaattgagaaaaactatagactatgaatgcatgacttataaggctttttagagaagcaaggatttattttcaacacctggtttttctgaactctgaaagattctttgtgactcaatacttaccggtattaacaaaaaaccatgagatctgtagaggagaaaagaagagctttattttcttaacaataatctcaaattggggaggcatagcctacaatacaagtgagcgtgccttccaatgaacaaagtgggggtctggcttcaatagagaaaattctcaccccagttctcaaccaaatccatttatgcaaatgaagcattcaaacttattcagttctgattggttgaaatagataagccctgattggcaagcttccaagccccaaactggaagtctctagcagccggtgtgagagtttgagggtcgtggccacagtttatcttgacaacaacagaaactggtttggattaatcacagaaagggaggttttgtgacacttttacaacacctttctgagaacatggagtactttctgagaacacagctccctcacttggctgtggccacctggttctgtattaactttgagaacctcagtcagccatgaagacttcattttgtctgttggccagaggcatgctttaacactagcaaacaccacagcaaacctgagatctttcttctgacatacagagtgatgccaaactgtaaaaatttaacaccactcgctcttcagatgtggagtagtaagcttcaatttttacttcatatctctttggttttatttcttcatattccagaaaccctactgccctgctttgacattacagtatgttactatgtaaatatatcaaaagatattgctgcaatgtgacaagtcacatcggcagaaaacaccaagggcctataagacaaagatctcatacatgaatatctgaaataatgccaataatgacactgaaaatgaagtaaactcacatgagagtcagaacatttttttagtgcttttagaagaggctcactgccagagggagaatgcatcaatttcatatgccatgtaaggaacttccatttctccttgaataaaacgttagtttcaaaaattgtctttagagtagaaagactctctgtgatttattaaaccttcttctccccttcaccttcagaaatccactaattttgcatcgtatttggcagccaggaagttgggccagtctatattcaattccttcaggactgtgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatcatgccactgtactccaacctgggtgacagagcaagaccctaactcaaaattaaaaaaaaaaaaaaaatcaaactctatccacaaagtaggtaactatttgtttgtataaggtaacatgttataagtgccaaaagtggctaactaaaagtcagtggagaaaacttatatttacacaaaaacctccacatagagtagctttattcataactgtgaaaacttggaagcaaccaaaatgtcctccagtaggtgaattgatagagaaagtatggtacatccagacaatggaatgttactcgggacttaaaaaaaaaatgaactattaagccatgaaaagagatggcataaacttaaatgcacattactaagtgaaatagccactctaaaatggctacatactgtatgactccaactatgtgacattctggaaaaggcaaaactgtagaaacagtaaaaagatcagtggttgccaggggctggagggagggagggatgaatagacagggcatagacaatttttagggtggtgaaaatactcttataatgatggttacacttgtctaaacccatagaacgtacaccaccaagagtgaaccctaatgtaaactgtgagctttggatgatgaagatgtgctaatgtaggttcaccaattgtaacaagtgtaccactctggtggcagatattgctagtgtgagatgctatgcatgtgtaggggagacaggacatatgagaaatcttcatactttcctcttaattttgctcagaacctaaacctgctctaaaaaaaataaagactttaaaaataatcagtgggtatatcgggtataattcttgaaagagttctattgcaaatatgagaagttttgctttgactttccaggtatggaaataatgattcattcattcatttgttcaaatatttactaagtatataatataaacccaaaactgaatgtgtaaatgatctggaacagtactgtccaatagaactttctgtaataaaaagatgatttttaatctaaaatgtccaatgtgataggtgctagctacatgaggagatttttaactaattaaaaataagtaaaactgaaacttcagttcctcagttgctgtagttacatttaaagtactcagtagccacatgtattaaacaatggtctagaatgaaaagacgggcatgtatataagagattgcagttttgtaacatgaatttatggaagcaacagaaggaatacattgtgtcacttagaggactttagaagaagttgtgttggagccaagttttaagaatggttgatatttaccagaaaaataaataaggaatgagtatcccagtcagtggaaactaagaagaaaagcatgaggacttggtgcatttgaggaatagccaatagagtaacatatggggaaatttaaggaagatgataggcaggaaggaggcaggtcaaatttacatttgagagtctcaaatttgcatttaaaaatgactgtcatggctgggcctatgccttgtaatcctagcactttgggaggcctaggcgggcggatcacctgaggtcgcgagttcgagaccagcctgaccaacatggagaaaccccgtctctactaaaaatacaaaattagccaggcgtggtggcagacgcctgtaatcccagctactggggaggctgaggcaggagaatcacttgaacctgggaggcggatgttgcagtgaactgagatcgtgccactgcactccagcctgggcaacaagagtgaaactccatctcaaataaaataaaataaaaaaaataaataaataataataaaaaaaaaacctaccattagcatagagcaaggtttggcaatactgattttatggactggtaattccctgttggaggtgggggctatttcgtgcattataagacttttatcagcatccctggcctccatcaactgaattccaggggcactttctagttgcgaaatcaaagatgtctctggacattgccagaagtcctctgggaagaaaaaatcacctctatttgagaaactttgctgtaaaaatggccttccaaggctgggtgtggtggcttacgcctgtgcactttgggaggtcgaggaaggcagatcacttaaggtcaggagttcgagaccagcctggccaacgtgacgaaaattctctactaaaaaatacaaaaattatccaggcgtgatgatgcatgcctgtaatcccagctactccggagcctgaggcaggagaatcacttgaatctggtaggtggaggttgcagtgagctgagatcacaccactgcactccagtctgggttacagagcgagactccatctcaaaaataataataaaataaaataaataataaaatggcctgcaaagatagagggttgaagtgaggaagttcactgcatgtgtcccagtgtgagttgatgacaggctaaaataagggatttttggaggcaaatttcaactgaatagaattggaaaggaaagagatggagaatgggataaaaagctctggtgattgcctggagtttggatccttttgttgaaatggaaagtgcagcagaaggctcaagttgaggaaaagattaatttggctttgaacaggatgacattgaggtacgtggggaacttccaagtgagaaatgctatcagtagttggaaataaagacctggaatttaagagagagttgtgaattggagatgtagattcaagagtcataaacatcttaatattagttgaaatcatgggaatactcctttgtgcttccagcagtctggacttaatgacgactcatagtttctgactgatctccaaatccacgctttttgaatcaattcaacacatagcacctgttctttcctgatttcatatatgaaaagactttgaagtctacactggcctatttactgttagcgcttctgcctcagggcccttgatcttgctcttccctcttcctgaatcactcttcattctcacagcacaacttggccccacaaatccattaggtcttaattcaaaggtcacacattcctagtcttgacaggctatttgtatttcaacaccctgtctgccaaacattccttgtctacatttttaaaaattctccatagcttttaacatttaacataccacatattttactgatttatttaatttattgtatgtttctttacagaagcatgcccgttccgtgaggcttgtccaccacctaaaatcggcacaggctccataaatatttgtttgatgaatgaagagataggttttctatagaatgaggcaaatttgcccgaattcagtcaacctcttacttataacaaacttgagtaccacaagaaagcaatcttcacttgtttttcaggatctcagagacacagtcttgcactagataataccttcttaacttactgagactagtggccttcaacattccctttaacgtatcgatatttatgtacaaaacacataagaactttttttacatcatatgtaaaatttacattcctcagtgtgagctccagaaactttggaatttttacacattgttaacctcatcattaattcaccacattccccatggagtagtatgttaatttctgctttgtgctctgacattgtgccgttttcgataaaaatgacaccttcctgccttctcttccctattatttgtccataatcttcatctatctaaaacattacatttccagaaagctgtattcacctgatgaatttatcctagtgttccgctcctagaagatactttcttagattctacagtcttgaattaggtgatcaatttgtattctaaacaatacctacttctagcatttaactcttctattgtaattgcctagttactcctctctctgacaatcaaccagaagcttgttgaggtcatatattaattgtttttcttcctcttggtccaagccagggtcacagtagagttcagtaaatattagttgctttatatacattgtctttatttctagttactcttctgccttgtcaatttaaacacctgcttgcttgatttgttctttgttaatacatgtggtacttgttgacatgctcctaaagctctgttagctgttttggtgtgttttaccccaataacaaagtatgcatgtttatgcatctaagtggtttcatgggtcccggagttcggatgtctgacccctccaaatctcatgttgaaatttaatttccagtgtaatggtgttggaaggtgggacctagtaagaggtgtttgggtcatgggagcaaatctctcatgaatagattaatgccttccctgagggaggggatgagtgagtttctactcttatttcccacaagagctggttgttaaaaataacctggaacttcctctatctctctctctctctgtctctctgtctctctctctctctctctctctctcactcttgcttttctctcttgccatgtgatctctgcacacactggctccccttgccttctgccatgaaaagaagcagcctgaagccctcaccagaagcagatactggcgccatgcttctatagtctgccgactgcaggaatatcggaggctgggcaatttataaagaaaagagctttgggtggctcacagttctgcatgttatacaagaagtatggtgctgtcatctgcttttggttagggtttcagggagcctccactcatggcagaagaggaaggggagctgacaggtagagaaggggagtgtagctgtcacatggtgagagagaggaagagagagggggtagtgccaggctggttttaacaagcagctctcacagaaactagtagagtgagaactcactcactacaagaatgataacaaaccattcatgagtgagccacacctatgactcaaaaatctctcaccatgccctactctaacactggggatcatatttcaacatgagacttagtggggccacactaaccatatccaaaccatagcatcaggttttcaattccgagcctgtgttttgctaaccaaatgactctgggcaagtttaataacttaaaccttggttgtctcatttgtaatattgagcagtaccagtacctaaccataaagatgtagaattaaatgagatagtacatataaatcactttgtacaagttattgtaatgatgtagtgctgtgttgtgtactttagctgctcggtaattatttttgagatttccagctcatatccatggagcatgattggtgatatggtagttgttaatgcctaacagactgatgatggcataggaaagaagtatacacccaaaattacaaacttatccacatctttccagtgctctatatttcctccttctttatacttgaactttctaagcattcccaaatcttaccttctctttccgttctaattccataatttatttgctttatttgtgccattagagtattgaggaaatggtgtaatgagctattgcttaatgctgcataggcctgtcctaagagacatgctaatgtatcagtactaaaaatgtttgaaatactaattttcctcctaatgagcctaaacattttattatagttataccttaataccaagttgcaggtcattaccttcacatattgaaggcagctgatgtttcccggacttaatgtctctgccatttgcttgatgacccctcttacttgcccattttgcatagcagaattttagaaaataaaaattagatcacttgacaggtactgtgtgtgatgttttgatttcattatttctttattcaaaaatatttttctgatgataaaaattaatgtatgataatttcatgaaatctaactttttaaattgaaaagaacaaataaaattaatgtgcattggcttactacctgaagataaccatttctgatttattttcaatatatgctttgtgtatacatacaacatagacaattttgcatgctgctattttcattgaactacatattttttcgtcattaataatcttcggcaatgccattataatagtttagttatatatttatatatgttatctaatgacatatatatttggaaatgccaaaatatagtttagctatataattatacatgttatagttttatatatttgtgtatatatgtatgtgttatctattgatgattttttaggtttctacagttttagcttgtaaataatagtgtgaggaacatctatgtgacaaatttgtatcttattgactatttaatgtatcctgatggggaaatattttctatatttttaaacttttgtgatatactctagtagttttgagaaaataaaatgtaatacagtggataaaatcttggactctgcagttaaccatacatgggcttgaatccacactccaaatcattctaactaggtaattttagggaagtgactttatctctttaagcattattttcctcatttgtaaaatacaattgttgcacataaaaaataatcctataaatattgagcatatgtcatggcaaaaactgttaattttagttgtcaattactacatccaccagtaatacaaatctgattgtattgcagttttatcaacatcaatgctgtcattaaaaatctattctaatttgatagaaaaaaaggacatgttaattaaaaaaccccaaatcaaactaatttaagcaaaattagggtgttcattggctctatagaggagggaaagatcactcccactgcctttttattcttttctgggctctttggctggtccaggaactgaactgatataacagatgaacaggagaaaagcacacaagttttattaattttacatttacatgaggattttcatcagagagcaaagtccaaaggaatggccaaaggaaaatgcttttatattttttagacaaaaaatataaatttgtaaagaaattacacaacaaggggacctggctagggtagtaagttctaggggagatactgggagatacatgagaggtggaaagctagtggaagataagggttatttgggggagattatttattcaggcctatttcaaggctaagtcccagtatctggtgataagaattcttctcacgccctggtactgggaaagcaccccttgcaaaagaatatttaaagcctgctgcatgcaagaaaagacaattcagccattctttttctgaaactataatttctccaatgtttttatctcaaaatagtcaatataccaatttggcatatttgaggaccatacatcctttacttcttcagctcacaaacctagacttcagactgagcagttggcaactggcatttagatttagcaggaaccaaaactcaaataccacctgacttcctgaatggtcttactcttattagtttctttattgtactagacctgagcatcagaaggaagattacacatgtatatgcatattacacattttctgaaaccttttattcagagaggaaatagcttatctctctcacattagtttggaaaatacagggaggtaatcttattgctcctacctgagccagattcctaccccttaaataatgactccatccagggagatgaatttctatgaggacaccagctacagtgtaggaaatgagaggcagttcttcaaaaaaagtgagatagcaaacctatgactgctagagtgatcttgggctgggtaaccaagctaagtggatctactccaaataaaacactgtttgaatttatttcactcaactatagtcctagggtcagtgaaaaggttttcaggtgtttaatcattctttcttctgtctaggtctcatttcaagagcaatatttgtattgtcttagtggttttcctctttatttcttgtatttctttttgttatatttaagacaattttttcaaagtttattgccagttgacttttaaatttattttgttctggaaatgccattttgctgaagaattaacagtgaacattaagtccttcagagcatttggtgtggtttctttaatctctaccatatttttaattatccccttttccctgttgttgcttaattatgacttttttctttgtgattatttttgtctgtttttgacaaacctttcaatttgtctgtctacacttttcaaagagcggcttttgattttgttgatgttatctcttattattttaataactttaattttgcttctcattcatcatatattaattatttctaccttttctattctgtagaaaagagcgtcttcaatttaattctaatatatttattttaaatttcgctttaaaaaatgcatctgaaattacaaatttttattaataatggcttcagcttccttcaacaaatataatatgaattccttcatttggattaattctgagcactgaactctgagcttttcttcctgctcaaattcctttctaatggcctgggtaaagtcaagcctacacgccttaacatcttgttaaatagggcttttttgaggcctgtttgaagcccagtatactgtggcttactttccaacctgactctagcatagcgtcacatgacagataacagaccctttatcttaacctaagcatttgtttttactgagtccaactatttagacaaagcttaactctttcaaccaattgctaactaaaaaatcccaaaacccacctatgacttataaggctctacttgaagatgtcctgccatcttgggccaaaccaatatgtatctcccatgtactggtttattatattacctgaaattcctgtctccctgaaatgtataaaaccaaactgtaacctgatcgcctcaggcacacttttacaagatttctgagactgtatttccccagcatgtggttactctcatgggctcagaataaatctctttaaatattttggcagagtttcctttttctctctcttttttttttgttttgtttgtcaccagttccaaacttgtaatttattttgtgtttttttcttttagcttccaaacttttttttaaacctttggtgtaatttttagtttctaatttaattgcatcatcgtcataaaatgtggcctttataacacttctttgtcatttcttgaaacttattttgtggcttatcacatacttcacatatatttgatgatactatatatttggcaaatactgttttccattttagatcaagctttattttttgaaggggtggtaaaatgttgtatatctttccttttttgcattatctatcattctgatggacttgtattacaatcttccccattatttgggaaaataatttatttttatactcatgataacttttaaaatattttaaaacgtcatttgtctttacatataaatttattagttataccttgtggctagagtattccctttattattctttagtaatagactctagtaatttcttttctgtaattatttttttctgacactgatactattctacaagcttcttaggaattagcatttaatgattttattcctttattttcactcttgaatattttgggaattttgttattgtttctgcttgtttttaatgtttctcttgtaaattgcacatagttgtattctttattatttaaactattttagttgtttcttacttttaattgttaagtatatcccattggtgggggggggggggtggggggtggggggatgtgacagagagagagatatatatttctgtattggtattgccataacaataacttgtattttctgctaatcttgttttatttgcttctttttaacttatttcctgaattttgcttaagataagatttagattaggttagggttagaattagagttagggtttggattcagcattttgtctttgattttaactaaatcaactttgattaaaaattactgaatttttgcctgggcacggtggctcatgcccgtaatcccagcactttgggaggccaaggtaggtggatcacaaggccaggagatcaagaccatccttgccaacatggtgaaactccgtctctactaaaaatacaaaaattagccaggcacggtggcatgtgcctgtaatcccagctactcaggaggctgaggcaggagaatcacctgaacccaggaggcagaggttgcaatgagcccagatcaggccactgcactccagcccgggtgacagagtgagactcggcctcaaaaaaaaaaaaaccaaaaaaattactgattttttaaatatttgtgctcaccattatatattttgaccaatgctatacttaggattttactttttcatggtgaaatacaaacattaatacttctttccataagatatttaaacatttgtattcattaaatgaaaatgcattcaatccaaagtgatatttaactaaagcatagaattttaggttgaggttttttcccccggtacaatgaggacattatcccactggttctaatatctacttaaaaaattaattgaaatgtctttaaaatattttaaataggtaatctgtcatttttcacttgtaggtaaatatctcttcgtccataatatcccacatttttcattacactctgtttaggtgcagttttatttttatgcattatactcaatatttggagcgcaattttagtcttgatattatatttttcttcaattctggcaaagtttcagccattacacctttggatactgctgttctgactgtctttacattatcttcttttggaatgcttataaaacatatattggaatatgtaactccacccccaccctcaagtctcttaatggtttacatgcttttatctttcaatctctgtgtctacaatctagctaaattttccagattgtgatattccaatccactcactttcttttcaactttgtctagaatagagtacatcctatctatagagccctatttcttcaatgactaacattttaattctcttggatttctcaagtcattttagattgtgtttgtttcatttcttttttatttaatgagtaatagctctttattcaaatctttgagactcacactttcaaatctttgagactcacactttaaaatctttttcagtctttcataattttaatctatacagatcacttttatcttccaattattgactatattagctttagatctccttgcatgttatggaaaatttttggtagcttcttttgagtaagtaaaaggtctgatcatctcttttaactccctttatttcttttcctctttctttgtgcttacccttccataactttcagtattgtaactatctcctttgccccaggtctcccaggcccctagttccagggtgacctaggataggctttacgtttaatgtagatgaaatctgccctctggttttgaaaccacagatccagtcactgagtgtgctacttggtaaaggtccaggtggcaagactgtgtgttaactccagagtccttaaatgtatagattaacaaaaattgtagcttcaaacaacattagccggcaacttttgtcagcttcattttgtcaggaaatcttaccccagccatggttttagcagtaagttgatgtttatcttccatctgacacaaagctcttttagtctctttattattccacacaagctgaatgaccagtctgcttccaaacccaaaacccagagcctatgttttcatccctattctctattttgtgtttctgttctgtttttacttagtgcatagtatgcctgtcatcctgtcctcaaactcttcaaggcctcatacttttaaaaatcgttttttagcctcactctgtctttgagacatggtacagcttagtgactctaaagccacatggccttaaatcctggccatttcttttttaactgtgtgaactgtaggcaacttaattaagctttctgtggctcaatttcctcattcataaaatggaggtgatcacctattccatcatagttttgggtttttttttttttttttttttggtttcctgatatatgtatatatctgtatacaaatgcttggaaccctgagtgacacatagtaattacccaattagtgttagctattactagtttttaattgtctcatttcataggtattttttaagaccatcttgaccagggtccttccataaattatttaattcttctagaatatatttagttttatattatgaggtagaatcacagtttgactcatcatatagttgtgagagtcagctgtgacattatttacaggtatgttataagtgataaagaattatgcaaatgtacgattttgtgtcttatgatcacaaaaacatttttttctgagttttagctcatttaaatttctatatttgtgaaaaaattcttttaaattacatacaatcaacattgattactttctactttctttatatttattcattcaattagtgatttaaaatcaaatacctaacatgtagcaggaactgtgctgggtgctagagattcagtgttacagaaagagctccagacctaaatggaaacttctttgagagctttccatgcaaacacatttagtaccttcccattctcagtttcagtacttgtaccagtgacatattttaaagtctcatgagactgggcacagtagctcatgcttataatcccagcacttcggcaggtcaaggtgggaggatcacatgaggccacaggtttgagaccagcctgagcaacatagcaagaccctgtctataaaaaaaatttaaaaattagctgggggtgttgacaaacacctgtagtttcaactacttgggaggctgacgtggaaggatcacctgagcccaggagtttgagattacaatattgaactgcagtccaccctgggcaacagaacaagatcctatctcaaaaataagatttaaaagtaaagtaaaataaaatgaattaaaagctcatgaaataaatagtaatatgtttggcaatgatatttgaataatatataactgttatctttgaggagtttaattatttgtagttattcacatttaaagtattaaaggattataaaaatacacaaaagctttaataaatgacgtaactccccatttaatcattgtacatgtgtattatatactttaatgtaaccacagtttggcataaatttttccatgttttacattggttctataattgttgttttaatggctttataattatttatctaagatattcatatagtcattctacaattatctattgaacatgaactatattttattctaggtcactagaatgtactgctaaacaaacaaaacaaagttccttcacttagtgtttacaacattctcatgtatacatagttgatgtaaaatcattcatttaatttttctagtatgcagtataactctttgacaacagaatattatatatattctattgttcagccttcaggaatcactgaagaaaggaaacaatgtcctgggcctaaaatgcttttattgttcagtaaattgactttccaaaagaaaaaggtatttatatatataacatacgtgtatatgaaacccagcaagttgaaccaagaaactacttagctgactcatcaggttgaaggttcaaactacaatcaaattggacctgagtcttccaaaataggttaatatcctatttcttttagagatgcaatataaagacatagggactttcatagaaaaaattatgttactatataatatttcttaacctgagcactagccccgtaatcctaaaagttaggataatgcccaagtttgaaatatttgttttaaaaaattatacaatgccataagatatgtttatattaaggaatactattggtttataaaatagtattttaattatttatttaaattattaatgacctcattaacattccagttttctccttttctttcttagttttaccatatataaatacatttggaacctctgtgcagagagatagtagttcagtctgcttgtctctctgcatctgttgataacaagtttacataacagttgcctcaagcagttttctgaacccaccacagcccaaggtttacttcttccatattagattattattgcaaatttcacttgtttccattttgtatttataaataatgctacattggttttttcataatacatttttctttaatttataataaagttcagaagtaatagtaaaagtttcagaagtttggacatttttgtgatacttgatacctattgctaaatttttctcttataaattctcagcagcctagatgaagctagattgatcttatgttattctactctctaatttattattaacttcatgtctatatggttttctcattataggatctttaatttggtggtgggaggcttaacagaggcaatcaggagtggtgactattcattttcatctcagctgtaccctttgtccacttggctaaattctactggcataattaaattcatttgagtcttatgaccacaaagcatttttttgggcttcggctcagttaatatttctatatttttgaaacaaattattttaaatcacatagagtcaacgttgattactcttcattccctttgtattcattcattcattcaattgtttattcaaagaccaaatgtctaacacgtagtaagaactatactggatgctggagatgcagtgttacaaaaacaatcatagctctcaatctgagctttctgcacatccaccttcagtagcttcccatcctcaggatcagtactactaccaatgataaccagaattgcattttagagatttccaaacctcttgagtcttgactttcattaagattgtcatgaaatctcacctatctttaaaaacattttctttgaaatatttcttaatttacgttaaatgccttaaactatagcttgactgtcataaattgtaggtaaaatgacttttccctaggttgtcaactaatctccttcccacatctctccatctccacatccctcaaaactcaaactacacagtttggattaacaacattctagtttattctgtctcgaggaaggagattggcagatggccctccaattttcctgaaatgggagaaagaagaaggatacagggcattagaatattctaagtattgattctggattctctgcctcttccattgctttctgtcttgtaagtgattcagacctatcagggttggaattaatattcacctgcaaaactgctttggaaggacttggaccaaaataaaacttttaggtaacctttgtggaagcattactcatctatcagcttaacaaatacttggttgagctctgctatgctccaaacactgtaatagacactgcatctgcctcactagctaactggatatatagttaagctgttcttccgttaccaagtatctttcagttctcaaatctaaatgcaaacttatttctattacttaaaatattaccatatttggctgggcgcagtggctcatacctgtaatcccagcactttgggaggccaaggtgggcagatcatgaggtcaggagatcaagaccatcctggctaacacagtgaaaccccgtctctactaaaaatacaaaaaattagccgggtgtggtggcaggcatctgtgtagtcccagctactcacgaggctgaggcaggagaatggcgttaacccgggagacggacattgcagtgagccaagattgtgccattgcactccagcttgggtgacagagcgagactccatctcaaaaaaaaaaaaaaaattttcatattcattttaccataatgcatactttgtcatggcttttaagtttctaaggcaatggaaaaagtctagctaaaggatgttagttattcaaaattgcttgaagttgctatgtactagtttattaatgaagcatttagcacagtacctggctcattaaaagcatttcataaatattgactcactttcatattatcaaactattgcacttgatcatttgacagcaatagaagtttcaagtattaaatgtaaaaatattaaaactatttacctactcattttcacacaataacaatgatgaaactattttttattttaagtatacttcctcaaattttaatattcaatgggataaagtatacttcaagattttctttaatccatagactccagacaatgaaagaacatcaagtccatccacctgcctgtggcaagaggtgcatccagattaaattccgataaaaacttacctactctgttcccaaaattgaaaaaaatttccattctgtgacttctctcagatcattgaaagcccttatatttggaaagaattctttctaatttctaacattaatattccttgccgatactgagaactgttctttccttttctgaaatgaaattcactgattcctcacaattcttataatacatgtttacatatttgagggcattccaagttctccatgttccttttaagtcataaaaaagattaagcatctcatttattagattggggacaaggctgttgtattactgtgccagtgacaacagttatagaattttaaaactaattgcattcattgcattactggtgtgtttagagaaaaacaatgagtccacttgaactgtaatacaggatgtactatttttacagaaagaatagaaatcaaggagtaagtgagaaaatatgtgagctagttcaaaatgataaggaaaattataggataattaaggtattaacattaacattttaaataacgtagggagaaaatgagaggatagtttttaagttgacattaaaaaatttgaactgcagctgaaagggaaactgtacatcaaatgggaaacagtatattgatgttttataaacataattgatgattttaatgtggccaatactcattcaatttgtgagtggacaaagaaattaaatgaccagaatgatgagaatgagtgaagactatgagttgctggggagcagaaacccctcttattcaccagcatatctccaatttctgtcacaaagtagatgctcaataaacatttcctgagagaccagcaggaggcgtgtagacagaccctgggctccaaactgaactgatgagcctgggccactgctactatgctgcaaaactatctctccccaccttccattgccatgtcacttgaatccattcacccttccttctgttttccttcccctttatccaattaccttcttccttgttccactacatgttaccaaagcaagcccaactatgttttctgagaattttgactaacagactacaataggcaccatttcattgccatcaacttcacctggtccctgtcattctacctgctatgcgatattcttctctcactgtgtccattttacttcctacctctttttgttttttctctatttgaggtataaattatcaatgctaactaactgtgagcataaaagctgagatatgcatgtggtataattttcccacattcacagtttttatgtgtcacatatatcatatgcattatatgatatatgtatatatatgcaaattatgagtgtacatgtttttgttttgttacatcttctaatgtagttaaaatgaaaatgcttgtctgaaacgttaactccaaaaatttagtgtaggattttatatattaagaatatcattttaataattttatgtccaaaataaagttattaacaactatttcttagtttagaggaatgtaatcttatggctgtaataaaactgtaacacttaccttttgtctataggttactatatgtatttgtatatatgtagtgtgtgtgtgtatatatatatgtgtgtgtgtgtgtatatatatatatatatatacatacatacacattttatttttgtttatcttatattttgaagggtcacatgatagcatcctgtgatgcctgtggggttacaaagctgtgggactttcggaagctgttaccaattgtgtccatcgatataggtccaagtcctggcaatgaggtgaattttgattcatcaggtaggatcatttttgtctaatgtttctgactaagccaataacattaatatttgttctgaaactattttgtttctccttaaatgtatgtatttctacgtaaatgtctgttcttaatattacattatattacattacattaagatatattttatcattacgtatagcatgtcatatgaaagaattatattcatatatttaaagtcagaaataatataggtgataatgtgtactaatctagatagcataggtttgttagcagtgccatgcaaaatattcaaacctccattcctcagaatcatcatccaaggtaagcaaattcgattttctaaaggcaaaatagctaacagtagagaagaacaaaagtttagcaaaaatgaacctgaaatatttttagtgtaataatttaatgttaaaaatttaatgaattaccccatattgtgtagagtttacaactaatttgagataaacatttatcttattgttgcaattatgtgctgtgcattctataatgttattatatttagtttttattccacaatgatataagtattatcaattagataaaatattttatccttgttgatgaggaatagtgtagcagctgattttatgaaccacacaataattccagttgtccatttataaggttaaaaatacagttgcatctgcatctttaatgatagagtttactaaataatgtatatatgttattgaataatatattttttctttgctattgtgatacatgttttaaactattttaagttttgagaatattttgaatctttgagcattatttgtggtaaatcaaagttgtggcgatagcaaaaacttgattttaggtgaagaagtaaagaacaaataagaagaaaatattttattgttttaagatagtccacgtttattctttagtccagaaagtatgaatataccaggagtaattctagagccagaagataattgtgtgtttcttgggactggtttcataatattgccatcacatatctgaaatttagaaaatggtaagtttgtcttcttaacaaactttaagttatgttcccattacagattggcatatgaaccacactagtaacaatggcttctttaaaaatgttttagtaatattcttgttaagacatttatggtctgccagaattaaaaaaagaaaacactcttcaaaatagaagtctcaactatgggaatttcatcttatattgcaaaagcctattaaagggtcaatttatagtttttggcatatataatctacattgacaccatagctctaaaggaactcttacagctttcacttgattttcataaacatttcacatccttaaatccctttttattatcttgagctagcattcaagtattcatgtctttgaattttgaactccgaaatttcaaaattttgtctgtacttcctaatagtagaagttaaaaggtgctttgaaatatcattacaattaataatagccatgtattttattgtcattaaatatgttgccacttgctctttgccatccttgtcatccagcccaaaagttatttgcatacttagataaacatgattttaaataaattacagtacctatcttctgtcatacaggtcagtgtgattttaaggcccttggtacatcaaacctatttttttctctccatgactgatatatacttggtgatacactaatattaagaaaagcataagaatcagcagtagaacagcaagaaacatcaaagacaacacgtatgaacgagggactctaatgaaaacactttatcagtctgaaggaatatgatttcaacctgaccttcccatccctttgaccatttctttaaggaacataccataataaattttagttccatgtgtgtgagaaattactgtcataaggattttctcattgaataatgagaaatctgtgcttctgtacaagacaagtcctcaatgactcttcatttaaaaggttgaattatatcaaaaattgaagaaactggggaaaacaaacataaaatctaatgagagaatgaagaaagaggtgaaagtcacaaagttaagtgctagaaattatgttcatctcaagagagtaaagaagagtgcaaattaagagccaaacaaaattgaaataaggatggggcacataggtctcttctagttgcatttattcaggaaaaaaaatgatttaaagagaagtgtaacaaaattgtatcatgaaaatatgagaataaaataaaatctaatttagtaatctcaaaatacacattcatttgaatatacctttatttattcccagtggcaagccaatacaagcctatatgatgtaatctttttcaaaaaaagcaagaatataattgaccctattggcaataatgaacatgtattgagggctcacattagttatgtctaaccattttttctagtcaaaactctgtgacagaactaaattgtgcagttatatacacctagcgtgttatttgtcacaacttatataatgtgaggccaggcaatggtctgctgtctccgctgtgctcttggactattgaaaacacacatgtaatgtcatcataatgttatgtaacacatgtggaattataaatagcatcctgtctgagatatttcatataaggaatgtgggtggttattagatactttaagtggccattacataaaagttgctaataatatttaatgtctctagatcagtttaatttaagggtgtctcaaggttgtgaggtgtactgtttaaaaagagttattttcttatgaaatgacagatctttataaataagggatttcttatcactgcaaatccaacacagtataggaataaattgaaagtagaggtcattaaaaggctgaaactgttatctataatcttaaatttcaaattttgatgtataacaaaattttctctatttattaacctcataagtaaatattgcttttgtggatttataaaagtatatatgtactaataaatagtaccttatctgtcttaaaatagagattattcacagagtatcatttttaaaatgtagctttggcaaaaatgttggaaaaccaaaggtgaagaaaaagaatatagactatatatttcagacccttaggtttaatcacatgttcagcaccttttagactttaggcacattacctatttctcctcatggaaataatggaagagacaattgccttgcagtgttctaacgtggactcaaagggataatgatattctctaataaggaactcagcatcttcatctactgtagggaccaaccccacaaggtcggtgggtctctccctgtgtgcggcgacgagagagtgtagaaataaagacacaagacaaggagataaaagaaaagacagctgggccccagggaccactaccaccaatgcgcggagaccagtagtggccccgaatgtctggctgtgctgttatttattggatacaaagcaaaaggggcagggtaaagagtgtgagtcatctccaatgataggtaaggtcacgtgggtcacgtgtccactggacagggggcccttccctgcctggcagccaaggcagagagggagaggagacagagagaaagacagcttatgccattatttctgcatatcagagacttttagtactttcactaattgactactgctatctagaaggcagagccaggtatacaggatggaacatgaaggcggactaggagcttgaccactgaagcacagcatcacagggagatggttaggcctccggataactgcgggcaagcctgactagtgtcaggccctccacaagaggtggaggagcagtcttctctaaactgccccggggaaagggagcctccctttcccggtctgctaagtagtgggtgttgttccttgacacatttcgctaccgctagaccacggtccgcctggcaatgggtgtcttcccagacgctggcatcactactagaccaaggagtcctctggtggccctgtccaggcataacagaaggctcgcactcttgtcttctggtcacttctcactgtgtcccctcagctcctatctctgtatggcctggtttttcctaggtcatgattatagagtgaggattattataatattggaataaagaataattgctacaaactaatgattattgatattcatatataatcatatctaagatctatatctggtataactattcttgttttatattttattattctggaacagctcgtgtccttggtctcttgcctcggcgcctgggtggcttgccacccacagtctaccatgttttatcctagtgctgaaggggtctgagaggtcaactcattccttttagggatgagagaaattaaacatattggtgcacaagaaagatgcttgaggctgggtgccactgtagaagttttctagggaaagcataagtattaataaacaaataataaaagaaacaaggatcaaaacctcacttttatgtaatattaaaaattgcttaatcagtaaagttatatgtaatgcgatatatacatatatattttaagtcaagatataaacatataggaatcaccccctagagtttagcttttcctgttgctgtaaaaaatcagcctctcatacatttaaaaagttgtatgtggcacagcattatttacataatgttttattatcaaatacattgcttgtgacaaacacagatacatgtgtatagtagtatatatttatatcccaagtatttgtgaagggataagtgctcctttctcattaaacagaaagcctcctggtaatataatgctacacatttttgtgaacattcactacctaaataatgtctctcacctggcctactcaaaatgccatatgtttgatcattcaaaaatttattgctatttcagaaaatgttaaatggaattgcgtagtgaaagtaataaaaatgaaccatgagaatttatatacatacttttccacgtctctcatttcaccatgtttatgtagtttagcaatatttttctctcctttgtaaaactaattccaggaaatttgcaaagaagtcacatcctaagtcctaagaaaatgcagaagctgaagtttgagccagatgggcactttccagtagaaagcttatcagtatcagatcattaaaatgagcaaagtttcccaacattatgttctccacaatcggaaccacaatagaaatcccaaaatgggacgaaaatatgactccattcaaaatgcaaaaagtatcagaccccccccccccattttttcataacctaacaagataactctaaaacccttggttcatatttgattcatcagtttcttctagaaaaatctacagttcatcattttttatttaataggaaatttgcagttaattccctctgatagaagcagtatagtgtaagggagagaacatttatttagaagttagaagcccaagttttgaattttctctccactagttactagcaaaatgatcctgacaaaatttccaaatatttctgagcctcagattttttttgtatttaaaatgataaaaatctgtagggacttctactaccagacaagatgttgtaacaaagaccaaccagatttattcctaacctaaaacgattgaaagaaacaaaaatgtatgtacatatatgaaacaagggctttcagacatgtaatatttggcaataaaaaactgtaatacctgagagagagaaagtaaacaaggtgagccctatgactgctccagaatatagcctggagaaagtttctaggtttcaactcagggatgaagggacttttggctaattcccagagttgaagagccagtgggtagtccaggaaggccaaggcagcttgagtttgcagggcagggtacaggagagttatgagccacacacagagaactggagatctgcagagtcccctccagtcttcagctggctaagagtgaatacatgaaagcctgaggccagaaaaaaatctatcttaagcattagaaggaaaatcccaggagctcacacaggcctggaaataatttgtgttcgcaccaacaagaatgggaaaaccttacaattcaaaaagacagcaggttggcaaactactgcccatgggccagcttggcctcttttcatatatggagctttattggaacacaacctcgcttatttatttacatattctctaaggctgttttcaaactacaacagcaaggttgagcatttgcagcagagatatatggcctgcaaagtctaaaagatttacttttttttttttaaagacggggtcctatgatgttgcccagtctggtctggaactcctgggtgcaagcaatcttcctgcctcagcctcctgagaagctaggaagacagacacgtgacaccatgcctgagggtagcctaaaatatttactatcttgctctttacataaaaataaaattgctgagttagagtgctcagaagaatatcgcctccatagtgaagcaacattaactcacacctctggatcttgtcctacactaaagtcttttgaaccaccgtgttggctcatgtattcacctatttaattctcaccccaactcaatgagattgttactcttgcccctgttttatagttgagaaaactgagagacaaagcattaacaggcccactgtcacctagctgattaaatgtggagttgaaattcaaatccagagtctaaatccagagactaaaatctgtaagtttatgttattctgactcttattctaataattgtatttggctttatattgatacatggcatctgttaggagaaatgattcatttgctatgaatattgaaatagtcccattaatgacacttagtgatagttgactcaaagctaagacatggaatcctgttattgacattagttttcaattagttgcctctggaagaaaacactaaaagagaatctccctagtattatcttccaggtttctgataggtcttatgtgcaagaggcattctcattacatctgttttcctcctgggagctagaactccaaccttacactgcagtgtaaattcctattcaaggaattagggctgaatttagttgtcaccacaactcaaaatgagattgttattcttgcttctgttttatagttgagaaaactgagagacaaagacagccagcacctccagagcacttttttgtcttttatttaaggcctggtctgcttaaaaataattattaaaaactgaaataggaaaagaagaaagtggactgggccaggcatggtggctcacacctgtaatccgagtactttgggaggttgaggagagaggatctcttggccaggagtttaagactagcctggacaacatagcaagatttgatttctacagaacattttaaaaataggcagatatggtaggacaacagtagtcccagctactcaggaggctgaggtgggaggatccctgagcccaggttgcagcaagaggatggctgagcccaggttgcagtcaactatagtcctgcccctgtactctaacctggatgagtgaatgagaccttgtctctaaaaaacaaacaaacagacaaaaaataatttaaaaagaagaagaaagcaggccaacttgttttatctctaaagcataaggcagatccaaactaagatgttcttccgaagaacaagcccattctaccacatctggacacagagctgtaagaggagaggataaaatacaagagagaaaaggtgaccaggtggtccttctgaattattttacaatcccattatttcattacctgttgagtgaccctattgtatatgcaaatccattttgttcttaagtagaatttgggcctcactgattctggagaaaggaactggagaaactgaaggatgtcagactatgtggctctttggatgcacaagtctatgactaatacctggaatgaggtatgctatgctccaggaatcatgcttcctttttcaatcaccgcagcacatgagttgggtttccttcctcccattttaaagttttaagagatttaattacatgtgtatattaataaatacacatgttcttacagttctgtaaaagtcagaattgcatttcattaaaatgtaattttaatgtaatgtaaattaggaactgtacagtaaaaaaaactgttatgctttatctggaaatttaactatttttctctttgattttgtcttcttatcccctaggctagaagcaattttatttatctgccagcaagtatggaaaataacatattaataataatggggacaccttgaaaactttaactaaaaacaaccaaaaatatattaatttagggataatagtcatagttgtgcagttttataaccataaacctgttctgatttgtataatgtccattctgattggttggtgatcatgtcatatcagttattaaatatttagactatcctaatgatgactcataaattatgataactaaaatgcatttcaattgcatgatttatgatagattaatataaattaaagttattgacttctacaaaatataatttattcaggaaacgaagtcttgttcctttctgatatcaggcttgaaagattgtatacttaatctaatgataacatcattgcacaaattatgaatcctcccttttgtaattgtcttcacaactttaagcacaatgttttaaggttccccaatacccacaaatcttttctctgagtctagactgaattttcagaaacatcgagaaattattcatgtctccatcagaaaaggacatttgaatcaggaacaaacgagggtctaaacagtaaaattgttgttcatctgtgatttgtaatatgaaattgagtaggacacttaacctctcttgacctcaactttatcatgaataaaatacaggttttgattaggtgacgttatcaattaggttcacagcctaagttttaaacaattgcattttttcctatgtttagaataattagaacatgatatcctgagtcaaacataatattctaaaataaaatttaaatgctcctctatgctattttaaacttgaaaataaaacatcaaaatgtaagtaaaacattccacttttcctcgatccaaaacagaaataaaatttgatataaaaatattatttaaaaattgagccccaaacataaatggcagctgtattgctcagcaagactaaattgttattctcgcatacctcacaacacggtctctgtagcaacaggaattttgaacaaaaaaaatgcataaattccaacattttaataaattaaattaatgactggatcaaagtcttcttacaggactatataagaacctgactcattctgattaaatcagagccgaaaaataactttacaaattgcagcattatgcaggtgcagtcaaaggagtgtcattggttaattccttaatttggggtagtatttttaaaataggtatatttataatttttgtttagcgctctgatacagttacataaaagtataattgtaataatataattggaacgctataggtatagacaatcaaaaggtgcttggaaatattttcctacttaaatacctccttggaaattgtttacaaagcaactatataacgatgcacacagttatataaaaacaattttaatctagcacatgcccaaataatgatgaattctaaattagtgtaatcatatttagtgaagatatatgtatataaacaatgtgctaatgccaaattatttttcaacacatttaagaaattcaaaagatttgtatctatgtggcaagtatgagaaattagttgcgtaactatacacatcttagtatcatctaggcaagaaactactccagtgcatataattagctatgctggtatgtttgcagatataataaaaattacatgtataggctggcataggtcattttgaaacatgaaaagatgacattcttcatacatactttaatcaatagaaataaatttatacaaagaaagaagagataattagaccttttacttttttcctaaggagcagttattacatttaagaggaatgtgttatttagatctaatagcatatactagtcattagattgaaaatcaagagttaaaatttgcagtgcacacatactgcatgacccaaagtcaagtagctcaagaatttgtcatctttttaatagactgtgtatacaaaattgaatagataatcatctttagtctgccaagctgatactttttaataggataatcctttaagggaagctgtagttcaacagatgtgcaaatcaacccagaacaaatagcacactactcttggagatagagcctgcacagttggcacttgtgataacttgtagttatatttatctaaaattgaatttcaaactatattcaaatatgatttactcaaatctgattgaactcagaagtatattttctcacttgttctataagagaagtgtaaataaaaattgtttaaagtcatcttcatgtaacatctcctaccatgcactctatcaccaatagaaaaaataattgaaaggaataaatagcatattgttattatgaaaatcaatactctgtaaatattttgaaataatgataagcatctttgaataatagacatacatttcagaccatgtcttctatccaaaaatgttatcattccctctcttatatatctgttggtctaacagtgagaattatgttaattcggttgacaaatatttaatgtaagcctactatatgccaggcactgttctaaattctaggattcagtgttaaagagatagaaaatactctatttacaaagcaaattgaaacaatagacatgaatttgcaggtaatgactaggagtattgcaaacaaactgttccacatgttatatgctacatgtgtcatctgagtgctgtttgtaaagaatagcatgtatttgaaggtggagaaaaaagatgggcattcctataatattagctatataaccacctaattctcttctaatggactcaattaaattaatggactcagtaattagtgtaagttttgattattactgcttttttgttttatcctttatgcctttcataatatttgatttttttcttgtatttatactactttaggtaccatttttccttatccaaatttggttgtaacagtggatccttctgctacttgtgcttattttccttctacttcttttgctgttcttactcccccttagctcctttctctgtaatcatttttatcatccttttttttctttttcatcaggtacaaataactgaattaatcatacttctcagtatgtgataaacttattaatctccttttatgtgccgttcctactttcattctttcccattctccatggaagtttttaaatgtctttaatatgttctcttagatctgcagatatccttgaagaacgtatatatagagaaaattattctgtgtatgtacgtatgtaagtttctaaaaactatgttttgctatgcattccattcaatttcttgctttttcattttacagcatgttcttacattttacccacattaatatatgcctatcaatttaatcaattctgtctacttgatagtatttcatattattcatcttactattttatttatccattgctgtaatgatggatgcataattttcctataagccccttgctacctaaaggcattctgcactaaacatttttctcaaacagaagtttactgatttcatctagaatgtcttttattaaattgaaatatttagattatattgagtcaattgttcagctcccacttataagtgagaacatgaagtgtttggttttctgttcctgcattagtttgctgaagataatggcttccagctccatccatgtttctgcaaataacatgatcttgttcctttctatggctgcatagtattccatggtggagatgtacaacattttctttatccagtctattattgatgggcaattagattgatttcatgtttttgctattgtgaatagtgctgcaatgcatatatgtatatatgtatctttgtaatagaatgatttatattcctttggatatatacccagtaatgggattgctgaatcaaatggtatttcaggttctggatctctgagaaacttccacatcatcttccacaatggttgaacttatttacattcccaccaacagtgtaaaagcattcttatttctacacaacctcaccagcatctgttgtttcttgacattttaataattgccattctaactggcatgagatggtatgtcattgtggttttgatttgcctttctctaatgatcagtgatgttgagctttttctcacatgtttgttggtggcatgactgtcttttttgggaagtgtctgttggacagtgagagcacatggacacagggaggggaataacacacactggggcctgtagaggggtggggttgatgggtagagagagcattaggaaaaatagctaacccacgctgggcttaatacctaggtgatgggttgataggtacagcaaaccaccatggcacacttttacctgtgtaacaaacctgcacattatgcacatgtactccagaacttaaaataaaaataactttaaaaataaatttaaaaaatttttaaaaaattaaagagtcaaaactattttgtttgtctttgtatttttttggaggagggattgctgaagaatatcaaccctgctgttaggtcacaaaaatattcttctcttctagcatctttctcttttagctttacgttggtagcttttacattttaggtctttaatccgaggtgcaagggagtgttatcagtccatttttcctgcaacaacaaagaaacccaggatcttcctgacttatagaagcatttgtttctcgttcccttatcagaaagcttcaggacagttcaaggctgacttgctttcctgggctcagcctaatgccatgtgtctgatttcagatcccaggaccttttggtgggacatgtcctcatagaatgagcaggtcaaatgaaaaaccaaacttgtgcaatcacatttaaatcttttttgagatgtcacaaattttaagtctgtttaacattccattgaccataagaaggtcatagcaagttataaaccaagtacaaaaccactgagatggggacatatatcctattactacagatatcaaagacaagtttcatggtaataggtggagatttttaaccctattacagggaagaagtaagtactgggaacaataatgactatagagggagattcaactttatttctctttctaataagtcagttttcttaacaccaccaactctactattgaaacttgtctcgttgatttgtgatgccacttttattagagatcaacttcaaaccaatagacacatcattttctgaattttcctttctaatatgctggtaacattgcctgtttctgatctagcacaatactgtttttgttgccgtgatgttctagtattgtctgcttaatatctaaatgaagccacactctttgtacttctttttaaaaagtatccattgagttttctatttcttgagacttttggagttatcccttttaaaatttcaaactgtatttcaatctgttagagaacatgatctgcattaagttcatcttctatgcaaatatagacaatttgttcactgccccttgtttaggcaaaaaatgcatttctgtgcagcaattggttgattcaaaaaatttatagaactttcaatttagcttattaactagttattcaaataatttatacaatttattttttgactgcttgagatctcagtttctgacatgcatatattaaaatccttaaccacaaatggtaactaatttatccatataaatctgtcagttttcactgtatgtattttgaggctatgtttccagatacatatatatgaataatcattatacattcttgatcttttttccctttgtcaaatataacatctctttcatgtgattttgccttaagttctattttatctcacattaaagttggcaaacctttttatgtcatattttccaagtaatcttttccatacctttactttccatacctttttatggcaatttgtttttatttatttttgtttttctccccaatctgatatttatatttttgagatggttaatttactcataatagttgcattgtttcctacatcagtatgcttgcttagaaaaatttttgtattggtcagtattctccagataaacagaaccaatatgtgtgtgtatatataagaatgtatgtgtatgtatatatgtgtgtgtgtgtgtgtgtctgtgtatatgtgtgtgtgtatatatatatacacacacatatatacatatatatatacacacatatatacatatatatatagagagagagagagaaagagagagagaggaaaagatttattttaaggaattagcttatgtgattgcgggggctggcaattgtgaattcacaggttaggcaaacagtctagaggctcagaaaaacttgatattgcagctcgagtccacaggtagtatagaagcagaattccttctttcttgagggccttagtctttctttattaacgctttcaactgattggatgaaatcattggattggatgaggcccactcacattatggagggtaatctgctttacccaaagtctgtgagttcaagtactaatcacgtctttaaaaaaaatacctgtacagcattatctacactagtgtttgaccaaataccgggtaccatatgtacaatggcctatccaaattgacatataaaattaaccctcacaatgctacattgtgattgtcttgaccttgtctttcccttgatgatcttatttctttcaggaaatatttactatgccctattctagacagtaaaaatagagcaatgaaaaaatatatctgctctcatagaacttacattctacttgagaaagaaggttcagtgaatgggaggtggatgataaatagctaccgaaattaatgccaacatatttgccaagtggtgataagtcttatgaaaaattaagacaagttaagagaacaaagagtgatgaagtggaatattactttagaaaggatgttctgagattacttctctatgaagtgatacacatgagcagacacctggatgaattgagggaatcagtcaaatggttatcagcaggaagagcattccagaaaaaaaacagcagtgcaaaagatttaaatctaaattatgctttttgtgagtgagattggataaggaaaactatgagagatggatcaaagtgttagccaagggcagattatggatggtcttgactgtggcaccaacgctggtctttattctaaaaagaagaaataattataagttagctcaattttttaaatgcatgtacatttgatggggtataggtaaattaaaatcttgccaagagaccaacacatgcaacttaaaagagagctaatatatttgatctcaaataaaagaacaaccaatgaatttgtctgctattaattatggatgatcaatccacagcaaatcattcctatttatgtctaaagacatggtgggacttaaatcagagacttaacagtataaaatggtgtagaaatttaaatgctccggacactgctaagagacagcaattaataatatcatgtaatgaaaaattttgtaaactactcttatattcttgtataagggctattagatgttctgctgaggaggagatagttcatgagtttgctactttctagttccacatcaatggataatttctccctctttactgtatggaaatttataatatgtagacattttgatgttgataacatttagaagtgtttaatttttagtattatcagcctgacagacataagttttattaaattagtttgagaatctctttgaagatatttgcatctgcataagtttgcatgaaaaaaaagtttgcattttagggggaaaactattatatcagtgagaattttggagtattttgcttattctttctggaactttgaagtaatgtgaaatagtgtttagaaacctcatctcaacgtagggggcttcttagtaataatacactgtatctgcatacccgtttataggttttaatccaattcattccaccaacatatcttctaatgcttagtcctgttgtcttctcatgatcaaaaatgaccccttttaaaaatgctttgcatcaccatcctttttttttttttttttttttttttttttttttttttgccaaaattgacatccagtttgttttaagacagtttcattaggtcatatgtctagatttgttacctccattcttcctctgcctgggcctaaactattctataatttttctctgtccccactgccccccacccccttgaaatcatagtcaacaattaaactttgctacttataagaaagacttgacctggctttgggacagccaactgagcataaagtggtgaatatgctgttgagagtagtgcttataaccccatcatatgtcagtcaaccagattagcatactgctccactattttcattaatgaaggcagaatttgtgttaagaaagccatatttgctacaattcaaagtcaattagctttctcgtgaaaaaatgagtttctcatttaggtgcttaatgttaaaataaagagggcattgttcatattaattataaaataattcaaaaagacatctctagacaccaatcaggaaaagataatcactgaagattatctgaaaataaattaaatgtctaagcataagtcttgttcaaatataatatctcaaatccatgcaatggaataccatgtgactattaaaatgtcataaatgtgcatataatgaaatataaagatagattttcatagtacatagtgaaaacaaaggcagtggaaaaatgggatataggatgtaacttcacaataatcatctagatagagaggtatatagacaggatgctgtgctgctcattctccattggccccattcctccactcatccattctatgttcttctctgccttcctctattccctgggaggctgacttgcctattgacttgtgtttggaattgacgaatgggaggcacttacaggagagtgaagggcaggaagagagggagattggagcatctactccctccacgcccccgggctcgggtgcacttgcacagtggctgcattactctccagctacagctcccatcaggccgacttactcctgagactggttctcagccaggctcctgttaggccattttctctcctcaagcctagtgtcagtaacaactcttcactgcttctaatttacatatgtatttccttaatttattcctctatctttaccccttggtaaatatttagtcccttcattaataagtctctttaaaacttccctctgagagtgggctctttgtttcctggcggggccctgaccgacacagttgctcataaaaggcctggcatgctaaccactacaatgtgcgtaggcattctctgagaagtgttttgccttttgttctaaattttctaaagtgaatatataacgagttttcaatattaagaaaatcaagtaaaaatgtttctgtacatgaaagagaaaaaatgaaaataaataatgctagtatgaaaccaagaagagctggtatctttttaacttgttttaattggccatattggtcttaaggacctcccacatctaacactaagtcttacccatctcctcccaaatgagttagaaagagaggaggagaagggcagatgaagaagactcagctgaagccaagtgaaagttagcatttatacctaatggaagttaataaagcttaactccttggacttcacatatgtctggaaggaagagattttccactctactgtcagggttaaaacacttacatagcataattctaactccggctctgtccctccttcctctctccctctatgaaagtggtatctatcttggtaactggtgtcattgaatagcctctacttgtgccgctctccttggaaaaacttgtcatctagtcacacaggttcttccatctattactgccagcagacagcaccagcagtggaggcctgagttaccacaatgctgccaataattaggtgggcatggttcattcactgtggggagtgttaggatgcccatgagccaacaaatttgtgttatgtgttcagcttggccttatcacattttagctgcattctgttctccctataaatcctgtgccttttcctgggggtggttccaaactggagaaggaaaggaaaggatactttactgatgttctcaaaacacagtaacatttagatcccttctatatgcccacaggaggcaatatttttttaaatgtgtatttttgttattctaaatgtcttataattactgcagtcatttttgaaaagaatatgaaacacatgtaaaagaaaaatcatgaaatcataaaagagttaattgtatactttttatgaaactataaaatcactatataatatatatttgataatataatgttttcagtctaattatatactttttttttttcattttagttatgtacagggacagtagaacagttaggaaccaaggtctccagagtgacactgactggttttgaatctagattctaccacttattcattctctaaccttgggcaaattccttaatttttcttttctttttctttttttctgttttcttttcttttttctttttctcttttttttttttttgagatagagtcttgctctgtcacccaggctaaagtgcagtggtgccatctgagctcactgcaactccgtctcccgaggtcaaaggattctcccacctcagccttctgaatagctgggattacaggcatgcaccaccacacccagctaatttttgtattttttttgtagagatggaaattcaccatattggccaggctgatctcaaactcctgacctcaagtgatctgcctgcctcagcctcccaaagtactggaattacaggtgtgagccactgcgcctagacagttccttaatttttctatgcttaagttttcgcctctgtaaaatgagaataacaaaatagtgcatgttgttttttgtgagccttaatgaaatattcatataaacatggtgaataaggcataagtctctgcccttattgtttacacagagaagcagaaaattaactacctctttctttctgtctctgtctcacacatgacacgcacgcacacacatgcacacacacacacattcataaatggtataagcaaaataaagccatgttaagtatacacagtgaaagagtggatagtcatattttagataagatgtgcaggaaaggcctctgagaaaaagcaactttcctaactgaggaagcaagtcatgcacaggtcttggcaagaacatttcaggctgaaagttccaggaggcagaccattagttaaaaaaatgttgcagaggtccacgtgattagagtggaatgaataaggaaattaagataacgctgaatcgattacctgagagcaaaggggaacaaaccccccgggtaggttccagactcagtatctgagaacttccaaaggatgtggtactattttacttaatggtgggaaactgtgacaaggtagcctgagcaagtgttgttacttcaaatgcagctatctcaccagcaggattttgtgtatggaatactacaattaaacattgaattaaatattttatgttgtttccaaaactaagtcattatgattgtgtatgatatatcccaatgttttctattaatggtttccagaaacaccatctttcttttgtaggttagaacattatcatatgaaataagatgccaagaaaagaacttgttatatcacgtaactcataatttgataatccttgagtattcataattaaattgaaaaagtcattatttcttggactataatagtatctgagatgtaaattaatgtatttatttgttactaaccaatataatttaattttataccactttaactccccattttgtgttaaaaaagaacacaatcataatttgactcctttattcaaaggaagtaaattgaaattcaaagtgttgcgcttaaaagtgagttggttagtgtttaactttcttttgagcacttctgtccccaaagccggtcagtactttgcattttggtcatttttcttttgctgagataatgagggtggggactctttacaactgcaggcaattgctttgagctccgagcactttgaagagattagccccattgatattctctccaatatttttggagagaaatgctgccttcccttgagtgtaagacgaacggctgttgaatagaaacttcttttgtctagcagagagtatggtaatacatattctcttcttagagacatatatacaacattagaaagttatctaagatgattgggagcctcactacactgacttgttaattttgtttaaactttcagttaaatgtggtctcatttacctggaaagtatccttaaagcgtttgagcctggattgtattgctattaagccagtgaacttggtgatgaacaagttaattatcctggggataaaaagggaaaacggcataatttctgccagcaatacagtgaaaaatatatgagtgaactatttggaggcctgcccactcagtaggacttagctggccagtaacctgatctctctggtttgagttcatcaaagacatttctttgatctaaaaatgttacagaatgctaaaattcagatgaagccatataaataatataaattttataccacttgactccacatgcattatgtttttgtttcagagaggttcagttagcaaaaatatcaattcaaatgacttttctgtcattaaaaaaatgccttttgtgggagagggatacacatacacttaggtgtgtatacatatacacacacacttaggtgtgtatacgtatacacacacacttaggtgtgtatacatatacacacacacttaggtgtgcgtacatatacatacacatataagatataaattaaaataaaattaattaaatatatatttaatttcattgctgcaattctacctagtgtctcacataaatacaagatcatcatctactgattagcttgctcctgcagacaatcggatagatactaaaacctcctgaaggtcatcataacctcattttctgaaagcatcccttgaagttcaatagcttagaaagtttctgttgcatttgtgtcccttgctgggttgtatatacataaaaagggatattactttcattcagagaagataataaaaccttgtgatttaggaaacagggttatcatcaaataagccttttatttatgctattcagactgcctatcttcaggatatcgcaagtactgatcaatttcaggtcaattggatgtgtgaaatagaagtgttgtggtataagctcatgattatgtcctgtagcttgaaacagtgaatttgattacatgacatgttgctgtaccctctttggtcttattgtctgcacacttcaaataatctacctgtgccaactctaacagcccatttcattctctaggaaataaccttgatataactctaaccatttcttcatggtgttagaaattataaactcataccaccttcatccttagaactttttaactctagtcccaatatcattatccaggattctgggcaggctgccatatagcactgtgatggataaatacaaatgggtgtgggatttgctgaagggtgtctaggctcagaaaattgccattgtgcctttacatccaagagcgcctcacaagattacaatattttgtgactccttaaccttggaaactagagtccatgagacttttctaagatcataacaactttcaggaaaggagataattttctgtacctcagaaaattctgaggtacaggtctggccacttttacttcaggccaccaccttagttacactggaccttaattatcatggcaaaaatgtgaagcatcaatttttgactcctttacattgaaatagatagtttatgggtgcttagactgtcaaagctctcctttatcagtgttcttttctctaatttacaaaatatattttgttgttttgttgcactttgctgagttatttatattccccttgtacagatgctagcatatcaataaatagtttatatattttataacatcacagaaaacatttattgagggcctttgactctagtcattatcattacttttcacaaacttgcaagatgatttctaagaaattctcattaaactcttttaaagtttaaattcgaacatattttctcagcaacttttctttgcttttaaagaactttggctccttgcactaacagaataccatcaaatcagttctactcctatgtagtaagacaaattttatctttttccatagaattgaataatttcatgatactagtttaagaataaggcttgaagatgctgatttgcaactgatactggtgcatcaagtatcataaaattccttaagaacaataaataagtaaacatatattttaagtgaaaagttattaatgtttttttctttttaaaatacattttattgtgtatatttgagatttacaacatgatgtatggggtacatatagataaatggttactatagtgaagcagatcaacatattcatcactttacgtaattacttttctgagacaagatcagctaaaatctacttatttaacaaaaatatctaacatagaattgcatctcatgttacacattagatctctgatttatcctgcatactttgttttttttttaaattttattattattatacttaaagttttaggttacatgtgcacaatgtgcaggttagttacatatgtatacatgtgccatgctggtgtgctgcacccattaactcgtcatttagcattaggtatatctcctaatgctatccctccccacttcccctaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcacgttttatggctgcactgcatagtattccatggtgtatatgtgccacattttcttaatacagtctatcattgacggacatttgggttggttccaagtctttgctgttgtgaatagtgccgcaataaacatacgtgtgcatgtgtccttatagcagcatgatttatagtcctttgggtatatacccagtagtgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgaacattttttcatgtgttttttggctgcataaatgtcttcttttgagaagtgtctgttcatgtcccttgcccactgttggatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccgttgcttttggtgttttagacatgaagtccttgcccatgcctatgtcctgaatggtaatgcgtaggttttcttctagggtttttatggttttaggtctaacatttaagtctttaatccatcttgaattaatttttgtataaggtgtgaggaagggatccagtttcagctttctacatatggctagccagttttcccagcaccatttattaaatagggaatcctttccccgttgcttgtttttgtcaggtttgtcaaagatcagataattgtagatatgcggcgttatttctgagggctctgttctgttccattgatctatatctctgttttggtaccagtaccatgctgttttggttactgtagccttgtagtatagtatgaagtcaggaagaagttgaatctctgaatagaccaataacaggctctgaaattgtggcaataatcaatagcttaccaaccaaaaagagtccaggaccagatggattcacagacgaattctaccagagctacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatctgcagtaaaatactggcaagccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatccttcatgctaaaaactctcaataaatacggtattgatgggacgtatctcaaaataataagagctatctatctatgacaaacccacagccaatatcatactgaatgggcaaaaactggaagcattccctttgaaaactggcacaagacagggatgccctctctcactactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtacaaaaatcacaagcattcttatacaccagtaacagacaaacagaaagccaaatcatgagtgaactcccattcacaattgcttcaaagagaataaaatacctaggaatccaacttacaagggacgtgaagagaagttattaatgttgaaacagttcagttaatgttgcctgcaggtattagtttaatgttaagtgctgaaagaaattaatgcaaaaattaatggcttaacatcatcaatatttacttctcactcacatcaatccaatgtgagaaggattctgtgccatacatacagtatttcagtagcccaggatggcaaaggctgttccattttcagtatttagcttcaaaggtcactctgggcataaacatctagccagtggacaggaaaagatagggaaagctttcttcatcacttttgcacgaatctaaaataaatattttccactactagggccagaggccctcaataaataaccacttcattcagttagcaagtactagttccataccctgcctagataaaaaggagactgagaactgtattccttggcatagtagccattttcgagccacaactctaccctgcagaagccagtctgaatcttcagtggagagtcaacctgtgtctacctgaacctgtaaattgttactttatcagctataattcttgggttgcagtcaacagaaattgattctgctatctctcctaagaaagaaatagattagaaggatatgatgcagtttgcagaattcgaaagaaggttaaattgaggaaccaggaataaagaaatatatatatatataaagaaatgtgtgtatatatatatataaagaaatgtatatatatatataaagaaatgtatatatataaagaaatgtgtatatatataaagaaatatatatataaagaaatatatatataaagaaatatatatatatgaatcagagaaattctgtgaataaaaggaattggattgatgaatgtggtcttctgagtactgtcaacatgagtacgtctcatctcaagatgagatggctctagccactttctgtccaggtgttattccattcaagatttgaattaaagaaaagaacatctgattagcagagcacttcctcttggctagtggagatcggggtatcttgattgacagtcctctaagattttacccaatgagacatgggaagacacctcaaagccaaaacaaaaaagagcaatgtcaaaagaaggggtgatagaggttaggttgatcaaacaatatatatgcttttaaaaaatcagttatttcagactacttttagtttaatacattaaaaagcaagaaaacagttcctggtcagaacagcaaggagaaaaaactgataaatcattataatcagtataaaattcttcttcctttttgttgtaatttgatggccttgaataaaattttgaatccttcagtagttaagtttctttatgtataaaggtgcagatgagagtactttgtcatatgaggcagtggtgtttggttgtggggaatgggagggaaacagcaatgagaattaatgtgttagccattttatatgttgtgatttacttggaatatcccataataaaaacatttttactgcttataaataaaattatactttgccaaggagctattataatatactaatttgtattccactgataaattcatcttttaatgtatggataccttcagattaaatacaggtttattaaaggcttttgttgatgacaatgtcctcaaatatagcatttaccaccatttcctgacaaataactatgtggtgaaatggatccaaatgaacaatatctaagtagataaatgttaagatactgtaaaggaaagaaacttctttttttaaaaaaaaaacaatattattgctagctagaggtgctatagatagtcatccataaaaataaatgccaggtttgaaaactacaggatatacctgtagaatatcataaaacttacaatgaaaaaaaatcctccaaacagatcttaatatgcccctcttatctgttcactctatcctgtagctgtagttttccaagtaggctactaagcggtctttcaaagatttattttaacaaatggctgctctgtctatgcacaaagaaaatgaaataaccctataattttgtgaatttttaaaggtaagctaacaaaaagattcctttcctgttcctttgattccaaagaatgtatagttgtatattattttcccttgggagctcggtaagacaatcttcccctgagtctttattcaagtatttcatataacaatagaagtacagtgatggtcaatttcttttaaaattttccatgtatgcttactctagagcaaattccactagtgcccttaagagtctctagtggaatttattgaatgtgtgtgtgtgtgtgttttatatatgtatctaaaaatagttctttggcaaaaaaatatgtgctatcaattttttaaaattacactggcttttctagactttattaacgtatctccggagccagaattttatgctaagctttttttaaaaaaatttctatttgtggtatatctatattcagttataattggggaaaaaccctcacttctggagtgctgatgaatatagaattatttaagaattaagattatttcaagaattatgtttggaataaatctcttaaacacaattctcagtatgtgagcttatgatatttatatgaaaactaaaaccatttttcttgccaatggatatgaaattattgtcctattagacacctagaccctatttcctgcagaaaggagcatcattcataccattgcctaagctcaaagtccctgaattttccttaacttctttttcttaacatatggaccattaccaaatgtatctattttgcttgcagaataggttcaaaatctaaccctttagatgaattgtctttaaaaagattgacttaatggtgacagttccattttttaaaattcttaatgggacctatggttctaccagcaattctctagtattccaggaattctcaggattttacatctttgctgtgactttcctgcttctgcctggcaaaccctgattcattctttaatattctattcaaatagtactttttctaatatcactccctcactttttctcccaactctattttttaggcgaaataaattcttttgtcatctttgtaagaattatgacagaaggtaggttttttgtgaaacaaaaatgcttcttatggaagttatatttgctttccgttgtacattgatgtgttacagaatggcttagtacttagcactgtagtttgctgagtatttatagtacctctgctagtatcaaattaacctaacaaacaatgaagttttataataattaataaaaaccataagtttgttcctataagtaaatattttatatgtcttaattatggagaaaagttcaaggtaaattttaagttaaaaaagcagaatatatatatacatatatatatatatacatatatatatatatatatggccagaattgttatatctaacttcacaaagtgtatgtatatatatatatatatatatatatatatatatatatatattcatactttatttgtacatataaactcaagtagatatatttgtgtttatatatattttcaaatacatttacacagaagaaactgagaggaaatataggtacttacttttattaacccaaattagcttatttttaaaatgtcattaaatctaaatatacctaactagggtattttgagaataaaacgttcttatttgactgaattatctttcttcagacaggagatatcagagttttgcaaacactgtgctatatttttataataaaccaatctaggaaattggaatgtaggagtttaatggttgctatattatgtagtttgtgaaataatgaaagtgagggtaatcaatgtgaaaaactgcatatataaaattagaaacagatgctaataaacaggtggttgaacaaaaaatactatggtactggttcagcacgcttgtgctgaggaaacatctggatgtgggtgttttactccaaagctagaacttgctaacaagaaataaaaacaagaaatttcttgagtgaatagagtgaatcaaaaagtgattttcaagatgatctttaagtctatattgcttttgaatgtctatagagtaatgaggctgattcacatgcaggaaaatatgtcgataacaaatatcataaatagagcacacgtgcacatacaactaagtttgttttgtagcacacccagtgttttgaaaaatattaaagtaatatttctaatttctattacccagtattcgaagctgaatttccttacaaaaacattttgatgatttttatcagaaagaaacatattttgaaaatgtatccttctgaaaatcttcctagaagtgtttattatatatagtatgcatgcaaataatatatagtttattatatatagcgtgtaaataaaagcccagttgttaccgtcatttagtagaaagcttatacaattttcttttgacgtatgaacatttcttttgcaaactaagatgacccactctacaatctacaatcactataaaactacaatacctgagtaatgaaaatattgccaaactctaatcacttctctacttttagaaatatttagtaacacaaaatttaagtgtataaaaccaaaacaaaatcatctagcctgtaggaatttgttgcaatagtatttgtttttcaccatttgccaaattagaaaagctggacctgtgatctaaaagatccaattctctggtcaatttttttatagcctgcattgtttccattgagttttatgctatcagttggtataattttttttttctgtttggccataatattgtaagcatacgaaatgggcaatatgtcaggaataattaggcactgtggtgctgaaaccccagcgtatatactgcttcttttatagaagaaaccagttacctgtagtcttgtcagtttaacttagcaaagaccatctgtttgcagccacctcttttctcagaggagcattccctcttccacaaagaattgctccatgacgtcaaaaacacttttctctacaaaatggtctctcctgtcttcatttctttctgttttctaaactgggttgctttttagagaatcagcaaatgtggcactagataacttaagaggtgaaataaaatgaatccgatagacagtgctctcaatagaatagatatgaatgtgcttagataaatgtatggctacaggaggctttcttgtggacaataactatccaaaaatatttacatgtatttgggagtctaggtttatttgcaacagtaagccaactggtatttgtcaattacatttaaatttaaatttaatttcaaatcatactgaacattatgagtggaaaataaatggttttatgtgcttagaatttaacagtttatatgtaatattatgttttggaaaaacatgtaaatggtgttagaatagttcagctattactaagccattctgggttagcagttattcaggaaaagactgtcaattttatataaaacctcttagataaatagtatgggtatatgcgaaattacacagataaataatattctgcatctttcatccctccttcccatttcatgacaaactactgttttactaaatatgacaatgtatattttaaaaccaccagaaattataatacctatatttcctgcaactggggagtaattcagagggaaactgggaacttacccagtggtgtatgcttgagtttatatgttttatacatatgttgagggaagaatgcggcaagcctgacatttctgcatatttcatggtatttagggaatttgtccagagcagagtggaaattttttgttctagccctctttgttcatatgttgccacagtgatctatgagttaacaattaatggctgtgatatttcagtgcaaaaggacagttgatcatcaaaataactcagatatatagtcctgttataatcattagaatagtatttagtatccaagtatttccaaaataaattcaataagctataaatagataataatttccatcttatttaattaccaacaaactttttctttgtagtcagtattcatccttcctttaaatgacaagttagtgccataaaaacaaggtagcattcaggaaagcaatatgcactgcactgatacagaataatcaccaaagtaagaaaaaggatgtatacttggagttaagacacctagacacatatttttataattaagtgcaaattgtaaattatttctttgcagtatgggctctgatagtggttccaggattagatttttcttatacctaaagaatattttcggaataattaacaactcatattgaatctgaaagttctcacattgggctagatgcaacgtgacctttaatctttacctagtttaaactcatgccaaaccaacctgggatcattttgggccttgagtggattttattacaaacttctgttgtctctcagttaaagttgcccccgattggtttagttttcagttttattaaagatagttattatgtaccatccaaaagtaaacaagacttctgggtaattttacttagcatagtttgttttccaaataaatttagaaataattttataaaaatgacataaatattgcttgaaaggcattaaattagcaatagtcagaacatagcttaacagagaacatctgagaagaaagagaagcaataaatgtgagtagatgtaacaaaggaatatctaacatgagaaatgtgatttttatattttcaatttgtgtccctctctgcctagtactaacagacagaaataagaactgaacatgatgtaatgaacagagaaaagggaagtcatacttcttggctaaaggaatggtacaaaatagaggcctctaacttgacatgacagaaagtatgatgggattttcaaggcatcccaaggcatcccaggggagctttagacgtagcttcctatcttataagcagtcctttttctcactgcctgcctctgctggccaccaattctatatatgaacaccatgaagaaacataatgagggcacatgtaaaatctgctccactcacagatattctctatccagggtgcaagctttgctagaggccgtctctctctaaatcctttttcttcttttcttcctccactcttactgcattctttacacatctaagtttaaattccataaagcaaagagtcttgcaattctctgccattgtcacttccataagatgtaaaattgtatattttagcccagcaagtacccagtagtcaagtagatgtgtttaatttttacattaaagtgtaaacaataggaaaaagacgatttgacctagtcaaagttgtggttgaaaggctctctatctaccatgcctcttgcatcacagtgacttaaagtgcttttctagatggcctctaggcatcacaactgcatgctgttaaattcagccaccaccagcacacacatactcttcatacacgtacaaactcattgagaacagaaaatgcaacagtgatttaaagccctatgttatctaaaaagcttcatggtctttaatcttttaaatgttttctacttgatcatggaataaaatgaactgacagtttatctctttcttctctctaccttttgctggagatttaaatatatatacatatatatattgtacatgtatatatataacaaaagaagggaaagtaataaaatcaaagatcctagaaatattccataccagataacaagctctgttgttatcagtttgtttattttattattcttataagtttgagactctgggtaatcagttttcttgattttaaaactaaatataccaatgcctccagtagtacactggatattcttaaataccgtctatgccttttcaaagtatatagtctaaaattgatgtgaataatgaacagatggactaatatgtgcgttacacaactaagattaaaaagtaacagccagtctcacaattgtttcttctgtccaatataaatgctacaagattatagacatgtaccttaggtaaatgtattttataatagggatgaaaaggactgcaaatctttaagtcaaagttagttgctttttgtttctttgtttacctttaatcctttcatggctgttacctgatgagtaagccaggaagctagagatatacaagatatataaatattaatgttataaattgggataaagaccaaaataattgctccagtagattctgtggtttttatacttgctctgtattttagcaattgtaagaaacgatctccttacaaggtgccagaatcatgtcactttattgtacataaatatcagatcacattgctcagattttttccaaacttcagaaaaattttgaaaaaaataatatgacatacactttaaattttattttattactgtggccatcaattatgtgcttcttatatcccaattataaggaactctagaagaggtcatagcgatgaagtgcctggcatatagtaaatacacaaatacttgttagaggaatcaatgactctaaccattggttattttcctaatacagtaaattagtgataatctccagtttcattattcttcctcttttaaaaatattcctttgtatacctaaatgtaccatccctatttgaattactgcccgcttccctcactttgaaaatccatacatctactacatatttttctatttgtggttatctgaactcagacttaacctgaagcagatccatttctgtccccatatcatgcctaaatttacttcttgagattactatgccctattatagacagactttcactcagggacaaagaggagaattactggtgaagagaagctttaaaaataggggctatttttcttagataacaaggattctggagacaagagctactattattggtgtgaaggctcaatgacatcagggtgtacacctctgcaagtctctcggcccttttactctcagctaaaatgtggctactatggctctcagcttgttcaagtcaggaaaaggagtgaagtggctcatttttcttcaataaagaaagcagaagctcttccagaaaaaccataacacacttttgtttatacctaattggcttgaactttgttacatggcaaaccatgatgaaagggaagcagggacaagggtgctggagataggtcagccctatcactcctgtctcattttagctcagcttagaaacctgtcctggctgataatattttcgtcatctgtgtagtccaaacttgcagtgagagcctgcttgtcttttcctcaaatgtgcttttatgaagaccaatgaaaggcttcaccgaagcctccgtgtatagattaccccatctgagattataaagaagcaatcacaagtggttgaggcaaatttaagctccatacaggataagtacatatcttaaaacatttgggggttttgacataaatcttgactcattatctcaataccatttaggtccatgctattctaactgtggtctttactatacatgtatttatagtacacattctaaatgtttattttcaatttatatacttatcatggaccattaacaaagagttggcaaaccagagccagtttgccaaccatatatcatatgaaataaatatgcttatagtctgatatttttgttcttcactgacatgtggtaaacatctctctgcatttcttgtttcttttgtttgtcattttgatgataaaatgcataattcttggtataccatttaaataaaattttattataattattggatattaaaactcaccaaggattatttttgtcatataaatgtaaagttagttgaaagcttttcaagctttattagtaatactaacagccactcatcccaactatagtgtctctataattgccaatttttactagtttacttttaatgtaattgggttagctaggctcactcataaaatattaatgtttacactgatttgttttgctttaaatgacagcaaaaaaaagacatttcttttgtcaccccacaacattctcagggagaactgtggtacgttatgaggctaactattgcttgaatattacctgtgcattacttaagggggaatctgcaaacagtttcagggccaaaaacaaaaggtcataatttgataaaaatcttattgcctgatagctcgcagacatctgtcagcagttttggtttcttttaaagggcagcacatggctgactgatctcatagtaggatttataagtataattattgccatataattcaacaaatcacttttatcactgaaaacttaaagctttccaatttttgctttttagccatttaaattttagggaaatagtcttctgtccaataaattttaatttcaaaataaagtcttcactaaaatttaagtagtttaatgacaaaatagaaatgaaaattttgtctttaaaaattttttttttgcttttgcatttagaatattctatggatataaaaatatagcagctgggccttttaggattacattgattattaatctcaataatcagttgtccttattaacattcataattaacatgcatagcttattgacaaaggtaatttgcttgcatgaaaaaaataggcttatttgcagaggctgaaaaatgctttgaaaagtgctcgttctagaggctcactgctttctaagcacactccactgtaatctaacatagacaattcaagaaaataacctttctgagcttgggtctacctatctcataaggttattatatgcataaaatgagacattttatgtaaatcagtgaacacaattcctaccacataatatgcacctgataatttatggttattgtacagaagcttatttcttagttactgggtagaagcagtttgtgtttggaaatgagaatactaatttggaccaaaataagaaacagaataaaataaattcgcataaatagatatacctgtcttaaatgtccctgaaagaattcctatgtgataaaaaaaaaagtctacagaatgatgatgagataaactgcacatcaagaaaactagagaaattacaaagaggtatttttttaaacattaaacagttacataaatgtattttttaaatttcgaagaatggacaactgtacataaactggagtgatgtgagaaggtgtcacagagcaagcaaaacttgcaggccagacagagacagaattattggagacctgtccaagtgtgcctgcgtagtctgtgacaaaggggcaaaggctaaatggaacagatgtatggtcatgtggagaccagagagcagagggacctgaccactatatccaaagcagccccacaatacacacccaacaagatatgcccttttagcctttcatcctgtttgtttcctttatatcatgtttcacaatccatactcatcttgtttttctattcctttaactgttagcaacctatctcccccactataatgtaagttctgttagggcagagtccttgtttgtcttctacagcactctgttcataaatacccagcactgtaccaggcataaaataatgttcaaaaaataaaagttgaattgataacaaagaatatgagctgaaaattaaatgattctttcaacaagcattactggataaactggggaattatattgtcaagtattaaaagaattccctgacaccttcaccctaccacattgtcttccaccacagaactgtgttgaataagctccccactgccacaggaggagtctcatagctcacagtgaagctggagtataaagcataagattgtcacctctgaagttaaaatgcatggtccaggtatatgaaggaaagatttatgagaatctaattactctgagtttttccttcttctaagcaaataaagactccatgggcaggggcaggagagaggggaagatgaaagtcattggggcttgagaagaatgaggagtgaagatgatgaaattatttagtaaaatgtaggaaaaattgtacgtccagagaattagaagagttacagatgaatctgtagaatctggatgaataaccatggctgagaaccatacagcttccccctccttccactgaaataacatgacataagtgttctggagcatacatgtcactccaaagagaaggaatagatggaggtaatgaatactaacctgactaagtacactacaaattgtcaaaattcctctcctatgggataaaaaagagctcaatacagaaacatgcaatatgcaagtagttgtttttttgtttttttgttttttttttgaaatggagtctcactctgtcacccaggctggagtgcaatggcacgatctcagctcactgcaacctctgccccctgtgttcaagcaattgtcctgcctcagcctcccaagtagctgggactacaggcctgtgccaccatgcgaggctaatttctgtattttgttttagtagagacagggttttgccattttggccaggctggtcttgaaatccttaccttaggtgatccacccaccttggcctcccaaagtgctgggattacaggcatgagccactgcacctggctgcaagtagtttcaacaggagggataaatagaagctttcaaagtttacacttgaggaaccactatggtaggacactatatgggcgtactctcatttgcaaaaatagttatacgttaagtgtaagtacatacaccaatatatatccccacacacacacacacacaaagttccggtatattcctgttttaatccatagtaatctcttgtttcaaatacttctcaattattctttcacttttgtctaggtgcttcataggtgagaggtactatgctatgtgttacctagcaatattttatatgggcaagttgatgtaaatcaattcaaaaagggaaagtaaaatcttggcaaacaaatgttttccttagctatgattattaaatctaagtactcattcatctacccattaattcattcaaaaagaattgtcccttttatcagaaagcaagagtttttctacattttattagcaattaaactaacatcttactggcccatatgaacaatatcatctcccctagcttgaacggaagctgagaaacaggctttttcatccactgtagcagaagacagcaaggaagaaaaagtctgggaattagtcatgtaaacaataatgtctgccataacaaacctcaggttaagacaaatccgcctaaccaaatcttggctatctaagctgtccagtttttcaggttactcttataactccatatcgcttaacctttttttttttctggtcggaggaaaggatgaaatgaggaagaaaaaaaaatgtaaacaaaatgaaataggctccaaactttcggacaaagtagtactttgagctattctctctagccatacctcttctcctttaatatcaaaatgcactactatttaagcgatttttgtattggatggaccttgagaacatatgactttaaatgctgacggtttattgcagcagttccatccagaaccataagaagcccaagttatgagaaactgggatagataggtcagagtgtctgcccctcctctgcccatatcatccctttctttgcatatccacttctccctggatacccacatctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtatttcttcatatccataaaaatgcaaactctttgcaaatgcaattgctcagtcttcagaggtgagatatctttacttctaagtctcttcctatccttatatttacctgctgtggttctgaatactaattttaggaattcttttgatattacactgaactgctatttttcaaatttgaaaatctctgttactgcaattacttccacacttcttaagcaacacatctattttttaactcatcctttactcatagcagtcatcaactaatttgatgataatcacttactgattcaagtgtggggtcctgcatccctttctgtgcttcatttatagcaaggtgtgtcagtctgggtgtgatttaggaggaaacaggtaacattttatacatagcaacatctcttgtccaggaaagacctcaactctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaaaaaaaaatcaccaaagctattaaacactgaatgcatcttatttttcatgtcagctaggtttatcattgtctctgccaggacattcatgatttttctgctgcaagtaatgttgagaagtttttgataaccattttaaatgccagtcaggtaaacagtcttcttttctctggacaaagctctatgtacctgtgcattttgcatattttaaaataagggcttgaattgggagaatttttcaagactacagtgaaatgtgatcctaggagactatcaccaaagcagcaaatgctaaacatgatttttttttgtattgaatgcataaacacctttttttttgcatttttctccatgatattttgatagaactattgaaaatactctagggaagagaaaagtttttaagaggtgcttttaaaaaatcaacttaattatatagttaagtcctttatttgtaaattaatttatgtaattcaagtagatatatgtgcttctttaccaaaaactgagctcctatagattatattttgcatcatcaaaattatcaacaatcccctttaacaactagtaaatgccacctgaaattttccgaaattgggatcatacagttggaaaaaaattgaatgaataaaaattttaattgactgaaccagtctccagaatgaacatcctactctgaaattatcttccagtttcctgttttgcactatcaaactctgtcttatctctttcctttttctctttttaccttgatgcatgcatatagacatatgtagccacacacctgtcactctctacacagtcatactacaatgttactagaatatgctccacgtctttcgtctgtgtctgcctcaatactggtaatctctcccctcctcctggcattactcttggagtgaaaggtagttgactaagattaaaagggaatatgagtgggacctttacaagcttcctctcctccctacttgccagattgtgttgtttgctttggaatttatataggagaaataatttgaaaatttttgagcagtgcacttcaattttcttcttcatatatgcccccaaattttgaaaacgaatatataccctcatataaaattgatagctcaaattatttttataaatttaaatggctacaaagactattatatacccttgtatacaattgatagctcaaattatttttacaaatttaaatgactacaaaggctattatctccagcctgttgtatatgatatatcatcacagatcaaatctttatgtctgcctcaaattcatatgttgatgtcctacccccaaatgtgatggttttcagatgtgcggccttaggtttagatgccattatgagagtgggggccccatgatggcatcaatgtccttataagaagagaaagagcctggagctccctcttcaccttgagaggacacagaaagaaggtggccttctgcaaaccaggaaggcgccctcaccagatctcatgatagcaccctgttcttggacttccagcctccagaactgtgagaaataaactgttgttgtttatcagctaattggcgtatggtactttgttacagcagcctgagctaagatagaaaagtgctgtaaatacatatttgtcaaaagcttgtagcgacaggtttagattattcaatttatagtaaatggtaaaaagccagtcctcattatcaaaccagtctgccaaatcaggcttactatgggtcagaaaagcctacctcaattatccattcttcttctgaattctagatagaatcacagaatgacagaattgtagaagaggagaatgatcaatcaatagatggacagataggacagagaccacctagcagaagcaggggtccttcactgagatatttttgatttagtgagaaaaaaggcacagccactttcaataatgcttatcagaactctctttggttcccttgctagactcttccagtgggagctatgcattttcaaattgccccttcgttggtataccaactaatgttataccttgagcagtaatttgctcctctttagtaaggtaggaaaagtgtgatgatgaaaacagaagttagaaaggaaaaaccagggccgggcatggtggctcactcctgtaatcccagcactttgggagaccaaggtgggcagattacttgaggtcaggagttccagaccagcttgaccaatgtagggaaagcccatctccactaaaaatacaaaaaattagccaggtgtggtagtgcatgcccctaatcacagctaggtgggaggctgagagaggagaattgattgaacttgggaggcgaaggttgcagtgatccaagatcatgccattgcactctagcctgggcaacagagtgagactctgtctcaaaaaaaaaaaaagaaaaaaaaaaaaaaaggaaaaaccaggatgctgtgaaccaatcataaaaaagagttcacatagaatttgaggttctagaaaacgatttccgtatagttatgtgtccatgtacttataagaatttatttgtgatcccaagggaacacgtacaatttgaagatccttgcttaaaatggttttaatatgcaaattcctgagcttcatttccattagtttcttattcaagcagtctgaatgaatcattggacattactttgggaaaaaaaaaacaggactaggacaaaagaatggattagtaaggaagtaaataaatattgctctaagagaagctaaagagtttaccacaaaggttgaaaactctgtgaagacatgcaagtttatgattcctttctaggtagaagtttatgacaatttgaacaaaaattagagggcttcaagaaacgaagcattctacctttccagtgatggtgttcatattagtgacaagttcagaatatattaaggaaggcacgcaaatgattgatatagaacagtgtagtcattttctccttcactgctcatctttccttaatgtttcttttttcctgatgccttaagaaaatagtgcctgtgtgaaataattaatgaataatgttaaatttgttaccgagtaactttacaatcctggtgaaactctttattttctatttcttagaaaaaaatggagatttgtttcttctatgaaagattggttctgctgtctcaggagcaaaattgaggagaaaataatattttgttcacagagtttatttagctgtgtttagctatgcttttgtaatgtattctttcaaaagctgttttcttttctctttgtcatatactatagtttgttctgtttattgcacttagtagtattgtatattcctttattttttttgtacttttccaaagagacagttctaatattttatggcatttgggatggttttgtttttcttaagtgtctttcatacactgtatcttctggttaacagagacccatgggtaagcaaaatactctgtttacaaaattgtgcccatatatgattattactctcttgctgtaatgcattgtaaaaaataagtaatgagactgcaataagcttctgtcttacatcaagttcccctagaacagcttgagattttgcaatggggatttgtatgcaagagagagcttttaagagaaacccaaatggaatgagagaagcagatcagggaagggacagaagccaagtgacgatgaagttttagctcaagtctgttgtcagcctggtcctacaaggacctctgctacatgatcagtactatagagttgtcccatctagaggcaaagcgaccaagctttgtatccccatatcagtcggctactggctgttaaggccactggtatagagggtgaggcataatttctcagacatttccaagcaaaatggattttatcaaaaggtaattttaaaaaatacatctatgagcaattagcagccaacacttccagtagctggtggatgggtgctgtcctgaccagagaaagggaactgggaggagctctggtcgcctctactagaactgctgcaccaagatactcatccaattaaaattttaagagcttttgctaaaattcattaacatctaattcaaagagatcttttatgtgtgtgtgtgtgtgtgtgtgtgtgtgtatgagagagagagagagagagagagagagagagagagaagggggtagagctcaaagctatgtctgccaagattttaggcagaatggttcagttaaataaaaggtcctggcagtaataaatctgtgtgatttatttgctgtgtaaccttgagtagttacttaacttttctgaatccagttcatcatctctgcaacgtctgtcatgggtagctacctgaggattattgtgaaaaaaatgtgtgtcaagttgctgacaaaagggagatactcactaaatgatggttcctattttatattcagtacaggttattgtcctccatttcatgacctcagacacttgctttgaaaacaaaacaaagaataaaaccaagtgagaaaatgtggctatattggtgcaaatgttctctctactgcaaaaacaaaacaaaacattcaacactaagtatcatctctgtgtaaaaaagtagatcatttagtttaatttctttaatgataaaattctcagacactaccaacgttaaagcaatgcaccattcagatgcacctttgcaccagaaaaaattggttggcattctttagagatgtttaaagagaattactctttatataatactcaactattatagtcagaaaatgctaaacatgacttggacaagcaagacattatttaagactgtaactgactcattctaaagcaatgcattatatgaccagtaggctcaaatagttggcgagttgtcatggggcttttgctttttctagcaatacatgaaatggcaatacatgaaaattcacttcagtcttgattaaagacaaaatatgccctggatctccaaaatctactataggcaaacctgtctacctagatcataatagtcatgaagtatatgcactaatacacatatgtgtactcatagactgtatcctcttcctcatacttgctcagaaacactatacttttactttacaaactattctagtttgtatgtttggtatctgaaattacaggaaaactggaagcaggaaaatgagatagaagaatggtacacacagtaaaacttcacattgtcaaattgacatctaacagcccagagcaataattcttcaaatttgtgtctgttttactagcataagacatatttgtgcacattattgcattagatctttataacacaatagaggtttgctagtcaaataaatattctcattttacatgtgaagaatgactcaggatgtttctgacactttcaaagtcacaacattaataaaatggcaaaaagggatgtcagatgcatatagtagatcacaaaatttgcatccttatcatattgttagattttaagaaaggaggatttttcctgataactcagaaagccctgtttctgaaaccatttggtaaagggaaaaattctgcacatttactactacgactggaatatgtaaccatatcttttagttaatacacatttattacacagcatccatatgtggtagccattgtgttaaactctggggatttggggatgaataagtaaaacatagcgtggccctcataaaacttatagtgtaatgcaataggcagataacagtagatacaaaaataattataatacattttgaattacatgaatgaaagaaaataaccagcagaagctacagggatggcctcttgagaaagtgctatttaatatgaaacctaaaataaaaggaatagtctgccaggaaaacaaataacacttccaggcacaaggaatgatgtgtataaaagccctaagggtggaaaattctttgcaagttctaggaagagttaaaaatgtaggaaaaggcagagtgaccaggggaagatactgagttcaaacacacacagatagatgagagatgatagatagatagatagatagatagatagatatttgagagatatatagacttgacatatttcaagcacagaatgttattattcaattcacattttacaaagattactctaacaactctaggaaaagaattacagggggttagcattagatatgaggagaccactgatggggctgtaatagaagtgcaagattgaactagaaacagtggtggaggtggagataagtgatatattagaacaaactttgcgcataaaactgaaagggcatggtgatggattagagatgggagtgcagaggtgagtaaggcaagtgacttgacccccttggctttctggcttgatccagtgactaaatagtgtctgaggtcattactgagatgaagaagactgggcaaaagtagaaaacagaatcaggagggaaatcagcagttcatgttgacacttggcaagtctgagattcctatgagaatcagatgaaattcaagtaaaaaaaactagctatggaagtctagattctgacggggaatttcaagctggagttatgaatttgaagtcaccaacattatgattttatttaaagtcaaataaacaactgctatcttccaggatcacagagagagtgatattagtaaaaatgcccaggactgagccagaggaacaccagtacctagtggtctttctactatatcacagtacttccttagaaaaatgttcaaaataagtgtaaaaagttaccagaaccagaatcgcccatatttaataataatgaaaatttcaggcccttaaagaaatattttcactatgttttcttaatcccgtgttgaatgtcataaccatcagtattgtatgcctcgggaaggtggagatataggacagaaggaagaaaccatgccagagagacagaaatcaacatgccatttcaatctttcccctttgttctttgaacttctctaccgttttctccctgtggagccttggcatcttaagatcttgattatcagaacttaagcatgaaagaatttcttgtcttgatgccttatctcttctgcatccagaggaacttcatgatgtttagataccacttaacaaatacgaaaacagaaaaactaccctaagatagtagacacagaggccatccgtattgactgtttaatagttcagggattgcacaataaaggcaactatcattgctaaattcagaatggaagaatggtaaatatcacttagtcccagaatattctcctaattccaactgaaatatacactacaaaccaagaaaaatgcagaaggtgctcagaaactgcaaagaaaataattggaaaagaaagagtgaaacacaaagagtgaaaccagtctatatgcctgttacattatttgtggttgaattttaaaacatgcatcatatacaaactaggaaaatttcttaatttaattggatttaacatttaagtatcaaaagcagaatactaatttagctgagctaagaataatgtagggaaaacctgaaggatagtataatgcactgaatcatatagcacaatataatccatcaaaaccacagagcctacaattttctcgctttatattcggttgaaaaatgacttcagagtatgtgcttataagaataactgatgagaaatctaagtggagggaagaccacttgatgccagcttcttatgataatgtataaatctaacagccataattaataatagttaaaggcttaaatggccctgggatattcagttaacagaagacaggtacacctgccaatatgaagctttgaaacttgcttagagaaagttagggcaattaacctgactatattccactcagttttgagtaaaaatgaatgttatgaaaataatgtaggtcagatattgacttgcaatattatttagagttctgatacaatatatcttaaacactgttcagtcattttgaaatctgtgaataaatctcaacatgtaatttatacagacaaaataaataagaaaaatgcttactgagtttatattcccattttggcgttaatatcatttttaaaggctgttagctttatttggaagtcagagaatttctgaattaataaagttcacattaaaataaaacatcattgttttggacatagtctacaatatgaatggactatgtataatggactatgtataatggactatgaatggaccatacatactgtatggactacagtatgaatggactataaataaatctccatagtgaaaattctcaaatctcctacacatttactgaaaaattaaaatatcattgtcattgcaaataaaatattattggcattattaataaaactgttttgggtactctatacaacttcttttagaggtattttctcagatttttgtttcatcagagttctacttctgttatttacattttggtacttttcattgtaatgtatgtgatagctatgtgtggtaacatcagtttacattataatcacctgtgttttttatatgtgtttttccactgaattaacctattaataaagtgaatattaaacacccagatttctaaaatatatatatattatgaaataaatattatcatatcgattctcactctttttatcagtaaaaggtaatatttaggcccaatttgctattgactttttacctggccattgggtgaaaatggcccaaggtttttgtaatcaatgactccacaaataaatcgtgtataatcttatagataacttgttttcactttatttcaaacatggtagcagaattgacctcttttattgtgtaatttttatttttatttcaatagtttttggggtatagctggtatttggttacatggataagttcttcctagtgatgatttctgagattttggtgcaccgtcacctgagcagtgtaccctggaccctatatgtagtcttttatccctcacctctctcctacccttcccccacccactgagtcctcaaagtacattatatcattcttaggcctttgcatactcatagtttagctttcacttacaagtgagattatacaaaatttggtttttccattcctgagttagttacttcacttagaataatggcctccagctccatccaagtttctgcaaaaagatattatttcattctttttttggttgagtagtattcttggtgtaaatataccacatttgttcattaatttgttggttggtagacacttaggttggttccatatctgaaattgtgaactgtgctgctataaacatgtgtgtccacgtatctttttcatataatgacttcttttcctttgggtagataccgagtagtgcaattgctggatcgaatggtagttatacttttagttctttaaggaggctctatactgttttccataatggttaactagtttacattcccaccagcaacactgctggtggcagtgttccatttttaccatattcatgccaacatctattttttttattcttaattatggccattcttgcaggagtaatgtggtgccttattatggttttaatttgcatttccctgataattagggatattgagcattttttcatatgtttgttggccatttgtatatcttcttttgagaactctctattcatgtctttgtccactttttgatgggattacttgtttttgtcttgctgatttgttgagttccttgtagattctggatagtggccctttgtcagatgtgtagtttgtgaatattttcttccactctctcagctgcctgtttattctgatgattgtttcttttgctgtgcggaggctttttcatttaattaggttccatttatttatttttgtttttgttgcatttgcttttgtggtctgaagtcatgaattatttgcctaagccaatgtctagaagagtttttccgatgttaacttctagaagttttatggtttcaggttttagatttaagtctttgatccttcttgagttgatttttgtataaggtgagagatgaggatccagtttcattcttccacatgtgtttgtcagttttcccagcaccatttattgaacagggtgtcctttccccaatttgtgtttttgtttgctttgtcgaagatcagttggctataagtatttggcttatttctgggttctctattctgttccctgggtctacatgcctatttttataccagtatcatgctatttgataattattgccttgtagtataatttgaagtcgggtaatgtgatgcctctagatttgttctttttgcttagtattgttttggctatgtgggctacttttggctccatatgaattttaggattgtttattctagttctgtgaagaatgatgatggtgttttaatgagaattacattgaatctgtagattgctttaggcagtatggtcattttcacaatattgtatcttcccatccatgaacatggaatgtgtttctatttgtttgtatcatctatgatttctttgagtagcgttttgtaattttccttgtacagatctttcacctccttggttaagtatattccaaagtatttgaattgttttgcagctgttgtaaaagggattaagttcttgatttgggtcgcagcttggtcatttttggtgtacagcagtgctactgatttgtgtacactgattttgtatcctgagactttacagaattcgctgatcagatctaggaactttttggatgagtttttagggtttgctaggtaaacgatcatatcattagcaaacagcaacagtttgtcttcctctcttccaatttggatgccctttatttctctcttctcttgtctgattgcctagccaggacctccagtactatgttaaatagaagtggtgtcttgttccagttcttgggggaaatgtttttaacttttccccattcagtgtgatgttggctatgggtttgtcatagatggcttttattactcgaaggtaagtctgttctatgccaatgtcgttgagggttttgatcataaagggatgctagattcaatcaactacttttttacatctattgaaatgatcatatgatttttgtttttaattctgttcatgtgatgtatcacatttattgatttgcatatgttaaaccacccctgcatccctgatatgagacccacttgatcataatggattatctttttgatatgctgttggatttggttagctagtattttgttgaggacttttgcatctatgttcatcagggatattggtctgtagtttccttttttcataacgttacaaagagggggaggtgagaggattgcttgagcccaggaggcagaggttgcagtgtgctgagattgcaccacttcactcctgcctgggagatagagcaagatccccatctcaaacaaacaaacaagatctcataaaatataagtttataaaaattgtaatctgataaaaattcaaagtttataaattcgaggtttttgagaaaacaattaattttaatgtttgtgaaacaaatatagaacatggatacacagacaatattacttaacaccaaaggcctgtctcctttttccccagcccattagcttttgattcaagaaaataaatcaagtttaacatatttgataaataataattaccacacatgggaagacattgtctgagacacagagtaattgtaaagagagttgcttcttccggccaattaacaggtgatccactggatcagctcagcttttgtgtttgcccagatactaggaaaaacttctggaaaagtggtgtcaatatcaaagggacacagactggtattgttttgtggatcaattagcaaaaataactgtaaatgtctctttttctaaagacggagccaaatttgtctacagggccacaattaagtagcataaattcttacttcagagttggtgcttcaccatcaaggtatcaataaaatccaaaatagagattcctgactaaacactttcgattagtttcttaaaatctagctgctaagtgaaaatatttaaataataaacattttaatttacttgtaataggggaaattaagatatatcccatttcagctagctagttttcctgcccttgaatacatgagagatacctgcaaactctaagctttcatatgaatgaattcaggcctcattaatgcacagtacatgacaagatagacctacatgtggtttgcatttgtatttatgaagatagccattggaaagaataagtagccatataaggaggatgttaaaagttcctacaaagaacaaacatttcatatatttaaatgcatcaattttcatacatttaactggtgtgctactgaggtcatatgctagttaggtcacttcagcatgtcctctacaatgcctgatatgggatagactacattttattggcataacaccaaccaaaattctggaatagattatatgatattctctggaaataatcttttggatcaaattaattaatgagtatgctattgcctgagctgcaatgtcaaaaatcacatttctttcttttcttttcttttcttttcctttccttttatttatttatttttattttttagacagggtcttgctctgttgctcaggccaaagtgcagtggcacaatcacaactcactgcagcctcaacttcccaggctcaagtgatcctcccacctcagcctccagagtagctgggactacaggcatacaccaccatgcctggctaatatttgtaattttgtgtagaaatggggttttgccacattgcccaggctggtcacaaacttctgggcttgagtaatctccctgctgggcctgccaaagtgctgggattacaggtttaagctaccatgctcagccaaaaatcacatttcttataacacgtttatttactttggatgtgggagacgttacaccaacaaagtcagtcatttagaaagaaagagtttaacttgaaaatttttttacaacctaaatacattaaattgatggctgccttatgatatgtctgtatttaaattgatgacaaaagtatttacagaaagaaaagagggataaggaaagatatttgagcaacatgggagggttgctgatggactttgaaggacataaatgactaatatttaatctcagtctgtctgtgttcctagaatatgaaaaccttcagtaaggtaaggtatattaatactaggaaaggccttggatgagtatttaatgaaaattatagagaagggataaattctgactatggtcaccatcggggcagaggtaaattatcctcaagaaagaaagattgaagccccaaaatccatagaggtagggagtaggagtcagaagtgatcacgaagccacatgcactggcaggagtttgaagcagttttaagaaggaagttgcacttcccataaaatatgaaagttgggtttgagctaatctgatctacatctttaagggccaagagacagagaattgaatctaagatacacaaataaatggccaaagcatcagtctccaaacaaacgtattcaaatagaaaaacaaaggaaataaatactctattttgaattttctattagtgccaccagagaaagcatcacagatgttttccggctatctcctaagctgttaaagaatatgattctgtgaaacagacctgagagaattgccttctcttttggtacaaaaaaaatctaaagtttcattttctgaaatctctcacgaggtgaagtcagtgtagaataccaaaacaggttttaaattctggaaacctaaattattctcttttatgttgtcagcaaaggtgctttattcacactaaatgaaaaatacagtcttcatttttctatatctgtgagagatttataattgaaaataaagataattatatcatgataaatataattggatgatgtccaatttaaacataaacttccatattactttcaataatgtgttttattttattttctggttctggtatatttctaagttctttaaagcatttaagttgaaggggggaaatggcagataggaggcaggactaactttcagctcccactccagtggatagagcagcatgtggagactcaaatcgtgaattttggctccaagaactaccacaggaacataccagaaagccgagagaatccacagaccctttgaaggaagcagagctgctgcaggccctgggagacagccaaaaaactgtgactgtccaaagtatgaaagggggatcatcggcctgaacacacatcctcacatcctcactggggaacctcaagttccagatcaggggataaggatttgaccttacctggagctgagacaaatttagagagctgagtaaaatatgggaatagaagaagcagtgggaagagccctgtggacactcgcggtccccagggaagccatttctgactttgtctcccaggggtccttggggagggctaccagaggaactggaaaaagaccacaggaagaaggaaatttccagctgaacttcgtaacaatttcaaccaaagtttcctggacggaacctggagaagggggcgaatcaggggtgcagacaagcacagaagctgtggcaggtggggaagctcaaaacctgaaagccctgcttactttcacagccgggaggctggttgttggagcaagttctcagctctgcctacccactgcctggaaacaaactcagtaccgttgtgggggcacagtgggagtgagaccagccttttgggctgcataggagctgatgaggcctgtaactgccagctttcccccacttccctggtgacttgcatgatgcatcagaggcagccataatccctctgggaacatgactgctttggcctgaaaaccacacccccacccccacagcagctgcagaaagccctgcccaaggagagcctgagctcagacatgcctaaccctgccctcacctgatggtctttctgtacctgccctggtagccaaagtcaaaggacataatcttttgggagctctatggccctgcccaccacctgatcctccctatactactgcagctgatgctgtcttgaaagcaccaccttctggctgaaagccaaccaacacaaaactagcacaataaacacaactacaaccaaggaccctcagagtccacttcattcccctgccacctctactagagcaggtgctggtatccatggctgggagacctgaagacagttcacatcacaggactctgtgcagacactaccctgtatgagcccagagactggtagttccactggatggctagatccagaagataaataacaatcactgcagtttggctctcagaaagccccatccctaggaaagggagaaagcaccacatcaagggagcaccctcttggacaaaagaatctgaacagtagccttcagatccagatcttccctctgacataatctacccaaatgagaatgaaccagaaaaacaattctggtaatatgacaaaacaaggttctttaatgcccccctccccaaaagatcacaccagctcaccagtaatggatcgaaaccaagaagaaatctctgaattaccagaaaaagatttcagaaaatcgattattaagctaatccaaaaggcactagaggaaggtgaagtccaaattaatgaaatcaaaaaataaaaaataaatcagctgggcacagtggctcatgcctgcaatcccagcactttgggaggctgaggcaggtggatcacttgagaccaggagtttgagaccagcatggccaacatggtgaaaccccgtctctactaaaaatacaaaaattagctgagcatgttggcaggcatctataatcccagctactcaagaggctgggagaattgcttgaacctgggaggtggaggttgcagtgagccaagatcacgccactgcactccagcctgggcaacagagcgagactctgccaaaaaaaaagaaagaagaagaagctatatcaaaaaaatgatacaacatatgaagggaaaaatcttcagtgaaatagcataaataaaaaacaatcacaactcctggaaatgagggacacacttagagaaatgcaaaacatttaagttgataatgtattttacttttgatgccttgttgtttttattactgtaggagttaaaaatcataagatcctgaaaaacataataatttcatatgttcaattttatatttgtgacttcatatattgaataatttttactcaaagaaatataactttaaactacacagtcagtattatacaaaagcattggtcacacatcagcttgagtatataaaaaattttgaagcacatctcacctaaagatatttatgctttagttgaggatataaaacccataaataaaaataaacaaaaataatacatcaaaatatgctaaattaggctatatatgtcatcaatttgagggtatattgaaagatttcttattgatccataatatacctatttatggaatacatgtgatattttgatacatgcatataatgtgtagtaatcaaatcagagtaattgcagtatccattacctcaaatgcttatttttgtgtgtgttgggaacattctacatctcctcttttagctattttgaaatgtacaacaaattattgataactggccgggcgcagtggctgacacctgtagtcccacactttgagaggccgaggtgggcagattacgaggtcaggagatccagaacaccctgaccaacatggtgaaaccccgtctctactaaaaatacaaaaaaaaatagctaggtgtggtggcatacgcctgtagtcccacataatcaggaggctgaggcaggagaatcgcttgaacccaggaggcggagtttgcagtgagccgagattgcaccactacagagtgacactctgtctcaaaaaatatatatatattgatatctattgaacttacaactaatttctcccctctagctgtatttttgtacccattaaccaacttctccttatctctttctcccactctttctcccagctttctggtaaccatcattctcccctctaccttcatgagattaacgtttttagctgccacatatgagtgagaacatgtaatatttgtctttctgtgtgtagtttatttcacttaagataatgtcctccaggctcatccatgttgctgcaaatgacaggatgtccttcttttttatgggtgaataatattccattgtgtatacatgccacattatctgttcatctgttgatggacacttaagctgattccatatcttagctatagtgaataatgctgcagtaaacatgggagtacagtcgtctcttcaatatacatatttcccttattttggacatatacccagcagtgagattgcaggatcacatggtagttctatttttagttttttgtggaacctccatactgtcttccataatggctgtactaagttacattcctaccaaaggtgtatgagagttcctatttctctgcattctcatcagcatttgttattttttgcttttttataatatccatcctattataatatcacccaactgggatgagataatatctcattgtagttttgatttgcattttttgatggttagtgatgttgaacattttttcatatacaatattgagagattgatgtaaaaaattaatcttagaaaatgtataaagatctaagtcagaaaaaccattgccagaggtttgatctcaacctcattaaagttgatcctaatataatagaaaatcagactattaaagaggtagtttctttagaattgccagaacatttaatccttcactgagagcattctgcttcttggacctattgtgtagtgtgatgcacctccaggctaaaatattaccttcaaatcagaattttataaggggtaccattcttctattcctgcttgccctgggtgccagaatgctgattctcaacatcaggtagggtccacccagttcaggtgctttttcttcaacaattcttaaccagattagtttatgtggaacttaccaaagcagcaaaagattcatgactgtttatccccttcctttcctgttcctctcctcatcatattacatcttccaccaataaaattgataatttacttgattatgtgctcagtaaagatataccacaatttctaattccaaagtttcagtttttgctcattaagcagtggatcctgtttctatgctagcagtgctgatctatcttctcaaatatcaggccccaaaaggtggccttattttcattgatttctcatgcttatttcttattattatttctcatgcttagcttttctttattttgatggttaatattacgtgtcagcttgattgcatggaaggatgcctagatagctggtaaagtattgtttctgggtgtgtctgtgagggtgtttccaaaggagattaacatttgagtcaggggattgggagaagaagatccaccctcaagtgtgtgggtaccatccaatcagttgccagcgagactagaacaaagcagagaagaaggtatgacaagctggcttgccaagtcttctggcttccatctttctcctgtcctggatgcttcctgcccttggacatcagactctaggttcttcaacctttagactcttggacttacactagtggtttgccagaggctctcaggccttcggccacacacggaagtctgcactgtcagcttccctacttttgaggtttttggactcagactgagccactactggcttcctacctcctcagtttgcagactgcttattgtgggactttgccttctgatcatgtgcaccaattctccttaataactctctttcatatatacatatactctattcattctgtccttctggagaaccctgaaaaatacagatttcggtaccaaaatctgtattatgttgtcttttatgataacataaaagagaataatttaggtttccagaattaaaaacctgtgttgctattctacactgacttcacctctagagaaatctcaaatttctctagagagaaatggaattttaaggatggatttctttagttggttttggagtttctggagttctctgtttaaactgattagacgccaaaatggtaaggactctacttctagtagtatggagaatactgatagtccttggcatgaactgtgtagacatgctcaaagtaaaggctttgagtgctgaatctttttcaaactatttcagttgaagactttattttgtgtaatgagcccagaaaacatatcagtcatagtataatagtataatagttaaaagcattggctctagagctagaatgaattaatccaaatttcaactctcccactgtgtaactggattaacccatttatgcctgaggttgcaattttttttttagtttttgcaatcagaccttggtgatgacattgagcagtaggatataaataactcccacatgcttagggttccaataatggaacactagggataaatgggctaatagctatataacatagacagggcacttaatcttcctgtgcctcagttacttcttctataaaatggggattataatagtacctacctcataggtttgtggtggggaagaaataaataattacatcattgcatggcacatagtaaactttcagtagttaatgcaactgtttttgtttttatggttacgggatgaagttttctatttcttgaacccaattgctctgttttttgttattattattagtcttttatcattattttttctggctgctgcaatacctacctgggtctttatttctcccaatgctatcataaatgttttagatcccattagctaaaaggatcctttcctacctagagtccagactcaaaacagaccacttcatgcctctccatgcctaaataagggtcccttcacccactatggtagtgtagttattatatctcttcatgcctgatgtcctgggaatataactaaaactctagataggaagaaggatcagaaactccccagcctaattgtagagaaacccattgcagcctatctgagaaatgggaattttgcttgtgtctcacacccctagcatcactgtctcctgagccataaaataacagtaaacaaagttctcatttatgtgaaactttaacagcatgcatcaatcgagagatgttcaaataccctgggaaaactattcaaacaaaagcatatccactcacacaaaaagccacaaagaaatatcctctgctcttctttcttgctcttgctcttgctcttcaacatcttgaaagagttttatggaccatgggaagtaatacgtctttgcagctgacctagttgtcttaccacaatagtagaggtttctagcctttggttccaggtattgttaccaatttgactagtgctcccaattcatcagttactggtactgaggctcatagcaatgatgtcttggctttgcccagaaacatgaacacttccaccttatcttgagccaaattaagcctatttaacctgcaaccttccatagtcaataaggttacataattgattaatttgtcaccaaggccccatactcaagtatatttatttatttttggaaatggagataacctcagggaagttcctaaggccatctacagtgtttgtcatatgaccttttaccagccctactcttatacacatttttctcaccaagaaaaatggagaatttaaggtttataacaactcccagatattgaaccaaattaccattgaaatcaatatgccctcctacatttttcttaatctgcttgatcaacttgagtcagctgtgatttgtatcagctgaaactccaggacaggattagagggtaaggaagaagttggggggaagggtcttatctccctatcaatatcagaaatattttttaagtattcatgaaagactgtgttttcagatccttatgataattttgagtacaattgaccctcgaacatgtttgaactatgaggtccacttatacatggattttttcaataagtttactgaaaattttcttggagatttgtgacaatctgaaaaaaacttgcagatgaaccatgtagcctagaaataagaaaaaataaaaggtatgtcatgagtaaattcagtataaaatgtatttagatattagtctctttatgtgttaattgactatgatattgataacagtaagatattagtagtcaagtttctgtggagtcaaaatttatgtgtggattttctatttcctgggggttttgtgctcttaccccatgcatatttccaaagatcaattgtgtttggtaataggtttgaataaatgttaacatatttatgtaactctgaaaaatacacttttaagcattacaaatgattggaaaaaagaagaattatttaataaataatctttctttggtagatgggaaccagtaaatatcaaaggccttagaaacatgtataactcaacacaggaattctattcctagaaatctttttaatgaggtaaccaaaagctccacaatttggaattaagcaaaaaaatacacacacacatgcgcgcgcgcacacacacacacacacatatttgtgtgtgtacttatatatggatcttatgatagttatataacaaaaataatatgtaactgtttaaaatcatatttatctagaatatctgacaacaaaagaaagatgccataatatatttaagtgataaaccaaagcaatgaacgttatgcaccatgtcatatgagtcttaaagatgataatgactgcatggatgataatattgctactcacttgttttattttttactcttgagcacgtaacattttccccacagttacaatgcaataaatttaattcagaaataattatttttagtaaagaggcaaaaaaaaattccctacatttgaatgtattagtctagttcatgttggctgcatattagaatcaccaggggagcatgaaaaacaaaatatctgagacctactctaacttgctgaatcaaaatgtgtttcatttttagtgtttgttgttgttcatatttttaacatggttctcaaatgattttgaagtggtcaggcccacaaaagtccacactgtcatatgggtacaactggccttgaggataatattgctaactcctcaggatcttttcagaatgaagtgaaataatgtgagtgagtgatcctacagtcatgggggaataatccatctatgggcctatttcccaggacactgatatctgagaggtcttacatcttttggaaaagacctcttgtaagtagtttggtagaagtgctatgtctcttcagcacttcttcactgccttcttgtggtagcaaatcccagctccctgactagagaggggacctgcaaccaagactgagaaagccacaggctcctatctccctagtggtccaaggagtggtccaggcttggatcaattgatcattactaagaatttttcttatcatggccagcaaattgtcaagtaagcttgctccatcccagttttccctgaccagaaaatggcactattattcccccaatatgatcagagtaaaatcatctttccttataccctacattccacccatcagcaagtcctgctggttttcctttgccacaacccccaaaacttcccacttctcctggcctccaatttaccactctagtttcgggctactgtgacacttggtgcctatttggtcttccacttcattcttatcttgctaaagccgttgtccagagagcaaaatatacttgtaaaatataaaccaaattatgtatgtaatttcttagcttaaaattctccagtgaattcacattacatttattatagaacaatatttactctctgtggcctgacaagacatacttggtttacccctctctaaattcctccatttctccctcactctcttgtttctgactgtcttgctgttcctcagacatggcaagctttccctgattttgtcttttatctaccagaactgctcatcacccagacctacaagtgatcccttcacttatttctttcaagttttactcaagtatcaccgcctcagaggtaacttccttgacctccctatgatattaattcctccttctcacctccccgaccacccactccctgcatccatcaatctctttgctttcttcctttttggttcacagaacttggcactacctgatacacgggttacatgtccattgtttgactcttgtgaagtgaaggcttcacaagggcttccaccgtgattgtgccctgtatctgtacctagttgaggaccactatttatatgctaagttagacccccattgattggataaagtcaggctccagaagggcagactaaagccaccaagcaaggaacaagaactggaagagcttttgtttccagaatcaccccagctagctctactctttctatttttcatcccttcgatagatgaaccaaaaaagtctttcttttctcttcagttagtttgaatacaatttctgtcacttgagattgaaagatccctaactaatagccagttgaagattcagtttcaggacctgaggaattttagagggagaactgtgaaatgccacatctctgtgcacagcacactagaacatgtaagtccacacagcacagactcctcacctgcccgttaacctctgaaggcacggtgggccaccattattgtcaatataatcaaagaactttttcctcccctattgagtactttgttctttgtgtgttgtgtattcccgtcatctgctgcctgaacaactcagactcagctgcttcttatccttcttgtcctttcccttacccttccagatttgcaaatcattccagagttgtgaagggaattctaatcttttaaaattgattttcccagtttctcacacacacaggggaagcaaataatgcatgcaccatattatgtattaatacctttattcctaatccaatcttaaagcagactgattatccacttatccccacccctgaatttttttattcaaatgttcatacaaagctgtcacttattcctgaatgcctgaattttaagcaaagctgatgacttcacagaactccatacacattgagcacactgaaaccacctgtgcaacaacgcaaggcagtgtgaacaggcagggagctgtgtcaaggccagggtcagagaccagctgctagaattcttccctgaacccaagggagcaagcataggttttgtggcaatcttctcaactatagcattattgttgacattttgagtttaatataatgtacaggagctgttctgtgcattgtgtgatgtttagcagcattcctggcctctaccagctacccagtgtggcaaccaaatattcctccagattttggaaactgtcccctggaatgtatgtgctcagagaaggattgagcccaattaagaatcacatgtattcaaaaaaagaacttgtgtgataactcaaaaaatcaattctatctactgggtatactactatctcctcaaaatagtcagtaagaggtcctgggtaggtgaaggtgctacctctgctttacagttggaccataaaggtcatggcctttatgaaccaataagtatccattagaagtaaaattgtagatgagtgtgatctgtttataaatttgaaattttaagggatcttattttcttcatggccccttcatttaaggtgaaactctatttatagtgccttttgtgatagaactcgggctctcttctcaaacctacattcccactattccatcgcatgtgtcctatacccagccatatcaatatttttttattctatggaaacaatttgctttcttatatctccatgtcattcatacatactgttccctctgcctaaaatatccttcccaaccttcctttttactttttttttttttgagacagagtcacccacgctggaatgcagtggcacaatctggctcactgcaacctccacctcccaggttcaagtgatccttttgcctcagcctcccaagtagctgggattacaggcatgtaccaccatgcccggctaatttttgtatttttaacagagacaggatttcaccatgttggccaggctggtctcaaactcctgacttcaggtgatctgcctcccttggcctcccaatatgcccagtcttccatattttctttgatatgttacttcttatgatactgaaaacttcccttaattcctgttccttcctggcattctctattccaggcctgtaggtttgtctcctctctgattcacctattccaatgcctattcttataaatatcagttgagtttcttacccatctccaaatgatgtacttgagagccacatcattttatttaggcagatctaaattttgtgggtacagaagtttatgcaatctgggatgccctctttataaaaaaagaatataatattattaatataaaattaggtatatttatttagaactgggaaagaaatcacaacaaatgcctggaaatttaaagactcaaactcccttgtcaatttaccagaaatgcttacatagaaatatttcctaataggaacctggctttttctaccatctagaatgctctgcagctgtcagtatctcacagcaacctgtgcagttgagggtcaccagagcctaaggttcattacatttatggcaaatctgcctttaaaaaacgtatctctgcatctccaaggcccagtacaatggttatatggtagaaggtacttcataaatgttagtgatgacaatattaaattttatttaaaggttaagaaattccatcactcttttgttccagaaaaagacattgccagaaaccacctttctcaatatgacttagacaagactcatagatgacccccttgttcacataaggcaaggccagacacagaccctccaaattcccattctttgcctcagaaatgactaatggaactgcttgtcccaactgatcagctggaacaaaatgactgttaaccaaccttcctcaagatccctgacctctggctcacctccaggtgagccagcattcagctcctcccaagaatagaatagactggcctcacggaagatattctccaacctaccagcctatcaggccacctttgattccatttccccacactgcttctttcttgctttgtttactcctcccttcagaagcttgtagaccttatggtcacctccttctccccagtgcaacattatctttccccagccttctaggaagtctcttgccacagactttcaaataaagtctctccttactaagtctgaacttgctttttatgtgacagtgaaattactgaagaaaataagtgatgaatgactgagtgtgaactcttgtcaagcaacaagtgttctttgtaactctttcccgtactgttgcaatgataatgctattgctttcctactgagcctatgtggtctctcttttgacctctgttccttctgccagttgcaatacactcctctgtcaaccattactataagcttaatctgtcaatattgtcaaacagttctgacctctaccttgattttggcttaaatcccacctttgttataattcagtctagatcctaatccattcagactttttcctgccttagttccaagaaaacatgactctgtttctaaatcaaaatagagtatgtgagttagctttgaaaaggcctgatagatacccattgcaaaaagttagtgaaaggccattctggttgcaaacaattgcatgtaaagtcttggaggcaggaatttgaaattcatgcctcaggacaataaaattagccaagttttattttaaattggtagaataatgacagaaggttggagaaagcattttatgaatggatattgattgggattgaaaattatgagcattggttttttatgtgtgaaatttcagatattggcaaaatacataaatagtatcttataatgaatgaaaaagtactgaaactagaatttgggagacatttggattattcaaaatctttgaaaaatgctgtgatgatgatgatgatgatgatgatgacgatgatgagatggagtcttgctctgtcgccaggctggaatgcagtggcacgatctcagctcactgcaacctccgcctgccaggatccagcgattcccctgcctcagcctaccaagtagctgggattacaggcacatgccaccacgcccagctaattttttgtattttagtagagatggggttccaccgtgttggccaaaatagtctccatctcctgacctcttgatctgcccgcctcggcctcccaaagtgctgggattacaggcgtgagccactgcgcccggccagtgctgtgattcttaaaatgaaatcttggagcacagtacatttttgcagtacaaatatattttccaaattttgggtaaagactaatattttctcacctttataaaatacattaattgaattctctgttgatttcacaacttcatgttaattatagaatgcagattggcatatttaaaattttcaatgttctgaacatctaactacataaaggacagttttaaacttattctttcattggaggcaggtattatgttgaaggaaactgggcagataatgaaaattctgtattggcaccctgcataggcacaagatattaatatataaaactatgattaagataacattaaattataaagtaatttttacaatctttttttatagattaacaaatacaaacttcatcagacattaaaatccattatttcagataaggaacaatgatttataagagccaagtggtggatttaacacaaactcacattttaataaaagtgttacaaaattttagttattaaaaattcaaaaaggttaacattttagatataaaaagagcaaggcacaaatcgatttaatgggagataaagggtaaagcatgcaatgcttagactttaaaaatccaattattccaattgctctgcatacattaggcagtcatattttagtgctatcccatgccttacttgtcttgctgccttttgtcaaagctcctgtttgcattttaattgacttggggaaaagcaagggagaaaagaaagggaagttgtaaaattaaagaaagggctgtgcatgtttgaaagcacctatgtgaccccctctgactatgttatgccgatgctttaaatatcattctgctccaaaagtaagatccctatcagtctggctagttttaaattgtcacttccaaatttaaatacattattttatgaaagtttatcccaccactcttaagagtacttaataaacacaaaaatcatagtagagatacttggaaacagccactaggctatacacactttccacatgctaaaagaataggccacaattttgtttatgttatgtttcacaactatttaatatctgcaaactttcatgttctcatctgaaaatgaggatggtgagagcagctttataagaaggctagtagaatgaaggaaacggtaatgcctgggcatgcctgatgaagtgcaatgtagcttccctgggagtggctcatggtgttttgttagacattctgaagtgcttttgtagctgcttctggggcagtgggtctcaaacttctgtctccaaccctttttatactcttaaaaatgttactgaggactccaaagacctttgcttatttggattatatcttttgacactgactatattttaggttaatgcatattttttttcaatatgtataataaactcactacatcccagcataaacaaatgttttatggaaatctacattttccaaaacaacaaataaagagagaatgatagcattgttttacatttttcaaaatgctttaatgtgtcgcatgaaagacttcgattcttacatcagcttctgttgtcagtcttttatgatgtgttgttttggttgaagcataggaaaaaaatctggtttcacatagatctggggttggaaaagggacggcctcgaggtccccttaaacagtctgggggacccctagaagtcctgaagccacccttgagaattgctgttctggaaaatagaagcaatggggagaagagtagagggtgtgtttcccagcactggtttgtgccaaatctgggaaaacttgacggaaaaatactagagaccctgagacttatgttttgcctccacgctgcctttaatctgattgcctgtccattgccctgccgtaacccattcccactttgctcctgccaggaagatcagaattctggtctgtactcatttggcagaagaacctgggaagagaggataagagatacttgtacaataacgccttcatattgtgcaggttttactatactacatgaggagagtggggaatgtgatttgatttattattgaatattatagatccttgaaatatacagatatgacatttacagtttcacaagtgacattgaagatgcatggcaggtagtcatgtcactttgttgaggcatgagtttggaacaggtggcaaagctagtgggtaaatgtggcaagtcactgacaagtgggcttagctgactctcagcacctccatcccagtgtaatttaccagtggccactcttgttgggtgaacttctcctaaaataattaaaattattgttgaaaggcttgggttttgaaggggttttgttgttttgtgaaaaatggccttgggaaattaaaaatccaactactattcttggaaatggaaacagaaggtgaagctatagggcttatttaaaaaataactctacatttgttttggtttactatttatgaaataattaaggacccaaatatttaaatttaaactttattgccttttatgaaggtaattaaatgtaattgtggtatccacaaatttgggcatttggaaatatcaggaatctcctgttaaatctgaatttacatttaatattagatgaatcagtgttgttattaattctcagttttgtatggtttagaaatcttttgttaaatctatttttaggagaaactgaaaagtattgattattgattataatgagtagtatttatagaaactttgtaaagtaaaagagaaacaacttatcaaatagaattatttgataacttatcaaatagaatagaaacaacttatcaaatagaattatttacttatgtaaaattttatgtactatcatctatgaaggactgaatttaaaaggcttgaaatatttgcctcacatatataaagtgctaagtgtttgctatttttatactttcttacaaataccaattttttaaaaaaatccaagaagaagaaacaaaacaagataatttattgagtacctgctctgtgccagttacttttttaggcatttggaatagactgcccagaacagaactagatattgtatgtcatacatcacaatattttattccataaaagtctccaaattcttagaaaatgtcccttctagtttctctgtgtctgtgtgtgtctttactgtaacttattcaaatttgctctcactgaaatatattattgcatgtggcaattcccagctgtttatttccatctgaaataccaaaccaaatatttcttaattactgttaactgatgatggaagtatagacagtataaaccttattaataaacttactacacatgaaaaaagataatttagcaaaacctgttggcaggttcatcctctagagatacattacattttgattatttttttattgatactccttcatatctaatagtttataaggacattttacacatatagttgaaaacatatcaacatattaactttaatagaatacaagatatagaatatgatgtttaaaaatagaagactgtaaataggatttttatacctaagttagcttaaatatgtaagtaactatttaaatatcttataagaatgttaacacatttttagaaagtcttgaatccttggtccagatcttcttatatctaatctgcttataacttttacctagaaaatcagccttagatgattttaaatgacttagcttacctacagccatctaaaaacttgttttggacttctgattctggatagatatagtttcagataattgaagattaccaaggtactgtctgcttacgacacggaaaagcttaatgtttggctaattttagttgcatttgagtttgttaatttttaatcagtaagatttgttaggtaaccttaaagttaagtcactgctactccccaacccaaagccttctcagactccccattcacacctctcacgtccaatcataattaaacactctgtgttctcataacactttgtacatatcactaatatggaatttgttatagctgaatatgctaaaactggatggcaaaattcagggaatcgaaggcttctgttaggtttctccctctaatgcttcaggtagtgccaggaaataataaacccccaacaagtatttatagggatcaatggattaatcttgaaggggcttttttacttaaaacgtaataaaattaacatggttaaaataaaagctgtcatatgacatgtgctgaaggtattttatattctatcctttatctactttatcttttggggagcatactcactacattctttttccatatggttaaaagagagtgattcaaactctctgccttaggggtgagcatgtgattcaggacttttgtagtttctttttcacccaattccccagttatgagggccaatgtattcctttattttgcttttgataattctaacggagtgtcacacacattcaatagcttcctggctaaaataacatctgcattttagaatttccccataagaaatatttatcaggttcaggttctttagaagtttaactacagtttgatatgcatatgaaattctattttattgcctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaaaaaagtgacatttttactttccagagcctacacacagacaaaaatggctttaaaactctatgcatcagaggaatgctaaagaaagaaaaatatttcatgttatttttcgtgttttcactttagcatttcaattacatgcttgttagtgtacattcttcttatgtttggggttggttttgatgagtgtagtagcatgatattttttagaatgttttattacaaaatcagccaatactgtttaaggattacattaaaattggtaaactgccaattgaaaaaaaacattaaaaatagataatatctgaataattattttaaataaaaatatgtgtttttgcctagtgacatccattctcacagaaaagtggtattgaatgtttcatggtacatctatctcacagctaagacattaaaatgtgttgagaaattagtttccttgctattctttttttttttttttttttttttgaaacagagtttcgctcgtctcactcaggctggagtgcagtggcacaatctcggctcactgcaacccccgcctcctgggttcaagcgagtctcctgactcagcctcctgagtagctggaattacaggcacccaccactatgcctggctaatttgtgtatttttagtagagatggggtttcaccatgttggccagcctggtcttgaactcctgacctcaggtgatccacccgccttggcctcccaaagtgctgagattacaggcgtgagccaccactccctccttgctattcttgagcacattgtagtaaaatgacctatttggagccagaaatgaaccagccacctacacaaactcttgttaatcttttcagccaaattatagccttaaattttaatctcagaagaaaatttttgtcactcaatctgtgaaatacaggatcaaataaatggcttttgctttaattttttttacacttcatgacatagttgcttaccatgtagaatacttattgctagcaatgtaattatcatgaacagtgtctgaaacatccatttttagtcaagttctgtgactaatcaagctaaaacatacattttcaagagatccacctgaggactgtctatccatggattttctatcccactgcactttaaaattgactgggagcttctataaaatgctctctggatgtgcctcataccaaataaatagtaatctttgaaggtgtggccttgggttatattttttaaaactctacagataattttaaggtgaaccaaggttaaataccatttatttgaaccaaatgaatattcagaaacatgttattcaatttttagtcacttgttgagaactaatttcttgacaaaaaagacattcactttgtggttaatgtcaaaaattttacctttcatttcttaatatgaaatatattgcagaaatccctgataatcacaaacacctgcattttaaaagatttccattattatgaactattttttattattatttggatcttcctggggagactttatctcactgggaggtaatctatgttaagtcttaattcaaaaaatgaaagttcttgagaaagggttgaagcatataggtcattagcaaaaagctgatgttgaaatattcactgaagtatccattataataatgaatactaaattactataagatttattttcctagaatagtaattttcccatgtgagcactctgcaatattttacagtagtaggttcacttcgagagttgtttctgaatacgtatagcatatgaactaaatcaaattggtaaaaataaacatagaagtgagggagtaaccaaaaaaaaaataaagttatatccaaccttttgtttcagaacaataaaatgcaatctactgaaataaaatatttgattaatttaagaggttggtatttagtagcaaaatttaaagcaataaaatagttttggtaatggtatttaaaagtaacctaaatttaagtatttcttctcatcaaaagatacttctattataataaaatatcaattttaaattataattcttaaaatatttattaagtgcaaagtttaatgatatactgtaccagagatataaatataagtaagagatgattcctgcctttaataaataggtattcaagtgtggatgacacagacatatgcagaaaactcgcaatgtagtgactgctatactaataaagtgtggtgatcagaagagggcatgtttcagttatgaggcattgaccaaggctgaccaaaggaagagatgttgaaatgggttttaaagaatcaggagaagttctccatagggagcagaatgggtaaagtgaatcaataaacttagagcattctgcagaaaggtaagctgttcaatagggacagaaatgagaatgtaagtgcaaagaccagctgttagtggggctgtagtctccttggccccagatcataaagggccttgaaagttaagccaaggtttctgctcttcttcccaggggcaatggaaaaccattcaaacaatgtaattttgagtttcttaagactcctgtttccttggccactttccttagcctgacaccagcttgccttcctacagccatacatgaattttctttcatattgatgattttgctaactaattaaaatgtttcacaaacaatgacttgatttcttaaaaatcagaacaaaaacagtgaatgtcccataaatatatgtacacataatttatattatttctcttaaagatgagccattatgattgaggtttataatttcttcagtatgtgcaaatactataattttgatgtataagtacaatcacagatgaaatacaaatttagtttataataagtttgaaaaagctttgcaaccaataaataatgcctacttcatctgaaaaacttgagaattaaatcagaggaaggagttgcagactaagggatttctggggaaaggctgtacaaataattaccctaagaacacagctgtgtttgctttgttgttggataaaaaatggtattaaccttaaggtttcttttataatcctgggaaattttaagttttcaaaatgttttacttgttgaaagtaagcaaattaatactacaaacaaacattcattcattcaacaaatatttatgaaacaccaatataagtgaggcaactttctagaaacagagtatgcagccaagaaacagagtagaactgtccctgacctcatagggcttatcttctagtgagggttgtcaatatgtgggcaggggtagagtcaaataatagggaaattaactggtgcacaatattaacagataatggttgctgttgaaacaagaagagattggattgctaacagagggaggaatttgttcatttttattgaatagttggagaagggttcacgaataaggtaacatttaagccatgcatatagaagagagcagcaagaacaaacctcaagtttaaaaagtgctccccgctgttcaaggggaagcaagaagtccaatgtagctgcaagacaataagtcaatgataggatgaccaacaggagatgtggacaaaatgtagagatgcgtggagcaagggagatggagccaaatattgtagggccttgctggccatttggggaccttttttttcttttactgagtgaggtaggaattcattggacagtcttacattttagaagaattaatctggcttttcctaaatctagattgtggagaatgagggtataaggagtctattgtgataacccaggggaaagctgatggatgcttggatcagagtgaaagcagggaaggcagggacacatggttctattctaagtgtatttgttttgaagacataagaaacatgaatatcaatatgtaaaatattaagttactatctacttaatatgaaaattatctccatatatgtgacaggcttttattattaccaaaaacacaataatcacaaaggcttcttcaactctaaaacagttaagaaaatatttcatatatttttcattgacatcaaacatcaaaaaggagagaggaaaaactatctttgtgattgttgtgtgtccaatctatgtgttggcacataaatacatttactttacttataatatagtatctgatctgaaaaataaactgttggaatatatgtggatgtttgtttccttctaatcatttaaactgactgtgttattgaaatcaaatttataaactgcctgcctatgtagacacccagaagcaattacaaatgcattgaaaacatcattacttacattctggccctatacagtctagaagtggtatcttttcttcctggctaggtagttattctgaatcaaggagtctgactacttccggtagaaagccaacagtgggacttcaaccattacttaaatgtaggctggagacagaatctgaaaaggttttcatttgcaaattactgcataacatactacttcaaatttattagcttaaaacatgaagcacttatgatttctcataagtctcaatggatctcagctctgcttcttcccttgtctgaagtttgctggcaggttggtaggggctagcccgtctaggatagtcttagctggtatgactcagctctgccccttggattcttctcatagtgaaggtgaaagtacatgggacaaagtgaaaaatgcacatactttttcaaacctctgcttgtgttaagtctgataatgtcctattggccaaatcaagtcacctggccaagcgcacattcatggtgtgggggtaaaaggtctctgattatttaataaaaagaacttcaaaatcacaagaactttaaagagcaaacaaaacaaacagcctcaaccacaaacacaaaaatcattacaaccatcatatctgtgacaagtgtcaagtttggaagacaagcaagtttggttaaggccttattccaaattctgaccttttgttgttcaccaaaatgtggttgcagtgcctagaacagaaaagtgattcaaaggctgtttaaaacacttccaaatactccccccaaagcttaccctggtaagcacactaataggatcacacaagatcacattttggacacttaagtgaaaaataagagatacaagacatgaaattcaagaactattcagttcagtctttggaaaaagacaaggcaatttctggttggagctgatcccctggctcttaaattgtacttgatttcttcaagtttcaataatcagatctttgaaaatttcaccccatgcactctgatatcttatactttttctcttttattgacatcagacaacagctaaattggattgccaagtatgaatcaaaataattcaaagatgattaaaatattaaggatgtctcaaaggcatgacaatgtaccagtctagcacactagtccagaaaatgtaaccaagtctagtgtagtgttttccagaaggtcttttaatataagcaattaatttttaaaatgttacaataaaattaatataaacttcatgcctagaatctgttaaactcattcttcctcctgataattattccaattaatttgtggtcaaataatagtgattatggaaattttagagattccacatcttcttattctgactataaaccacagtctgggtaatttgctgcatcaataatgtcaaaattaataagctaaagtcaaaacagtattagaaacagttttaatatttactacaaatatacctaaaatctgctttagacaagagagaattaagtaaataaaagccaacaacattaagaatttattttgttattaccaaaaactacatataacatttcctattatccttgattcaacgcttttgccagttaggactccaatatgtacttacccatatcccaaagacccgtattctgtatcctgatgcctctttctcttccttccttgattaatcattgctgtaactgctgtagctgttctatagcagttctctcttttctgccatagatggaagccattttgaaaattctaacttccagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaagaataatggctagtttagagatggaagtctgaaaaattcctgaatctaagcagttaaccttctttctatgttccttttgatgagattctgtactgtgactatttgtaaatataaaagcagctccctgagacagatggttatttacagtgttttctctattatgcaggataaattattaacaagaaaataattgaatattgaatatgccctggcaaagaaataatctttcaccaagtctgtcacacagtatgctgcaagcatgcattccaattagtagagtgggccaagtagattaatgtatcaaattgtttaaattcatgattcaatcctactttccttaagaacttagtacaattgcaaatcaattattattcaagtttgttaactttctgcaaatttcaactatattttatgactcatggatttaaatcataattcaatatgcatataattgaaaaagttttctcaaaagcttgttttcatttattttcattttgatagcattatatcacagctgatcaagtaatttatcatgttaacatattaaaatgcattcataggaaatattttacctcatttttataagtaattttttaagctaccaaggattggaatagaaaagaacatagttaggagagggaatagccaaattattttcatatctttggatcatactatcaataggagaaaaagcaaaactgtttaaccattataaaataacagtagactatatcaatggttctcaaagtgtgcagtacctggaaatttgtgagaattgcaaactctatcaccccagaacttctgaatcagaaagtctgcaattagggcccagccatcagtattttgacctcaaactgattctgatgaaaaggtaaagttgcacaactactctcctattgagcttttatctcttcaagcactgttgcagtcatattatcatttaatctacatttaaaagacaaagtattatcacaatatttaacaaatgagaaaaatgaaattcaggaagattatgattagcttcttcaaagctcctcagctacattgatggcagaaccaatatctgatttgactttcactaacatttgtctccattaacaaactcataattttcagcctaaatggatagaaacattaaaggaaaaggaaagtctaagtcagctgcaaagaattatgttacatagtttctgctatggagccaactttcattctttcaacaagtattataccagggactatggtaggtacaggagatacaaccagaagcaaaacagagttctttctcttatggatcttgccatctaccacgagaagcaggaaaaaaaaaaaggataatttcactatagaagaaagtatataaaggatgtaaaggtcactacgatgggcacataggaaaaacgcttcttctggctctaagattaaaggaagaggaggcaggtggttcctggaacatgaggtgtaactaatctttcagtagagtaggggagaaaatatcttaatccataaaaatagctaaagatgtgagagagaagaatgggcatgcatctttattatcctgccatttgttatctaaagaacagtgcaaacatttttaattttcattattatgaagggctattgtctgtatattatatttatatgtatgtgtatatatatttatatgtgtatgtgtgtatatatatgtgtgtgtgtatatatgtatttgaaatccaaaatgttttcaattgagttttcttattagaatgcaataatttaaatattttagagcataaaaattaagctaatattcattcagtttattaaaaaactataatttggaagattaaaaacaaaaacaatagttcacagcttattttatatttgtgggaatcagatacaaaaaaaaggtgacttgatgcccctagaaaatatttacagtcaatacaaacatgggagacagctttgaatatggtgtagaatacatgttaataaaaatgtataatatacacaaacttctggtctgctgcagtttgtatagcattatgaaattaatgaaaatatattattttcataacaagtgtcagcaaaatgcagcacagtaatgttaaactattctatttttgcagattcaacctcatattcagttttctcttacactccagcattacatatgatgaatgtgaaaaaataaacaggcaaacacctaatatattatagcagatggagaaaaaatagctaaatcggaatgatttccctaaattttcagtatgtgaagcaatgaaaataaaaatttaatattcagcctcctcattttaattatttcacaacagtgaacccatagtgatcagggtattttgtgtattaaattatattgtttggcattattgttacgtgattctagataatatttctatcagctaactaatttctacattaaccaaaatgtatagctaataggccaataaacatgacgagggaaaagaggactttctaaccctttgtgagtccacaaaaatgctcatttctagaaaaaccaaagaatacattgacctcactatcaatcaggtaatgtcaatgttagctgcagctctggctgtgcacaaattctttttgcaacaaggtgagacataaataaatatcccgtcagtgatattaaatatttattacattaaacttttaagtattgaaaacaacttttaatctcaggaagaaatattatgatagtttaaaattagttcataaataattggatatttatagatacagtaggttgctttcagagtttgctctcagcagggaattaaaatgcacctctatgcacatgctggtgcagaagagatgaaatgcaaaaccaagatctctccagaggacaccaacattcttggacaatttccaaaaggaggcacaaagtacaggctagttctaatttggtgtctgatagccaagagagaaggccattgttgtggaggtgatgaatggggaggcaatgaggaggggtcattacagaaatagcaagcagttgtggcagttttttgagttaaattttacaaagaatattttgaaaacaagatgggccaaacagaaccaaaccatctgtctatcttgggtctcaaagctgttggggaagagacagttattgagaaaccatatccatcccaaagatcttaaattggaagcatagtcaaggggttataatgccttctttggttgacaagttctaacccgcttcagtctattacaatctcagatgttgtctgtaataatgcttggtgtcctatgtcgttggatccagacatcgttggaataaccaaccatgtcccagaacagtgcttaatggaaacaactaagtgagtctaggattaggtcagggtttgatattatctatgctatttattgactaaaatatttcaaatgcaatctagcctggaatagaaaggtagacaagtcaatctagaatagaggtaaaaattattcaaattaattttgcaagtggatgttttaaatgcatgtctattatgacatgttttctagactctttaaagaactatgtcagatatgaagtagtatttattcgacttcagagtgaactgagacaacccatgatttagaaatgaggcaaaaattgtctcagaatagactacagttaaataaataatacttataagtttataagtattgtataacgatactcatgcatataagaaatcatggtatttctccatttacaattttgaaatttctattttcctattaaaataaagaaaaatacatcatctatgctagagggcttcatgtagccaagtggcattactccagcattgagcccccaaaagaagaaaagaggtgataggataaggaaagagcacaaagaaacttgcagtaaactgcacatacttttgtccttcaagaggcattatattttccttaaattcattgccagttttccttggggaccattgtctgttttctttaagagaatgtgaggatatatttatgtattttaactgctaaattaatagttaaaaattcaatgtgacttttatttctttcaaagaatgagattaaaattttaaatggtttcttttattaaaaagagactatatgcagttttatccaaatactttttctatgtgtttaattattgtataaccactaaacatattatataatttgtttttatgcaatagtagtggatatgtttttaaaagtttaactaatatatttttaagatgaatagaacaaacatttaatatcacttaaaagtgatattagaatgtactaccctgcactaacagctatttttgttacataaatctttaaatacactttcttattcttgcagtcatagttaaggaagaagttgtagaaaaaaagtaaacatatggtagatgctatttattcttttttctggtaatatgaaaagtcaaatttagaatttcaagctagaaatatctcagagagtatagtatcttttaccttaaatatattctaaattggtatgaaatatttcagtatctcatccaaacttgtcataaagttcactttattattttcattttcttatttaatattctcttctgataactgcaacattcgtggtgaatgtgattcagagttttcagtggctgtgaaaagtccagttagtcatagaattggtagctatggaagaactttggagaatatttcagattcttatagtgtgttgagaaatataaatcattgcattcaaatattaactaaattactgctcacctctgactgtgaaggagtcggggggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaattgacttgcaggtatcaatacagttactctaaacacttccacacatattattgattagagtttaatatttccatgaggcagtgcaactcaaatctctaccagatatggaatgttattgtcccagaaaattgttctctcgtgccccttttcactcaatctccatctacctctctcagctgcaatcattaccagggtggttttcaaccatatattagtttttgactacagtaaagctgcaaataaatggaatcttttgtgtaagatttcttcatatgtgttaatgtgtatatcagtttatcccttatttctgagtagtattctattatatgaatatattggtttgtttacgaattacgctattaatgtgggcatgaggtgtttttggttttcagatattatcaataaagcttctgtgaacattcttctacatagtctctcatgaaagtgttttcatttctcgtgagtaaacactgagaaatgtaaagcctgtcatagggcaggtataggtttaaaatgatctcataacttttctcataataaggatataatgttatattcccactagtaatttgtagaagtttcagttccacatcctcaccatcatttggtgtgtcaacatttttaagtttagctattctggagtgtgaatattagtatctaatagtagttttattttgcctttccctgatgtctaatgatgttgagcaccttttcatgcacgtattggccattcatacaccttttttaatgatgaacctactcaatattttgcccatttttaattggcttgtttgtctttttattgctgagcagtagaacttagttatttattgtagacatcagtcctttgccagatatatgttttgcaaattgttttttctagtttgtggcttgctcatttatttcttttcttttacggttagtgcctcttaggacctgtcctagaaacctctgtctacttcttatttgaaaaggtattctcctttgctgttttctaaaagctttatagttttaatatattgatctatgatccatctgaaattaacttttctgtatgttataaatctgggcgagagtttttgttgttgctgattgttacctgatgatttcagcaccatgtgtttaaaacaaacaaacaaacaacaacaacaacaagaacaacaacaaacccttaactgtccacactgggttcctttggtgcctttattaaatgtgaaatggttgtatatatgagtctactttctattgcctcttcagtttgttacattgatctattgtcaatttttatgccagtaccacactttccttaatgtagcattataataagtcttaaagtcaaacggttagaagtcctccaaagctgtttttcttttcaagattcttttacctattcaaagtttttattttttgcatttccatataaattttaacatcttgtcaatttgtttaaaaaattatgggaactcttttggtgtggaatgtatagattaatttgggcataattatattttgtatcttgcaatccgtggaaatgatgaatctcatgacttatttagtgttctttaatttctctaagcaatttttgtagttttcagtgtaaagctccaatattgttttaaatgcattcttaagtaatagcatgtattttcatacttttatatatagaattctctaatttttgaactgctgctagtataaaaaaaatgtgatagatttttatatacttagctcataccctgtgactttggtcgtttcacttattaatcatagtagttgtgttgtcaagttcttaggatcttcttcataagcaatcatggtatctgcaagcagaattttctttctttccacttgttgtgactttatttatttcttatcctattgcgctcttaagacctccagtaaaatgttgaatagaaatgatgtgaataggtattcttgctttgttccccattataggttaaaacactcaatatatgaacatgaaatatgatggtaattgtagtttcttaatagcttctcaatttgctaagagtgttatgaatgagtgttgatcatcaaatgcttttcaacattcattgaaatgaccatgtaattgtttcttatttattctcttaatatggtgaatgataatgatttttgaatggtaagccaatcttgagcttttgtaaaacagcgaagataaacaacattatcatgatgcattgttctttttatatattactggattaatttaacaataatattttcaagggatataaaggacattaatatatggatttatatttgtaaatgttgtattaatggtattgttgccttcataaaaccaactgggaagtgttctcactctatttgatgcaagagtttgtttggattgatgctatttcttccttaaatgtttggtagccttcactactgaaaccatatgggcgtatagtttttctttatagaaatattttgataacaaatgaatatataatagatgtagagctactcagattttattattcatttcatgtttttataatatttatttttcaagaaatttgttcattgcacttatgttgtagaatttcctggcatgtggtagatattttatttttcatttcagtaggtttgggagaacaggtgatttttggttatgtagaagttctttagcagtgatttctgagattttgatgcacccatcactggagcaatgtacactgtacccaatgtgtagtcttttattcctcacccccctcccactcttcttcccgagtccccaaattccattatatcatgcctttgcatcctactagcttagctcccatttataggtgagaacaaatgatatttggttttccattcctgagttacttcacttagaatagtggtctccaactccatccaagttgctgcaaatgccattatttcgttcttttttatggctgagtagtatcccacagtgtgtgtatgtatgtgtgtgtgtatatatatatatatatatacacacacacatatatgtacatatatatcacattttccccattcatttgttggttgatgggcatttcaactagtttcatatttctgcaattgtgaagtgtgctgctgtaaacatgcgggggcaagtgtctttttcatataatgacttcttttgctttgggtagatacccagtagataccttaatattgtaccacaggctcctgagacactgtttattatgtttcaatcttttaagtttttattcttcagattggattatttatattagtatatcttcagccgccttcctttcttcagttttcttttccttcagttagttatcaccactctgctattaatcctatctagtgaatttttaatttcagatatggttctattatataatttcaatttggtattttatatagtttccatttccctactgagtatttttatttttattctttgagaacataatttcttttatgtctttaagcataattatcatagttatcttagacttctttgctattaatagttccaacaactgagtcatcttagtgttgtggagtattacctgttttttctcttaaatatgggtcacattttttttcttagtatatcatttttatttgtattttggattgttttaataaggttgtagatacttttaattttgttacttttttcctaaggagggttgattgaattcattttagtaggcatttgacttggatggactaaaactacaagtctgtctcttttcaggtggccagcaactcaaatatcagttcagttgttttaactgtggctgggttgtttggcatttaccttgtgcattcctgattcagtggtcagccagatatttgggcagaaaaaaaatacatatatataatatatatgtatataacatagtgtatatctacactatataattatatatgtatatatgtgtgtgtatatatacacatatagaaataaatgcgtacacacacacgtatagctttttttttttttttttttttactttctggctctctcctttcctggattgtcacctgcccccctcacccctcccccacacacgtttcggcagatataaccctgagccatttccttcttccaggcgttcactctccttcactctccacctgcctatttgatttttggttggtttggttggtgtttattttgttttgttttcgtctccggttcctttgtgtagctttgtttttgtactttgtttttgttttcgtctgtattcctaaatttggttgttttaataggagatgaataccataccaaaagcacaattcccacaatgtgtgtttgcatttgtcttctaagtgaactcctgaattatccagctgcgttatctacatagagagccagatcatctgtctcaggcagttctcctttgaccagatctttccattatgaaagctcagggacattaaagtggttctcaaatccctttgttaaagaactgcgccattttactaagattatgtaatttttaatcttttaatacaaaggaagaaaattttatttagcagaggattaaactattctgctatgattttgtagctaaattaaaagaattatacttaaagatttttgttctgattagtgggtagtgttatttttatattaaaaaaacagataaaatctcagtccataacttcagggacaaaggaaatataatttttaaaaattttctaagtgataaaagactatacattgggtacagtatacacaggagatgagtacaccaaaatttcggaaatcatcactaaataacttatccaggcaactaaataccacttgttcccccaaaaactattgaaatgataattttaaaaagagctcccagaaaaagaatatctaattttttttttttcttttcattgtaagcctctaccacctggtaggagaaggtaatagtaaatttggtatcttctccgttttcttcccagggagtatttccacatgctactgtgttatagatgccaaacattagagaaaataatttagtccttggttcatctgactacactggcatccattaaaagtctattatttctttggttatttgtcatctatgcatggctttcttttcatcttaaggactcctattaagtcttgttctctctctcagctaactcctgggattctctttacagcatgagttcttgttcctgtgtccagagatctgttatcatgtttctaatttcttgatgctacttaccctcaaacacatagtgcctgggtatctatctttgactattcaggcattagccctttctcttttgcctctctcctggcaccatagagtatggtaaaattctgagacttggccaggtgcagtggctcacaactgtaatcccagcactttgggaggctaaggcaggtggatcacctgaggtcaggagtttgagaccagcctggccaacatggcgaaaccctgtctctactaaaagtacaaaaattagccgggcgtggtggtgggcacctgtaatgcaagctactcaggaggctgaggcaggagaatcgcttgaacctgggaggcagaggttgcagtgagccgagatcgcgccactgcactccagcctgggctacaagagcaagactcagtctcaaaaaaaaaaaaaaaaaaaaaaaaaaaaaaaaaaaaaaaaaaaaaaggaaaaacctgagattttgctgctgcattcctgaaactccctcaggactgtaaatacctccctctccctctctttttctctctctttcctttctccaccagcccctcccacgataccatcacataccgttcactcacacagagagctaggcttcagaagccccctggaattcccaatactgatgcactccctgattctcttcctgtccctggagaaggacttcttttctagtctggcggctaagaaagctctgcctttataacaaaactgtttatactcttagtctctcaggatttagacttctgaaacccaaaagctttgctttctgaaagtgtggatgtgagaataaaaatctagcttgaaggaagtaaagttataagtttgataggaattgagggggaggaggtagtgaaaattagttaattttttggaacactatcttatcacacacatttgccctttatacatttattatttttgctattcaaataaaagtaacaatatgtattttaacagagtaattttttatttgtgcttattaagttaaatttttcttttttctatcatcttggatataataaacgaagtgtaaatatatgtatatacctgtataattacagtcaagagtttaaagtttgtattctaacttgtctcatttataatttttatgctaaagaatgtgtgatgagagacctctgtggaattttgatgcaaatgtcaaccaaaaattcttggtagcatagatcatctgtctaattcaagacctaatgctgaattattagacaaacatctctgtaaatacaagattggtttatttttatcatgaataaaggggaattctcatacagttttattttactgtcctttagaccttacagtttaatatctaaatattagacatttacattagatatataattagactatctatctgatattcattagatagcctaatggatttgtcattattgtccttctgtcactttccatgtttaaaattttcccttattattccagcatcttcagtgtattatataagaaaaacatttatcaaactgctcttagcatgagaaaacataatataccaaggaaacaggagggaatttcagaaattagaataaattaaaactttgagttaattttttgaacgagtttttatgtttaaaaatgtgccatatttgtagggtctcttgaattacctgtaatatactataattgatttcagcttgatatgtattttttaacgtaaaaaaagatttcatgtactttgaagagtctttgttatcattatcttaacaataatgtgatatttatgttttaattaccacaaaacagcaaccaccacagactaactaaaataaactttgtatagcttccatgctacacacaaactaatcattcaaagttttctcaggatgatgaaatttttaagatcatgttaaattaaccataattttaataataatttatgtcaaaacaatattttttctgtatccttcatctccgtatctataaaatgggggcagggttgactaagtgattccaagatcttatttggctctaaaagtatttgattctaataaacaatgaaataaccgcaaataccactaagtatagacaatgagtatcaaaggaataatgacgcattgctctactatataaataacctttttttactgtaatcattctttacctgctattgtgaatcagtagttttgatgttaaattgtggtgtttttaaacaaacagtatcattttattttattttattttcctcagttttatttaggtataattgacaaatgaaaattgtatacatttaaggtacacacgtgatattttgatatatgcatggattataaaatgtaacaagctaatgcctctatcacttcatagttaccttttattctatagtgagaacaattaagatctactctttaagcaacttttaagtatacaatgctttactattaactacagtcaccttaatgtacataagatctccaggactttttcatcttataacagaaagtttgttcttgattgaatggttcactgagggcacaggtgcaatgaccccacacatgcataaattttatatatgcattttagcttcttgactcagcataatctctcatctgtcctctccggtgaattcttaattactgattatttatgtctttacctgctttgtttgcaagttttgcaagaaattttgcatattattgtatgtgtgtgaatgtgtgtatagcaatgaaatcatttctgttataagcacttgatagaagcatatatctttatatcagtcttgcgatttcagagtacttttgcatatatgagcgatcctaccttattttattgcctcacattgcaaaataaccttggctgttatacttcaaggtctcaggtgttgagtcattagcagctatggaatagatcagaattatattacagctgcacaactacaaacaaaaggtaatccaagatctttcaggcttaacatcagcatatggacaactccttagcacttggctgaaagaaagttaattcgggaatttcaagctaaattccctcaggatgacttctctgaatgatttttaactcctgtaatacaaatagaaaggcatgtgaaaataaatagtatgcaattaaaacagagagcaataacacagatatttgtgtatacatcttccaaaattggtcattttataaagaatgtattttagcatatttagtttatacatgcatgcacttgggaattatttagttcactgacatcctgggtagaaactagtaatagaaacagatctatgacaatttattagaattattaagtctatacttttaaaattaagcacaaagtggcatctaccagaattataaacaagaaactgaatttcagaacatttaaatttcagaaatctgtgtggctgtctggactgttgaaaccacctcctgttcttcctgcttaaaccctctctctgcctatactcccacccatatgccctaaatccatactcctcctaataggcaaattgatcttggagaaatcagatcaaatctcctatataagaccaagaatatttttccagtgtaccttatataaattaaaaccatctctgtggactctaagtgctgtcacgactgcatctgcctcttggacttcatctttcactcctctctcctcagcattgcagccacactagcatggacatgccaagtgcatttctgctatgctcactaatccatttgcctagactgccctgcccctgcctgtggatcttctaattttttttatttaatagactttatttttagagtagttttaggtttacagaaaaattggacagaaggtataggaagttttcatataccccctctcctttctcacccccttacactatattttgtattattaacattttgcattcgtatggtacaattgttataactgatgaagtaatattgatatattgttattaaataaagtccattaaggtttactctttgtgctgttgaagtccatgcattttaacaaatgtataacatcatgcatccatcattatataacatacagaatagttttactgccctaaaattcccctgtgtgccacctatttatcccttcttcttccttcctcctaaactcttggcaatcacaaattctttttactgtctctatatttttgccttttccaggatgtcatatatttggaattatatagtttgtggcttttgcagactggcttctttcactaagcaatatggattcaaggttcccctatgtctcttcatggtttgatagatcatttctttttagcactgaataatatttcattttatggctttactacagtttgtttatcatttcacctattgaaggacatcttggctgctttcgtgtttttgcaattatgggaaagattgccataaacatcaagttttcaactcttttgagtaaacgcttagaacaatattgatgaatcatatggtaacagtatgttaagttttgttagaaattgccaaactgtttgccaaagtggatgtacaaatttgtattctcaccaacaataaatttgagttcctgttggctccacattctcaccaggatttgttatatccgcattatggattttggccattctaatcagtgtacagtagtatctcattgttgttttaatttgcaatttcctgatgacatatgatgttgagcatcttttcatatgcttatttgccatctgtgtatcttctttgatggtgtgtctgtgcagatcttttgcacactttttaattgagttatttattttcttatgattgagttttcaaagtttgttgtacattttggatataacccctttatctaatacatgttttgcaaacattttctcccagtctttagtttatctttttattctcttaacatgtcatttgcagagcaggagtttttaattttaatgaggtacagtgtataatttttttatggatcaaacttttggtactgtatctaaaaagtcgtcaccaaaccaatggtcatgtagattttcttttatttatgttctagaagttttatagttttgccttttacatttaggtatataattcattttgagttaaattattgtgagttctaataattttttattgctgtttctcatttgtattctgattttaatgttaagttctcaaaggggcctttcctaatcatcctagctaaagcagtccctcccaaccaatcactgtttgatccattattctaattttcccctagcattgccattatctaaaattatattgttctttatttattttcattcttactttttatttctctataagtcctacgtgagctgagactcagtttgttttgtttactgctctacccccagggtctaagacactacttgaaaattatttagtgaataaatgaatgaacaagaaatgcatttaacaaaactcacagacacataatgatatatgttcaagtccttatctatgagtgtctttgtaagtaacaaagacagacaactaataggaatgaaaactagggtagcgaagaggcagcaacattcaaacaaaagtattactattttgtttgttttgcctgtagcatgtattaagtccaactgaatctagaatacgttgccacaagaatgttagtaatgttagctagaatcttagtaatgttgaatgatttgcatggaagtttttcaagtcccttatctattgccaatagatagactttatttttggagcaaacctatttaaacattgtgaacagtcaacagagctcaacaaattagatatagaatgaatgttccacaacagagtaaaagccatatatgacaaccccacaactaacatcgtacctatggtgaaaagttgaaagctttttctctaagaccacttctgttcaacataatactgaaaatccaagacagggcatttaggctaaagaaagaaataaaaggtatccaaacagaaaagaataaagtgaaattgtctctgtgtactgacaacatgatgttatagaaaaaatattaaataatccaacaaaaaatgttagaactaataaacaaatttggtaaagtttcaggatacaaaatcaactacaaaaaatcggtaatgtttctatacactaacaacagactgcctgaaaaaaaaattaagaaaacagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaacttttaccaaaaagataaaaagctaaaaagatttttaaaaaaagattaaaaagattaaaaaatagataaaaagataaaagctggaggcactatactactggatttcaaaatatgttacaaacctataataatccaaacagtatgatactggcataaaaacagacatattgaccagtggaataggatagagagcccagaaataaacccatacatttatggtgaattgatttttgacaaaggtgcaaagatcatacaattgggaaaggacagtcccttcaaaaaatgatattaggaatactggatattcatatacagaagaataaaaataggctcttatttcaaaccttgtataagaatcaactcaaagcaggttaaagccttaaatgtaagacctgaaactataaaactattaaaagagaacataatgggaaaatatccataacattgactggtctgggcaatgatttattggatataacctcaaaagcacaagcaccaagagaaaataaagatatcacaaataaatggaaagatatcccacaaataaattcttttgtggattgaaagaattaatagttaaaatgtccatactaccgaaagcattctatagattcaatgcaatatctatcaaaattccaatgttattcttcacagaaatagaaaaaaaatcctagaatttgtatggaactacatgggcttatatcagattgaaagcttctgcacagtagggtaaacaacagagtgaagagaaaacccatagatcaggagaaaatgtttgcaactcatatatcaaacaagagggtaatagccaaaatatacaaggaaatcaaactacttaataagtagaaaaacaaataaccccattaaaaagtgagtaaaggactcaaatggacatttctcaaaagaagagatacaaattgccaacagatacatgagaaaatgctcaacatctctaattataagagaaatgtaaattaaaaccacaatgagagattgcctcacacctgttagggcaactattatcaaaagataacaagcgttggcaagcacgtggagaaaagggaaccctcatacactgtaggtggtattgcaaattaatacagccattttggaaaacagtatgaacgttcctttattgtgagatccaggaatctcagtactgtatatatatatccaaaggaactgaaatcagtatgttgaagagttgtctgcactcccatgttgattgtagtactcttcacaatagtcacgatatggaaacaatataagtgtccatcagtgcatgaatggatttttaaaatgtaatatatttacacaatagaatactattcagccttaaaaaagtaaatttgtcatttttgacaacatgaatgcaactaagaggacattgtcttaagtgaaatatctaatggcattttagtggaaaattatgtaggaccaaccatgtcatccaaaaactcaatattttatctttcggggctgaaagaagaaccaacatgactgaaaataaataaattaacagatggcatttgaatttatgataaaagtaaacaatagagaaattatggtatggcttaatgaatataacaagaggcagcaagcatctgaagggtgtgtgtgtgtgtgtgggtgtgtatgtatgtatttatttgtgtatttatgtgtcattagatataccattagcttctagatttctgcattaatacaggccatgcatggaagagctgtataaaacgcttttccctatgctattcggcagtaattttttgaaagtcagagatggctgcatgtaaatgttactaagttctaccaatctctaaaaatcacatttaataacaatttgccagactttcatttatagaaagaaacagaattatgttagaaacacaataatcagctatttgtcttttcaatatcttctgggaaaaatttgcagagttttaaaaatttaaattatcatggtggacatttatgtccttaaggtatccatgtaatatatagatagcaaaatatctttgtttcagtttaaacatgaaaatccaaaattagcatatcataatcaagggaattgcctaaggttgtctttctgaaaagaaatgacgtttaaaaatttttgttttaaaatcttatgataaaatcaatgggactttttcataacttagagaagaaaataaaacatctagcctaatgtgacctcccaaatatagaaattgaattccattttaaatgatttcttttgatctttggacatatgcctattctttgcacgattatggctggaattggtgagcatagaattgtgtgtgcacactaatgtgtgtatgtgtgcatgtgtgtgttttgcttaaatgacattattatttattttttgatcagtgaaatgtctatcttttctgaagcatgagttttttactaaatgcaataaatttagtgtacattcaatttttcaaaactatttcaatccactctatgccaaactacaaattgtaatgccataagaattatattgcatgtattttacaactccaatctacttattggaaggagggggtggtgaaacatatgtcatgtagctgttaaaggagatctttgccaggtacttctaaagaagattttaattcaggagaaaataattgcaaagcagagaaggtctgtgagaagaatctatcttgagcacttaagctgaaaccagaagtccaaacaatgacctctgaatcatgggggtcaccttgtatcctctatttatctttaaaattgaacttatcctgaaatgtttgcttaaaggcaaatgttatttcctgatcgagatcttataatgaattaatgccagagacagaacttggattaaaggaaagagaatgtcttttgacttttaggtccgttattatcaatatgtttagtttcatagcttgtctcctattggagtcttaattcctttaaaattggaatttcatcacactcatctttgtatcccttagaacaccaggtacaagatcatgcacttaaaaatgtattgacttgaataattttccagtgcagtctacttgtctacataaatattgttagcaaattagacatgaaatggtaacattattgaacattggctgcatcttaaccatcctgttaatttcatttgcatagtctttgttcaagtattttacagttcaagctttcttttggaccataatccaaacatatttaaaaagtaaaaatgaagtcctttgtgggtattttttactttcataggagaaggtgtaatttaaacctgttggttgataaaatacaaaaagtatcttgggatctaagtttttcttcgggataccaatttgagtggtctgtcactttctgcttacaacatactgtgcttatcaaactaaactccccaaaatggaactcacgagcctctatgatatggctcctgactacatgtccaactttaccttcagtcaacctatggcttctatattctcatgagtgaacgtattagctttctactcctagaatatctcaactttgccattttaggagttttcacttgctttcccatatgcctgaaatgcatatgcttgattagtcccgtggttgtctccatagcgccctacagttcttggatttaaatatcctagatatttaaatatcttgtaaaggggtgttttctgaccatcttatctataaagtagctccccatcagaggtacttgctgtcacagcacattttttatttctttcacaggatgtgtcacaataatgatcatattcagtagctgtcttctaaaacaaagtataagttccatgagtacagtaacctttttctacctttttcccgaatatacccactgcgcagaaaacagtgcccaatagaaagtaaaagtctaggaaatgatttctgaatgaaaaaacaaatatttactgaaaaactgtgacttttgagatcttaatttaagcagtaaattaatttgaagggtaaagtataattctgatacttttttgcatttttgtcttctctaaaaccaatgactagttagtatacatgttgtaagccagccaaactgcattattatttcaacaattaagactataggacataggaaattaggaagttttccaaagtagtaatggggataaaaaaagaattttttagctttgtttttattcaaacaagaaataactatattttaaaatttttccccatcaaaggtactgaatgtaaataagtcccttatgataccaagtattttttcatatctatatccattttaataattagtttatgcaaaagttcataaatttagaggtttgttggaaagttattatttctaatctcctaataagctgaaagaaaattatgacttcaaacaatatattgaaaccttattaagagaaactggccacgtgtggtggctcatgcctgtaactccagcactttgggaggccaaggcgggtggatcacctgaggtcaggagtttgagaccagcctggccaacatggaaaaccctgtctctactaaaaatacaaaagttagctgggcatggcggtgggtgcctgtaatcccagctactcggaaggctgaggcaggagaatcacttgaacctgggaggcggagattgcagtgagccgacattgtgccactgcactccagcctgaggggcaagagtgaaactatgtctcagaaaaacataaataaattaaaaaaagagaaactgtgggaaaccccccccccaaaaaaaaagaaagaaaaaaggaagaatagcaggagtctgtttttataggaatgtcatttgagcttaacagatctagaggttaagctttgaagagttttaactatatatgtgattctcataatatctatttcattcacaggaaaatcagaataattcttataaggaaatttgtgatcttaatatacagtactataatattgacaacatttcattaaaattataagtacttattggtttcctttcaaagtgtcatatctgtgccatttctatctgtatagcttttacaattataatttatatttaccaattttcctttttaacatgatataaggtatgaaagtgttttatcacttcctaattattttattatattttgctatcatctactttgctatcatctatgttctgaaatttatttatgtctcttatatctgtatggtggaaattttttttttattatactttaagttctagggtacatgtgcacaatgtgcaggtttgttacataggtatacatgtgccatgttggtttgctgcacctattaactcatcattcacattaggtatttgtcctaatgctatccctccccctgccccccaacccacaacaggccccagtgtgtgatgttcccctgtgtccaagtgttctcattgttcaattcccacctatgagtgagaacatgcggcgtttggttttctgtgcttgtgttagtttgctgagaatgatggtttccagcttcatccatgtccctgcaaaggacatgaactcatccttttttatggctgcatagtattccatggtgtatatgtgccacattttcttaatccagtgtatcactgatggatagttgggttggttccaagtctttgctatcgtgaatagtgctgcaataaacatacgtgtgcatgtgtctttacagtagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgctgtttcctgactttttaatgatcgccattctaactggtgtgagatggtatctcactgtggttttgatttgcatttctctgatggccagtgatgatgagcattttttcatgtgtcttttggctgcataaatgtcttcttttgagaagtgtttgttcatatcctttgcacactttttgatggggttgtatgtttttttcttgtaaatttgtttaagttctttgttgattctggatattagccctttgtccgatgggtagatcgcaaaaattttctcccattctgtaggttgcctgttcactctaatggtagtttcttttgctgtgcagaagatcttagtttaatcagatcccatttgtctattttggcttttgttgccattgcttttggtattttagacatgaagcccttgcccatgcctatgtcctgaatggtattgcctaggttttcttctagggtttttatggttttaggtctaacatttaagtctttaatccatcttgaattaatttttgtgtaaggtgtaaggaggggatctagtttcagctttatacatatgactagccagttttcccaacaccatttattaaatagtgaatcctttccccatttatttcttttttttgtcaggtttgtcaaagatcagattattgtagatgtgtggtgttattcctgaggcctctgttctgttccattggtctatgtatctgttttgataccagtaccatgctgttttggttactgtacccttgtaacatagtttgaagtcaggtagtgtgatacttccagctttgttctttttgcttaggattgccttggcaatgcagacacttttttgtttccatatgaaatttaaagcagttttttccaattctgtgaagaaagtcattggtagcttgatggggattgcactgaatctgtaagttaccctgtgcagtatggccattttcacgatattgattcttcctatccatgtgcatggaatgttcttccatttgtttgtgtccccctttatttcgttgagcagtagtttgcagttctccttgaagaggcccttcacatcccttgtaagttggattcctaggtattttattctctttgtagcaattgtgaatgggagttctctcatgatttggctctctgtttgtctgttattggtgtataggaatgcttgtgatctttacacattgattttgtatcctgagactttgctgaagttgcttctcagcttaaggagattttgcgctgagacagtgagctttctaatatacaatcatgtcatctgcaaacagggacaatttgacttcctcttttcctaattgaataccctttatttctttctcctgcctgattgccctggccagaacttccaacactgtgttgaataggagtggtgagagagggcatccctatcttgtgccagttttcagagggaatgattccagtttttgcccattcagcatgatattggctgtgagtttgtcataaatagctcttactattttgagatatgttccagcaatacctagtttattgagagtttttagcatgaagggctgttgaattttgtcaaaggccttttttctgcatctattgaggtaatcatatggtttttgtcattggttctgtttatgtgatggagtatgttcaatgatttgcatatgttgaaccagccttgcatcccagggatgaagctcacttgattgtcttggataagctttttgttgtgctgctggattaagattgccagtattttattgaggatttttgcatcgatgttcatcagggatattggtctaaaattctcttttttgttgtgtctctgccagtctttggtatcagaatgatgctggccttgtaaaatgagttagggaggattccctctttttctattgattggaatagtttcagaagcaatggtaccagctcctctttgtacctctagtagaattgagctgtgaatccatctggtcctaaactttttttggttggtaggctattaattattgcctcaatttcatggcctgtgattggtgtattcagagattcaacttcttcctggtttagtgttgggagggtgtatatgtccaggaatttatctatttcttctaggttttctagtttatttgtgtagaggtgtttatagtattctctgatggtagtttgtatttctgtgggatcagtggtgatatccgctttaccattttttattgtgtctatttgattcttctctcttttcttctttattagtcttgctagcagtctatcaattttgttgatcttttcaaaaaaccagctgctagattcattaattttttgaagggttttttgtgtctctatctccttcagatctgctctgatcttagttattttttgccttctgctagcttttgaatttgtttggccttgcttctctagttctcttaattgtgaagttagggtgccaattttagatctttcctgcttttgtgggcatttagtgctataaacttccctctacacactgctttaaatgtgtcccagagattctggtacattgtgtctttgttctcattggtttcaaagaacatctttatttctgccttcatttcattatttatccaggagtcattcaggaggaggttgttcagtttccatgtagttgtgccattttgagtgagtttcttaatcctgagttctaatttgattgcactgtggtctgagagacagtttgttgtgatttctgttcttttacatttggtgaggagtgctttacttccaactatgtggtcagttttggaataagtgggatgtggtgctaagaagaatgtatattctgttgatttggggtagagagttctgtagatgtctattaggtccacttggtgcaaagctgagttcaagtcctggatatctttgttaatcttctgtctcgttgatctgtctaatattgacagtggagtgttaaggtctcccattattattgtgtgggagtctaagtctctttgtgggtctctaaggacttgctttatgcatctgggtgctcctgtattgggtgcatatatatttaggatagttagctcttcttgttgaattgatccctttaccattatgtaatggccttctttgtctcatttgatctttgttggtttaaagtctgttttatcagagactagaattgcaacccctgcttttcttttgctttccatttgcttggtagatcttcctccatccatttattttgagccaatgtgtgtctctgcccgtgagatgggtctcctgaatacagcaccctgatgggtcttggctctttatccaatttgccagtctgtctcttttaattggggcatttagcccatttacatttagggttaatattgttatgtgtgaatttgatcctgtcattatgatgtaagctggttatcttgcccattaattgatgtagtttcttgctagcattggtggtctttacaatttggcatgtttttacagtggctagttctggttgttcctttccatgtttagtgcttccttcaggagctcttttaaggcaggcctggtggtgacaaaatctctcagcatttgcttctctgtaaaggattttatttctacttcacttacgatgcttagtttggctggatatgaaattctgggttgaaaattcttttaagaatgttgaatgttgtccctcaaccctcttccagcttgtagagtttctgcagagagatctgctgttagtctgatagttaccctttgtgggtaacctgacctttctctctggctgcccttaacattttttccttcatttgaaccttggtgaatctgacaattatgtgtcttggggttgctcttcttgaggagtatctttgtggtgttctctttatttcctgaatttcaatgttggcctgccttactaggttgggggagttctcctggataatatcctgcagagtgttttccaacttggttccattctccccgtcactttcagatacactaatcaaacatagatttgttttttttcacatagtcccatatttctcggaggctttgttcatttctttttactctgttttctctaaacttctcgctttatttcattaatttgatcttcaatcactgatagcctttcttccacttgatcgaatcggctactgaagcttgtgcatgtgtcacgtagttctcatgccatggttttcagctccatcaggtcatttaatgtcttctctacattgtttattccagttagccgtttgtctgatcttttttcaaggtttttagcttccttgtgatgggttcaaacatcctcctttagctcctttagcttgttattaccgaccttctgaagcctagttccgtcaactcgtcaaagttattctctgtccagctttgttctgttgctggtgaggagctgcgataatttggagaagaggtgctctcgtttttagaattttcatcttttctcctctggtttctccccatctttgtggttttatctacctttggtctttgatgttagtgacctaccaatggggttttggtgtggatgtcctttttcttgatgttgatgctgttcctttctgtttgttagttttccttctgacagtcaggtccctcagctgcaggtctgttggagtttgctggaggtccactccagaccctgtttgcctgggtatcaccagcggaggctgaagaatagcaaatattgcagaacagcaaatattgctgccttatccttcttctggaagcttcatcccagaggggaacccacatgtatgaggtgtcaatcagcccctactgggagatgtctcccagttaggctacacaggggtcagggacccacttgaggaagcagtctgtccgttctcagagctcaaacgctgtgctggaagaaccactgctctcttcagagctgtcagacagggacgtttaagtctgcagaagtttctgctgccttttgttcaactatgccctgcccctagaggtggagtcaacagaggcagcccaccttgctgggctgtggtggggtccaccagttctagcttgcctggctgctttgtttacctactcaagcctcagcaatggcggatgcccctccccctgccaggctgctgcctcgcaggtcgcaggtcaatctcagactgctgcactagcagtgagcaaggttctgtgggcgtgggacccaccgagccaggcgcaggatgtaatcccctggtgtgctgtttgctaagacggttggaaaagcacagtatttaggcgggagtgccccatttttccaggtacagtctgtcatggcttaccttggctaggaaagggaaatctcccaacccctggcacttcccgggtgaggtgatgccccaccctgctttggctcacccttcctgggccgcacccactgtccaaccagtcccagtgagatgaaccaggtacctgacttggaaatggagaaatcacacatcttctgcatcaatcatgctgggagctgcagaccatagctgttcctatgcagccatcttagaaccggaccacatcctctttcaaggtatgaaagattattgaccttattttgtctaggtggaggaactgtatcatacagtggtatatttgagctactgtgggactgatctagtccttctataaagagactatctaaatgccttataaatcttgatatttttctaagaagcactatctttgagaaaaaacttattttctggtaaataaaatgaggaaatatgaggggcaaatttgagagccttcatctttcaattattccctttaaagctcccatttgattttggattatgccacggtgaatgcaaacaaatcccacttttcaaatggaataatttattttcttaatgtttgtgtttcaacctaaaagaattgtttttatacctacatttgaaacttcagaaaacaagattcacagaataatgaaaaactacattttaacctaaatgtggaactgtgattacagacattaccgcaagcaagtgattcaaacaccacttttcctgtgtcatcttttaaacaccactgcagattttttattttgaacatgtacttggcttctgcttctatctaagttagaggaacagtaattggatgtacccttgtgcctgaaacaataacaagcaacaacaaaaacaaacagaatatatgaaacaagcttttttttttttttttttgagtctcgctctgtcttcaggttggagtgcagtggcacgatctcagctcactgcaacctccgcctgccgggtacaaacgattctcctgcctcagcctcccaagtagctgggcctacaggcatgcaccacaatgcccagctaatttttgtatttttagtaaagactgggtttcaccatgttcgcaaggatggtctcaatctcttgaccttgtgatccgccctcctcaacctcttgagaaacaagcatttttttaaaattgcaaaacactaggcaataaagtagaaggaacccagagagatgaaaaacacagtgctacatttgcatcattttcctgctttcagagaatttctgagccacaactcgagaaaggagagcccagatggaaattgatgaactctgtaaggtaaggaaatgaaaatgagagcacagggacagcaaggcttttggaattcacagaatagagctctggagaggagaaagatacagaaggaaccccaaatatttgcataaggtactcctcaagtattcatcagagtactgatcaggacatgcatgtgaggaaactgacatttgtagtaccatccatcaatagcacaacacatattcatttcaagtatacatgaaacattgaccaagatatatactaagccataaaataagtcttagtgaattttaaaagattcaactcacacaatgtatttctctaactaaaacaggatagacttaaaattcagtcagtccccaaatatttgaaaatcaaaaaaacccatggatcaaagaagaaataaaaaagtattttgaagtgaatggcaatgaaaatacaaacataggaaaaactaaggaatgatgctaaagcagttcttaggaatttacagcactatatgctgacattactgaagaaaagatgtctcaaattgatgacaccaacgatcactttaagacactagaagacatgaaaattaactcaacatagcagaaaggaaagtataaatagcaggacagaaatgatcaaatagagatgatgtcggtaatgcaatgttggtttaatatttgaaatcagacaatgtaattcaccatgcgaactaaaaaacatgcagaaaaaaataaagaagacatagagagctatacttgttcatcaacagaagactcaaaatgattaagatgtcaattctccccagacttatctatagattaaatacaatgccagttcaaatccttgcaggtcttaactgaagaaattttcaagcttattttaaaactcgtatggaaataaaaaaatatagaatcactataacaactttgaaaaagaacatatttggagtagtaacactatctgctctcaaggtttattatgatgctacaataatcaagactattggactggcataaagaaataacttggtcaaagaaacagagtagagattacagaaatagatccacatatgggcaactgttgttcgttttttttaaatttatcgtctttctgaaaaatcttcatagaaaactatttggtttagctctcagtagcctgcccctgagctgtgaggaagcttgccttcttttgagctacctgatctttcttctgagcaagggacattttgggatggttctatctcttttaacttatttcctgggcgtcttctcatagactagattctctcatatagcagcatgagctttcttatacatctcctccatgtctagagttatgccgttctttatatattgagaggattgtttcttgtaagcatcttcatcttcctctacttagtagcacatgtaatctgcgacattctggctgataatgtgcttccagtgtacttctgcattaaattccttgctttcagaatcataaccgggaatcgtttggtactgtaagggatagacaaacctccattcacagctccctcagggcgccagaaactttattgccagtagtagttctggcaaggccttcatctccagtcacctccacttggccttcatagatcttgtccataccaaacctattgagaagcctgtggtccagcagcaggccagtacaatacgctgcagcgtaatttgtcaagccaaccttcacgccatattttggcagttcatgtgcatatgctatgcagactatcatatccccttctatacaggcataagcaatatgacaaatgatatctgttacactatcatcctgtatttgggtgtttcctatttatttttatcctgtatcaccaagcgtttctgagcatagtaatcaattttaccgtcccattgtcttctaaatttcacttggtgtctcttaaagtaggccttagtcttaacaactttaatgaaccacatcctgcagagcaaatgcccacgtctgcggcttggcagagacttctaggctcagcagcgctaggtggggaaaagagggagcaactgatttctgatgaagttgatgacagggaggaacgggaactctcacacactcctggtgggaatgtaaaatggcatgactcctacctgtttggaaaatagtttaacagttttttagaaagtttaatatatacctacctatcatatgactcagccattatactcctaagagaaacaaaaacatatgtccatacaaagacttgtacccaaatattcatagaacctttatattcaatagtcaaaaactagaaataactcaaatgaccatcatccaaattgtagtatgtccatacaataaaatgtaataaactactgataaacacagtgtggatgaatctagaaataatgatactgagttttaaaagctagtcaaaaaacagtatatatggtgtgatcccatttatatagaactcaaaaaaatgcaaagtgatctgtataactgaaagcacatcagtggcttcctgtagagaggattgcagtgggttctaatctctcattataaaggagaacaaagaaactttcagaggtgatggatatgtttactatcttgattgtgataaaggctccagaagtgtatacatgtgttaaaacattgaattgtacactttatatgtgtacattttattgcagatcaattatactttaacgctgttaaaatatgaataaagcacgttttaaaacatttagaaatccaaaatatcataaattaaacataaattataaatgatgtagattgaatcaattataataaaattacttaaaaaagtgttatcagaaaaaaagaaaatggtactctactatggtcacaataaatctaatgaggagaaatatttaataacactgataaacactagtggattttgttcctggttcaaatctgtcaattcagtatttcctaagattaatattaatttattgtataaaacatttgtgtttagtcaattgatagactgattatttcttctaaatacagaggaagctttatctgggaattgcattatttcctagtgattcttactacctattctaataggacacaatttcacagatatattcttcttgatttttgactaagattttaaagaaataccgtcttttaatttttgattaatttttttctacaatcttagaatgaaaattttggagcagaaaagaccacagaaacctttgtaatatatctcctcaatatataaaagccagaagtgagctcaatttaaatggctaacttaggatatgaggagtaattggcaacaagtgctggaaccagatttcaagtctcataatatccagtccaaaactgtgagacactatgtaggtttcttcaacttgacatattatgtatgatagcagagtggattttctaaataggtggaagaagcctttaccttcgactgacagatttgctgagaaaagacaaaaaggatcacagcaggttcagatgaaaaattgacaggagcctccacctaactctgatactgactcagcatgagatatatagatgacagcaaccaatactctaaaaaaattatatatgtaagaaaagatgcagcctagcaaacacataaaagtatataactgtgataattattaataattattaataattgcagggcccaccagtcttctgtcagtaaattgattgtacacaggtttactgcctgagtaatttgtttatcttgcctgcatcagttattttgttgaattatcatcataataacgtgtgtgaaccagtcttcttaaaagtgtaaagactttggtctcttcttgttgatttatagtttagtcatgacagcagcaacaaccaccacaaaaataatagcaaatacttatagggtgttaaatacatgccagccccatattagcactgtataacacttcacatattcccactcctttaaatacttcaggtatttctaaatacattacatatcttaacttctttaattgccacaaggcctataagtttgatgctatttttacccctaatttacagatgtggaaacagaaagatccattaagttatggagcaagaaacactctggagataatactctaaaccactgttttaaactgtagaattaactttacaaaaaataaaaaaataaaaagctttagccaaaatttagaagaaagattgtactccaaactaatgctttctgctgatattggcagaatttttgcttgctgctctaatagttttctgtttaatgagcaaattgctttaagtacacatataacactgcggcattaaggataaagatattcagccaattcctttctcatctgtgatagttctagctctgcttatttgtacaatagcactttgaatttaatctttagaaaaaacacaagaaattgacattataaacttctttaaattaccagtgaataaagggggcaataaaatcagtaatttattaaataaagcacaatggaagcattcattaagatgtcatgaaaatgctaattaataatcaaaacgtatcctattgatttgagagcttttcagttagacttccagataacatctagaaataagcactgtacattcttaagtagagatttcatgactaggtcatatccttatatagcacccctcttttggggtgtaaggaaataccctgcagtgaatatcctctgaaagagactgcgttatgagaaaaaacacaaagattatcttctaggtcactaacaagggctgattattttatgtcagtcatattgctcttcttttttcctttttgtcttgataaattgtatcagctctccaaaacccagcttatctcatccctttaatttcctttagtttgatttgtttcttccttaactttccagaacattgaggtctatacatagcatctagcaccaatttatatagtatttctccttttggttattgattctaactacttggttgagcattaaatattataatatacaccctactggtggtgcatctgtctcatgtttctctagctccacgcacctatcaaagaactacaggtaggagaccctcaggagcactctgctccttttgtccactgaaaagaaaaagtgtatattcatttggaggtctttgcgcagtactctgttgagatctacagatgcagaaagttaagagtacagctaaatattatgtaagttgaaaatgattggtgcattcattaggtaagaaagtcttttagtttttccaatctagtcaaacttcattaccaaattatcttttatccaataaactcatttttaaggttgaataatattttactctgtgtgtgtgtgtgtgtgtgtgtgtgtgtgtgtgtgcatatgtatttgtgtgtaaccacattgtctttatccattcatccactgatggacacttaggttgatttcatgtcttggctatgatgagtaggaccacaatcaacagatgtacaaatgtatctttaatatactgattttctttctttggatttatccccaaaagtgagattgttggctctattatagatctatttttatttttttgaggaacctccatactgttttccataatggctgtaccaatttactctcccaccaactgtgtacaaaggttctctttcctcatattcttgccaatatgtatcttttatctttttgataatagacaatttaacaggtgggagatgatacctcattgtggttttcaatagtatttccctgatgattagtgatgacagcaccttttcatctacctgttggccatttgtttgccttccttggaaaagtatctactcaggtctgttgctcattgtttaatcagattatttgaggttttgttttttttcaactattgagttgtaacagtttcttacatattttggatattaagcccttatcagatgtatgccttgcaaacattttttcccaatccatgagtttctatttcattctgttgattgtttcatttgctgttcagatgaaaaactaacgaaacccactgaactactaaactacttaactactaaaactgctagccgggcgtggtggctcacacctgtaatcctagcacattgggaggccgaggtgggcaaatcacaaggagttcgagaccagcctggccaacatgatgaaaccccatctctactaaaaatacaaaaaattagctagatgtggtggtgggtgcctgtaattccagctactcaggaggctgaggcaggagaatcacttgaacctgggaggcggaggttgcagtgaaccaagatcacaccactacactccagccctggcgataatgcaagactccatctcaaataataataataataaataaataataatgaaaaaactgctaaaaagcagacgcttttagtttgatgcaatcccactttcctagttttgcttttgatgcctatgctttcactgtcatagccaaaatgtcatcgtctagaccaatgttaataagctttttccctatgttttcttctagtagttttatgatttttggaaatatgtgtaggtcttattccattgagttaacttttgtacatcacttgacattatgcaaagtgaagtaagccagacacagaaagataaatactacattatttatttctatatggaaccaaaaatatttgaactcaagaagcagagagtagaatggtggttgctgggctgtggtgaacggagtaagggggagatgttggtctggggatacaaagtttcagttacgcaagatgaataggctctggagatctaacgtacaacaatgtgactatagttaacagtactgtattgtgtacttgaaatttgctaagctcttattaagtgttctcaccacacacacacaaagaatcttcagggatcccaaaaagtttatatgaatgcttatgtaatttatttctccaaaatccatgtaaaaccccaataatactataaatgactaaataaatagtgtataaaaaaataacagaggctgggcgtggtggctcacacctataatcccggcactttgtgaggctaaggtgggcatatcacttgaagccaggagttggagaccagcctggccaacctgccaaaaccctgtctctactaaaaatacaaacattagctgggtgtggtggtgcacaactataatcccatctacttgggtggctgaggcacaagaatcacttgaacccaagaggcagagtttccagtaagccaagatcacaccactgcactccagcctgggcgacagagtgagactgtgtctcaaaaataaacaaataaataaataaaataaaaaataacagtgataacttgttctgatattctctggctgcattagaatcactaaaaatgattgacctatgaaattattaatgctacccatagtaggctaatgatggatcacttccatgaatctcatcttcctcgtctcttaatttgaattgtaactgccatgaaagaccttttctaattattttaaatttactgaattagctgtgaattaagactgaaaagatatatttggagattaataaagttcttcaggaaaggtattttatttacatatttattttggtataagattccctacatcttataattacaccatcagaaacacaaacctaacttacctttcctccttgcatatttagcaaatgccataatcatgcatggcctgttactttctgaaccatttcctattgattatatccactgaaatgttgacattgaatgattgctgaactctatctgtacaagcactgaaagtatttgaaagtagaaattactcttcaaatttcatttcttttatcttttctgttataagaacttatcagtgatttccttctgtatcccattatagaaatggcatcatgaaataaaatataagctgacagttctcagatttattattgtatttgatatattgacatttttaaagagtggtgctctgtagttaaatgaatccaaagagattaaatctctttaaaaggagtcagtcctctaagagtggaattttcttgccaatgcagcttgatcagaccatagttgggggtgggctttcagaaattgcaacacttttcatctgctcatctatttgaggcagtattatttttttgagtttcaatatcttaaaatactgatttttctatcaatcattacaattgaatgcattcacattagttgatttctatgaaagtatcaatatcaatagaaaattacatcttggaaatggatttgactcatgtacttgaaaaatcagtgtgtgaggaaatttaaaagtccagttttcattaattttagcacaaagtgttttattgaaacaaaatgcttcacctatctgtattttagtatttgttacatatgtagaataggtaatgaccaagtcaggtgattttgggtatccatcaccttgagtatttatcatttctatgtgttagtaacacgtcaagtcctctctcctagctacttggaaatatacaatacatttgttgctaactataatcaccctactgtgcttttgaatattggggattatttcttctatttaactgtatacctgtgcccactaatcaaccttggtttaccgccccccccaatcccacccttccaagcctctggcatctataattctattctctgtctccatgagatcaacttttttagctcccacgtatgcatgaaaacatatagtatctgttgtgctgtgtctggcttatctcacttaatgtaacaacttccagttccatccatgttactgcaaatgccctaattttattatttttatggccaaatagtattcctttgtgtaaatatactgtatttttaaaaaatccacttatatattaatggacaattatgttgattccatatctttgctattgtgaatagtgccgcaaagacatgcaagtgcaggtaggtatccctttgatacacatatttctttttctttggataaatacccagtagtgggattgctgaatcttatggtagtattatttttgattttttgagaaatctccattctgtcttctatagtggttatactaactttcattcccaccgacagtgtatgagttcccttctcctcacatcccgatcagcatctattaaattttttttgtctttttagtaagagccattttaactgggataaagtaatatctcattgtggttttaattttcatttccctgctggttagcaatactgagtattttatcatataccacttgatcatttctttttgagaaatgtctattgtcctttgcccacttatttatttatttatttatttatttatttatttgagacgttgtctcgctctgtcacccaggctggagtgcagtggcgcgatctcagctcactgcaagctcagcctccccggttcacgccattcttctgcctcagcctctcgagcagctgggactacaggcacctgccatcacgcccggctaatattttgaatttttagtagagacggggtttcaccgtgttagccaggatggtctcgatctcctgacctcgtgatccacctgctttggcctcccaaagtgctgggattacaggcatgagccaccgttcccagccctttgcccactttttaataggatttttgttgttgttgatgagttgttttgagtttcttgtatatttcagatattagcctcttgttgcatgaatagctggcaaatattttctcccattcaacaggttgtctcttcactcaacggattgtttccttgctatgtagctttttagtttaatagtcacatttgtctatttttgttatagttctctgcgcttttggggtcttagccatgaaatgtttgtaagattgatgtcttgaagtgtattttctgtgttcttttctagtatttttacagttccaggtctaatgtttaagtttttcatggatcttgagttaatttttctatatatagagagcagtccagattcattattttacatatgtacatctaattttcccagaaccgtttattgaagaggatgtcctttaccagcatgttcttaatgcctttatcaaaaataagttggcaataaatatatggatttacttctggactcactgatccattggtctatgtgtctgctcttataacaaaaccatgctgtttgtttgggttattatagccgtctaacatattttgaagttgggtagtgtgaagtcttcagctttgttcctttggctgaggattgttttggcttttcttgctcttttttggtttgatatgaattctataattttttttaattctgtggaaagtgacattcttactttgataggaaatgcataggatctatagatgctttaagcagtatgaaaatttaacaaaattgagtttcccaatccataagcctgggatactgaactgtagttttagtttgttgttgtgtctttgtctggtttggtacctgggtaatgctagcctcatagaatgatttagggagagttctcacctcttcaatttttttgaatactttcaggagaattggtattagttctttatatgtttggtagaatttggctgtgaattcatctggtcctgggattttctttgctgggagacctttcgttactgattcaatgtcactactcacaattggtatgttcaggtttttttttactttttcctaattcagtcttggtaggtgtatgttgtgaggaattcatccatttcttctaggttttccagtattttagcatatagttgtgcataatgatctctgatgatcttttgtattttgttggtatcaattgcaatgtttccttttctgattttgtttatttgggttttttctcttcttcacagcaatattggcctgtaattttgttttgttttgttgaatgtgtttttttgaatctctatgtcattgagctctgatctgatatttactatttctttccttctgataattttggatttgacttacccttgctttcctaattccttgaggtgcatcattaggttgttgattataaatctttctactttttaaatgtaaatatttactgttataaatgtcccttttagcactgcttttgctgtctcccacaagtttgggtatttttgtatttccatttttatttatttcaagaaattttttgatttccatcttagtttcttcattggcccaatggttggttatccagaagcatgtttttaatcttcatgtatctgtatagtttccaacgttcctcttactgatttctagttttactctattgtagtctgagaatatgcttagtgtgatttctattttataaaagatttgttaagacttattttgtgtcccaaactatggtttatcctgaagaatgttccatttgctgatgagaagaatgtatattttgtaattttggataaaatgtcctgtaaatgtctgttaggtctatttggtcaaaaataaagtttaaatctactgtttctattaaaagtgcaatttaaatctactgtattaacattttccactattattgtattgaagtgtacctctctctttagatctggtaatacttgatttatgaatttgggtgatttagtgttgggtgtatatatatttagaattgttatttcctattgcttaaacaatctctttgtcattatataatggcctttgttttttctttactgtttttgacttaaaattgattttatgtgacataagcatagctactcctgctcgcttttggtttccttttgtttggaatatctttttccagcacttcactttgagtctatatatgtctttgtaggtaaagggtgtttcttgttagcagtatatatttagatcatgtttctttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatcatgtttctttatccattcaaccagtctatgtcttttaagtggagaatttaatccatttacattcaaggttattattgatatgtaaggtttacttcctaccacattgttgtttcgggttgtgttgtatattttttgttcctttctttttcttctttcatttgctattgtggttaggtagttttctgtagtggtacaatttgggttgtatctcttcttcatttgtgtgtttggtttatcagtaagttttatactttcatgtgatttcatgatagtaaatgttgtcttttcgcttccagatttaggagtcccttaagcatttcttgtagggccagtgaagggccatcagtgtttgcttgtctgggaaaaacttcatttcccctttattgatgaagaataattttgctgtgcatgatatccttgagtgggaagtttgtttttttttaaagcactttgaatatgttattccattttctcctggcctaacaggtttctgctgagccccagtgttagtctgatgggagttcctttataggtgacaatatgtttttcttgctgttttatatagttttctctttaatactgactttagatggttggactataatatgctgtggataatttttggtattgtagctgtttggggatcactgggccttctgtatctggatgtgtaaatctgttgctggacttggaaagttttgatttattgtttttttaaataggatcttaactaaactcttgttttctcttcaccctcagggacattgataattcaatttcaaaacacccatattcaagttttgagattctttcttctgcttaatcttgtttattattgaagctttcagatgtatttttatttcatttaataaatttttcattttcagtatttctgattttttttaaataactattcggaaaatttctcattcatatcctgacttgtttttctgatttctctgtattgctttaatcatttttatttatctttctgagcttctttaaactcagcattttgaattacttttctgggaattcatggatttattttgattgggatatgttgttagaaaattatatttttgggaggtgtcatatttccttgctttttgatgcttcctgtatcctcacattgatatctgtgcatctggtgtagtagttgcttcttccaactttttaaacttacttttgcagagaaagacattttcctgaagatttatatatgttgttggttgggtagagaactttggcctcaattttgagtgcatgcgatattgtagtatctgtgatttcatcagctgtaaagtgtcagtggtatctttgaattcctcggtggcttagggcttagaacacagttattagtgaagaatgtggtaaagtcttactggggacgaggatgctggatagtccagtctttgagtcccagtggtggtagtggtgggctaagcatgccttaccttgagccgtagagcaatgtatgctggctctggtgttagcacattcaggcaggccaattcttgggcccccagatggctttctcagatgccagtagtggcagcagtaggccaggcttgtgtgtgggttcttgggcctctgggcagtggtgtggtgtgcataatggcataagcagtggtagcacaactcagtggaacaccaattcatgttggtgttggtgttgtcagtggctgcaacaggctggatgggcaagtcccttgacctgcagctggctcatatgggttagtgtctgcagtggtggtattggtaggttggataatcctgacctcagaccctggcagtagtgttcaagtgccagtgatggtgagctggtctggtaatccctaggcctttggaatgtgtgcttgggtactgttcagatgaaagctggtgagcagatttgtcatcaggacccctggtagtatgttcaggcactacgtatgataggcagaggcagaatactccccaggtcactagcagaatgctcaggttgggacagcagtggctgtgttatgagtctgcttctggggaggctggggccactctcattgggagcagcctaggaaggcagctgtggagctcatggtttgcttatgcactggtcctgcagtagcagcagtggtatttctccttgggacatgtgaaagttcctggccttccatctccctcctgtggcagctctggtagcagtggccccagggcagaatgcaggcctttgaagactaagctttctgaatggtaccagctatgggcctacaaccagggaaggtggggccactctcaatgacagcaacatagacaggcagctatgggacatacagttgcctcatatcttagtcccacaacagcccacagcagcagcagtggatttgttctttgggtgtatgaaatgtctggcttcccttatctctccctggactgactgtagcagtagcaccatcagctccagggcaggatgccgtccttttggaactgagctctcagaatggtgccatattgcagctgctcaaggctgagaagactgtgaaacccagcatgagctccctctcttaagcggtgcctctgcgcaatctgtaggcagctccctatgttagtttctaggctcgtgggtgccgaggggcttgctcttggctaagattgtgtaagtccatggcaggaatgtggagccctggggatcacacattttccctttccctgtgtctgggagcttcttccagctcccagtcaatcccaactgagaaggctgcctcatttccctttcattctttgactttgttgcttccaataatttctctgttgaatattggtgttctcttatagatgactcatttgaactatgaatatctacttgccattttggtgtcactttatggagaggcatataatagctgcatctagtcaaccctcttcccttatgacagccaaaatattattaattgaaatgccaactgtacttattaaagagcctagatctgtgatgagcagtgattcatgatttgccactgcaaacttgccatctatcaaaccttaactatagttaataattgaactttgttagcagcaagtcatgaatttagtcataaggactccaaagattatctgatatttgactatgtatactcaatctttagctggctttaaataacctgctttatgtttataggtgtcttccccaaagaagagagtttatcaaacaaaacataataatgctggtgatcttaatgcctctcccaatatgtttttctgatgccactacacatctagctagatttgactctttagtatgtagccaacattaatgactgttctaatacacacttgatttttatttcacagaatacaaaattcttgatttattggaaaagaatgataatgcctgtatccctgtatgagcacttgctctagccacggtcacagtgccatctgtctagggtctggggaatttaggcccattgatcatttggagaggttgaggagtaaaataaatagtacccagctctatcatcaagaggttagtgctcaggtctaccacttcactccatttttgataccagaatctctgctctcatcaccatcttctgacaagtttgaagtctggcaaccaaggagcaaaagtgggtggggcattattcaactaatggatccatgagataacttctttatcaatgcctgctttgttatacagcgaactctctgctaacactcataccatgagaaatgattttaacaaaaccctaaacttactccacactctaatgaaacagtttttgctagctagcatttattaagcgtatttttttaatcttactcacaataaataatttataccaacaattggtactcaaggaattttgaataccctccctccctaagctctccttaattggaacagaagggatatgaaggccagggacagtggctcatgcctgtaatcctagcactttgggaggccgaggtgggtggattgctttagccaaggagtttgagaccagcctggctaacatggcgaaaccccatctctactgaaaatgcaaaaattaaccaggcgtggtggcacatgtctgtaatcccagctacttgggaggctgaggctgcagaattgcttgaacccaggaggcggaggttgcagtgagctgagatcaagccaccgaattccagcctgggccacagaacaagactgtctcaaaaaaaaagggaaaagaagggatatgagattggaccagctgctctgttatatattacatattcacaaaccattttcttagccaccttcagttaatgtatttttaatttttatctttttaaattttagattcaggggatatatgtgcatgtttgttaagtggatataatgcataatggtgaggtttgggtttctagtataccaatcacccaaagagtgaacattgtacccaataggtaatttttcaaccctcatgctcctcccatactcccccttttcagaatcctcagtttctatcatttacatctttatgtccatgtgtactcatttgttagctcccctttaaaagttagaataagtgatttatgatttttatgtttctgagttatttcacttagaataatggcccccaactttactcatgtagctacagaaaacataatttcattcttttttatggttgcatagaattccatagtgtatatatgtttaatcctatcatccattgatgtgcacttaggttgatttcatgactttgctattgtggatagtgctgcaataaacatgtgagtatgggtgtcctttggatataataacttcttttcctttgggtagatagccagtagtgagattgctgggtcaaatagtagttctatttttagttatttgacacatcttcctactgttttccgtagaggttttactaatttacactcccatagtgtacaaacattctcttttctccacatccacaccaacatctgtggttttttgactttttaataatagccactctgactggtgtgatgtgttatcttattgtggttttaatttgcatttctctgatgattagtgatgtttaccttttattacatgtttattagccacttgtatgacttcttttgagaagtgtctgttcatatcctttgcccactgataatagtttggatgtatgtcccctctaaatttcatgttgaaatgccatccccaatgttggaaatggggcatagtgggaagtggttgagtcatggagacagatccctcatgaatggcttggtgcacacctcacagtaatgagtgagttctgtctctctctgagtttacacgagattgtttaaaagaatgtggcacctccccattctctctcttgttcactctgtcaccatgtggcatgctggctccccttcactttctgccatgattgttagctcactgaggccctcaccagaagcagatgccagcactatggttcatgtatacccagcagaaccacaagccaaataaaattgttttcttaataaattacccagtctcagtttttcctttatatcaatgcaaacagactaacacatgtactttttaatggggttgtttttgttattgttgttgagttttttgagtcctttgtagattctggagattaatcttttgtcggagtcataatttgcaattattttcttcaattctgtaggttgtcagtttactctgttaattttttgttgttatgcagaagctttttggtttaagtctcatttgtatatttttgtttttgttgcacttgtttttgaggtcttagtcataaattctttgcttaggccaaatgttcagagcagtctttcttaagttttcttttaggatttttatatttatttttatattttcaggtcttacatttaagtctttaatctacctcgagttaattcttgcatgtggtgagaggtatgggtccagtttcattcttctgcatatgactagcctgttttccagtgccatttattggatgatattgtttattatcattgtttctttctttccccattgtttatttttgctgacattggaaaatataagttggtcgtacatatgtggctttatttctgggttctctattctgtttaatagatctgtgtattttatttttgtatcagaaccatgcagttttagttactatagacttacagtataatttgcagtcaggtattgtgatgcctccagctttgttctttttgcttaagattgcttgggctatttggctctttttttttttttggttttgtatgaattttaagattgttttttcaaattctgtgaaaaatgacattagtaatttgatagaaattgcattgatactgtagattgctttggaagtatgatcattttaataatgttttcagttccaaaagcatggaatgtttttctatttgtttgtgtcatctgcaatttctttaatcagtattttatagttctccttgtggagctcttttaccttcttggttagatgtatgcctatatatatatatatatatgtatgcatatatatatatatacacacacacacacacacacatacacatacacacacacacacatatacacacacacacacacatatatatatatttgcatggcaattttaaatgagattgagttcctgtcttagttctcagcttgaatgttattgttgtatagaaatgtctctgattttttgtacattgatttttgtatcctgaaactctgctcaagtcatttatcaaagttaggagtcttttggaagagtcttagggtttctaggtataatatcatgtcagcagtgaacagagataaggaggatgatgatgaaattatcagaacgtagaaactgtatttttttatgattcagctccttgctgtgccctttagactagctggcaatggtagttttattggtaagtggaacctaaaggagaaaatcaaacagaaaattcactatcttgtaatgtctcagattttatctatagtacagaaaaggaacagagtcttgtgacaagggctgcattatcctggggaagtaagcagcaacttaatacaagaaaatgggctgaagggtaaactgtcttaatgattactgctgattatattgtaagcctatttgtattttatttttccctttaattttataaagtgttcttgggaacagttttagttttccctaggctcgatttctttttcaatcttgaggtgcaagaattaatatggtccaaatttggcaaagactgctctagatttttttcttggcaaggggcatagccatggtgtgagtcaggattagaggaatgaaattctcaggtagtaactctaaatatttgtgagtgcctagtcaggggtatagtatgaacaaatttggtatttttgtctattattttagtgtaacatttaattgaacagtgaactatgaggtaaattataagccctattaacagaattgtgaatccaaactttaagaccccttgtaaagtgaagtaaaaatcttggagtatctgtgagaaaagctcagaaaatcagtcagacagagggtgtgtagtaagaaatgttatagtcaggaatgaatgtacaatgtagtctaaataaattgtagacaaatagtaaaagtccaaatataatggacaaggctagaatctaaaaacaagtgtagtatactttttttttttttttttttttttttgagacggggtcttgctgtgtcacccaggctggagtgcagtggcgcaatcttggctcacttcaacctccacctccaggttcaagcgattctcctgcctcagcctcctgaatagctgggactataggtgcatgccaccatgcccagataatttttgtatttttagtagagatggggtttcatcatgttggccaggatggtcttgatctcttgacctcatcattcgcctgcttcagcctcaaaagtgctgggattacaggcatgagccaccgtgcccagcctatacttctgtgtaccacaattgtttccagtctctcacttttattaaagaaaaaataatagtaaaaaatttattggcaaagtaagttttaatctttttatacatggcctgattatttgcataaaatacagcaaaaatggtgattggccatataggctcttttaagttggctttgctgaaactttttaataaggaatctcaggttaaactttttaaaagtctcttcagattactcaagtcaatgatttatctatgcctgtagatacctgtatgaattgggtaaatttttctctttttgaagtatcagaataacttggtgtttctgggcctattagaaagtgacatttcttatttattacggttcagtaactttgtaaagaaattgcatagacaaggtacaaggccatttttaagggacttttatcaactttataagtcaactttaattttttaaagtagtctgatcatttctgaaaatatgtcattttagtcaaagccttggcaaaataaccggtatctctaattgtttcctattataaaagagaacagatttttattgaacttatgtaaataattaaattgccataaattaagaattctcacatatagtttttaaattctggaaaaattaggtagagagaaagaaatatgtttcaaattttgcttacaaataaacaattgcttatttgtaacaatttttattcaattgttaaaagctataaatatctcaaaagaaaaagattttctcccctctggaaaacaaaatgaaaaggatcagtaatcttttaagtaaaatttaaaaattattttagtcctccattggtttagtgttttgctggatgttgggttagcaatcctcatgaacacataagctttttaatgagagtgctagaagttttttatgagtccaatgttatgatttttaaaattattagaaacctatatttgagtcttttttacaaatttttttaaagaagtaaatttgtactgtagaagaatcaaagtaaaagctaacaattgtctatagatgacaaaagtcttagattagtcacagataaaggcataattgacaaggaaatttggttatttttgtgacacacaatttaacatgattatcataattattagtgataacataactaagacatttaagaattgaaccagaaagaaataaaaatcctgaacagacaaataacatataatgcaattaaaccattaattcataatcttccaagaaaaagaaaggcccaggagcggatggattcactgctaagttttaccaaatgtacaaagagctgacacaagtcttatgaaaactattcctaaaaatagaggactaaggattccttcctaactcatttaaaaaaaattattactctagtaccaaaatcaggcaaggacacaacaacaacaaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgcagggatccaaaaataattgaacatacacaaaccaataaatgtgatttaccacataaatagatttaaaagcaaaaatcatatgataatatcaatagatgtagaaaaagcatttgataaaatccaacatcccttcatgataaaaaccctcaaaatctaggcatcaaaaaaaaaaaactacctcaaaataataagagccatatatgacaaacccacagccaacatcatattgaatggggaaaagttgaaagcatttcccctaagaaatagaacaagatggggaatatccactctcaccactcctatttaacatagtactggaagtcctaaccaaatcacccaggcaagagaaagaaagtaaaggcatccagactggaaaacagaaaatcatttcctggaatttatccatttcctctaggctttctagtttgtttccatagagatgttcatagtagtctcatgatcttttacatttctgtggtatcagttgtatgtcacctttatcatttctgattatatttattagaatcttctttatttcttggttaatctagctagaagtctatcagttttgtttattctttcaaagaaccaacttttcatttcactgatcctttgtattatgttttttatttcagtctcatttatttctcctctgatcattattatctcttcttctgctagctttgggttttatttgttcttgttttttagttccttgaggtgcaacattaggtcatcaacttgagatccttctatcttttggatgtagacattcaatactaaaaattttttcatagcactgagcttgctctctcctataggttttggtatgttgtgtgtctctttgcatttgcattgaattttttttttatttctgcctcaattttgttgtttgtttgcccaaaagttattcaggagcaagttgtttagtttccatgtacttatacagttttgatagttcctcttggtattgatttccaattttattccactatgttcccagaagatacttgatgttattttgattttttgaacttattgagacttactttataggcaaatatgtaattatttttgaagaatgttctacgcacagataataaaaatgtatattctgaagttgttgggtataataatccttaaatgtctatcaggtccacctggtctagagttcagtttaagtccaaagtttctttgttgatttctgcctcattgataatgccgtcatgtaatgactggtgatagtgctgtcaatggggtgtcaaagtcccccactatttattattgtattgctgccagtgtctttttgtagggctagtgtaatagtatttgttttgtgaatacttcagtttttttgttttggagatggagtctcactctgtcacccaggctggagtgcagtggcaccatctcagctcactacaacctctgcctcctgggttcaagcgattctcctgcctcagcctcctgagtagctggaattataggtgtgcaccaccgcacccggctaatttttttgtatttttattagagatggggttttgccatgttggccaggctggacttgaactcctgacctcaagtgatccacctgcctcagcctcccgaagtgctgggattacaggtgtgagccaccgcgcctggccaaatacttcattttatgaatataatgctctggtgcatatgaatttatgatagttaaattttcttgttgcattgaatcctttattcattatatagtgtgcttctttgtcttttattactactgttggtttaatctctcttatgtaacataagaaaagctactcctgttcacttttgtttttcttttgtatgatacagctttttctaccactttactttaagactgtgtcattacccattatgtgagtgtcttgaagacggcagatagttgggtcttttgttttttgtaattcaattagccagtctatctatcttttaagtggagaatgtatgccaactatgttcaaagttaatatttatatgtgaaattttgttcctgtcataatattgttagctagttgctttgtagtctcaattgtgtaactgctttatagaatctgtgagatttgtacgtacatgtgtttttatgatggcaaggatcatccttttgtatccatgtttaggactcctttgagcttttcttgcagggctgttctagtgttgatgaattcccttagcatttgattatctgggaaagactttatttctccttcatttatgaaattacttgtgtcaggatataaaattcatggatggcatttttttaaagaactccacaaacagtgcccttatttctttgagcttatggggtttctgtttagaaatgcatacttattctgaaggtattttcttaataggtaatgtgatgcttctttctagctgcttttaagattttttctttcacattgaccttagatagtctgaagacgatatgctttggtgatgttcaacttgtatagtatcttccaagtgtcctctgaatttcttgtgtatgataacaacactcctagcaagatccgataaattttcctaagtttgcccatcaaatatgattttctttttcttcttctccctcaggaatgcttataagttataggtttgttcactttacataatccagtatttaggttttttttcctttttaaattttggtttttaaaatttttctcttactgaattaattcaaaagagcagttttcattttttaacttttaagttcagggttacatgtgcaggtttgttacacaggtaaacttgtatcatggtggtttgttttacagattatttgatcactcaggtattaagcctagtacccattaggtatttttcctgatcttctctctcctcccaccctccaccttccagtaggccccagtgtgttttgttcccctctatatgtccatgtattctcataatgtagctcccacttataagtgagaacatgtggtatttggttttctgttcctatgttactttgctaaagataatgacctccagcttaacacatatccctgtaaaggacataatcttgttctttgttattgttgggaacaggccccccaaaatctggccataaactggccccaaaagtggccataaacaaaatctctgcagcactgtgacatgttcttgatggccataacacccacactggaaggttgtgggtttaccggaatgagggcaaggaacacctggccgcccagggcagaaaaccacttaaaggcgttcttaaaccacaaacaatagcatgagagatctgtgccttaaggacatgctcctgctgcagataactagctcaacctatccctttattttggcccatctcttcgtttcccataagggatacttttagttgatctaatatctatagaaacaatgctaatgactggcttgctgttaataaatatgtgggtaaatttctgttcagggctctcaactctgaaggctgtgagacccctgattttccacttcacacctctatatttctgtgtgtgtgtctttaattcctctagtgccactgcgttagggtctccccgaccaagctggtctcggcatgttatggctgcatagtattccatggtatatatgtaccacattttctttatccagtttatcattgatgggcatttaggttgatgccatgtctttgctgtgtgagtagtactgcaatgaacatacatgtgcatgtgtctttataacagaatgatttctgttcctttgggtatatactcagtaatgggattgcttggtcaaatggtatttctttctctaagtctttgaggaatcaccacactgtcttccacaatggctgaactgttttacactcccatccaccatgagtaagtgttcctttctctccacaacctcaccagaatctgttattatttgacttttcaatcatagccattctgactggtgtgagatggtatctcttgtggatttgatttgcatttatctaatgatcagtgatgttgaactttttttcatatgttcgttagctgcatgtatgttttcttttgaaaagtgcctgttcatatccgttgctcattttttaatggagttctttgtttcttgcctgtaaatttaagtttcttgtagactcttgttattagacctttgtcagatgcagtttgcaaaaattttctcccattctgtaggttttctgttatctttgttgataattttcttttgctgtgcagaatctctttagtttaattagatcccatttgtcaactttttcattttgttgcaattgcttttggtgtcttcatcatgaaatctttgcctgtgcctatgtccttaatggtattgcctaggctctcttccttggattttatagttttgggttttacatttaagtctttaatgtatcttgaattaatttttgtatatactataaggaagggattcagtttcaatcttctgtatatgcctcaccagttatcctagcaccatttattgaataggaaaccttttccttattgcttgtttttgtcatgttttcaaagatcagatagttgtagctgttcagtcttatttcttggttcttgattctgttccactgctctatgtgtctattcttttaccagaaccatgctgttttggttaccatagccctgaagtatagtttgaaatctggtagcatgatgcctccagctttgttctttttgctttggatttccttgtcaatttgggctcttttttggttctatctgaattttaaaatagttttttttttctagttctttgaagaatgtcattggtagtatgataggaatagcatttaatttataaattgctttgggcagtatgaccattttaatgatattgattctttctatccatgatcatggaatgtttttccatttgtttgtgtcatctctgatttcttagagcagtgttttgtagttcttcatataaagatctttcacctccctaataagctgtattcctaggcattttattcattttgtggcaattgtgaatgggagtttgttcctgatttggctctttctttgactgttgttggtgtattggaatgatagtgaattttgcacattgattgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccctggccagaacttccaatactatgttgaataggcatagtgagagagggcatccttatattgtgccaattttcaaaaggaatgcttccagcttttgctcattcagtatgatgttggctgtgggtgtgtaatagatggattttattattttgaggtatgtgtcttcaatacctcgtttattggagagtttttagcatggatggatgttgagttttattgaaagccttttctgcatctgttgagataatcaagtttttgtctttagttctgtttatgtgataaatcacagtttcttaatttgtgtgtgttgaacttgcatgcatctcagggataatgctgacttgatcttggtggacaaacttcctgatgtgctgctagattgccagtatttgtttaggatttttgtatcaatattcatcagggatattggcctgaagttttgttttttgttttgttttgtttttgttattgtatccctgacaggctttgggatcaggatgatggtggcctcatagaatgaattaggggggagtccctcccctcagttttttggagtggtttcagtaggaatggcactagctcttctttgtacatctggtagaattcaggtgtgaatccgtctagttctgggatttttttggttagtaggttatttattgttgccttgatttcagagctcattattggtctgttcagggattcagtttcttcctggctcagtctcgggaagaggtatatgtccaggaatttatccatttcttctacattttctagtttatgtgcatagaggtgttcgtaatgttctctgatgtttctttgtatttctgtggggtcaatggtaatatcccccttttttgtttctgattgtgattatttgctcttctctcttttcatctttattagtctagctagcagtctatctatctattttattaattttttccaaaaaaacagctcctggttcattgatcttttgaatggtttttcatatctcaatctccttcagttcagctctgattctggttctttcttgtcttcagctagctttaggatttgtttgcccttgtttctctagttcttgtagttgtgatgtcaggttgttaacttgagatctttctttctaactttttgatgtgggtatttagtgctataaatttccctcttaacactgccttagctgtgtcccagagattctgatatgttgtatctttgttctcattagtctcaaagaacttcttgacttctatcttaatttcattatttacccaaaagtcattcaggagcaggttattcaatttccatgtaattgtatctttttgagcaaatttcttaatcttgatttctaatttgattgtgctatggtctgagagagtggttgctatgattacagttcttttgcattttctgaggagtgttttacttccaattatgtattttacagtatgtgccatgttgcaatgaaaagaatgtatatctgttgtttctgtgtggagagttatgtagatatctatcaggtacatttgatccagtgctgagttcagttcctgaatatctttgttaattttctgtctcaattatctgtctaatatcatcaatggggtattgatgtctcccactattactgtatgggagtctatgtctcattgaaggtccctaagaatgtgctttatgaatctgggtcctcctgtgttgggtgcatatatatttaggatagttagctcttcttgttgagtttaaccctttaccattatgtaatgcccttctgtgtcctttttgatctttgttggtttaaagtctgttttgtctaaaattaggattgcaactcctccttttgtctgttttccattttcttggtaggtttttctctatccctttattttgagcctatttgggtcactgcatgtgagacggatctattgaagacagaataccattgggtcttggctctttatccagcttgccactctatgtcttttaattagggcatttagtccatttacatttaaggttagtattggtatgtgtggatttgactctcattatggtgttagatgattattttgcagatttgtttatgtggttgctttatagtgtcactggtctgtgtacttaagtgtgtatttgtagtggctggtaacaatcttttctatccatctttaatgcttcctttaggtgcttttgtagggcaggtctggtggtaacaattccctcagcatttgcttgtctgaagaggatgttatttctcctttgcttatgaagcttagtttggccagatataaaattctggtttggaaattcttttttttttaagaatgttgaatattggcccccattctcttctggcttgtagagtttcagctgagatgtccattattagtcaggggcttctctttgtaggtgatgtggactttccctccagctgcctttaacattttgtttttttattttgaccttggagcatatgaagattatatgtcttggggatgatcttcttgtggagtgtcttactgaggttctctgcgtttcctgaatttaagtgttgccctgtctagctaggttgaggaaatcctcatggatgatatcctgaaatatgttttcccaattggtttcattctccccatctctttcaggtacaccaagacattgtacatttggtctatttacataatcccatatgtctcagaggttttgttcattccttttcattctttttttctctagtcttctctacctgtcttatttaagaaagccaggcttcaagctttgagattctttactccacttggcctattctgctattaatacttttgtaattgcattatgaaattcttgtttttaagttctgtcagggtggctatgttcttctctatactggtcattttgtctgtcatctcccataatgttttatcattatttttagcttcctcgcactgggttacaatgtactcctatagctcagtgtacttcctttccattcaaattctaaattctacttctgtcatttcagccatctcagcctcagcctggctttaaaccctctctgaagaggtgatgcaatcatttggagaaaagaaggtactctgactttttgagtttttagtattcttgtgctgattctttctcatgtttgtgggcctatctaccttcaatctttgaggttgctgacctttggataggttttttttttcttttatcctatttgatgaccatgagggtttgattgtgttataaggtggagtcagctgactagcttcatttctgggagattttagggggccaacactcagctctcaacctttggactgtgtactataattctgggggacttctattgggccccaactttgttctctggtttgaaccttgaggtttggagttcactttgccgggggaaccaaagtgtggcagctgcagcaaagtgcaagtggatacaggggttcctacctccctgagagcattcaccacagtggtagaggcaaggcagcagctgggacagcaggttgtggggtgtcctgctggagactgtgctgttgcactagaggtgatgttggctggtttattttttgttggttttcaactttctcttggatctcattgagcttccttatagtctatatttctaattttttatctgtcattttcaaattttcattctattgaggatccattgccatagaagtagtgtgatcttttggaggtgtcaaagcactctttttacactgctggagttactgagctgattccttctcttctaaagaaaccgtcattttctttctttctttttttttttttgaaattgctattgtttgcaagggactttatatttattttttcctcccttgaaggtgtgactgtagtacatattttgtatgatcatttggcttctgggtgcttttagacaaccgaggctctgtatgaattcattggttatagatagcttttgtgtggtggctttctcaaattctgcttgttgtagctatacattgggcatatgagccaattcactctcttctaggaggccaggaatacagggatctcaggtagctgatgtcctccctagcactgtgtccttctgtcagccactttttgttttgttttggtttttgttttgtttttggtgaagtttggtctccagtaggtggtgccagagccagtttccctttggatattgagatgatgtgtggaagcacctgccctaatgaagctcatggagggagtttgtggtgggatgcactgaggtttccagggtggtaaagagagggctgcaccagctccccatcctgggaagtcaggaatatgatccacttccatatcatgcccctatctcagggttcatggccttcagttcagatagtcactgtcctttatctccaggccacaatgcaacttaggtctgtgagaaatgcctgtctggtggctactgatgaaatgacctttcagcagaacctcttcccccaacaccaaacagatgactctgcagttagttggtttacactgttttgcagtgatgctgccactctgtgtagaaaggcagaaattagccccgttctatgtacaagcctaagcagtgggcacaccttcactgaggacacagctatcccaaaaaatgctggaaggaggacacttacggcaacctccaacaggaaaggccttggctacctctgcagcagtgtacgggacagtgggagatccatttctggccactagggtcacctatccactagggcagaacagtgccccctttggagatcagcactgttacctgcatttcctctgttccgaggagcgctttggcagtctgcattccccctctctccctctctctagggtcagcacactcgaaggactatacctctagggatcccacagctccccagggacctgatggacctctgtagttgccaaagtcaccgtgggttttgaggttccctgggtaggttaatgacccataacagatacacaaacagtgtggtccctgccacctgagtctgagtttggtgtgagtgtgagcacacatggaggaaatggctgcctcgtgctgtgcctgctggaagttcccaaattgccaccaacaaacagcattgttctgggttgattgataggggaaccccgacagtttggctgttagtagtctgtcacacaggtgagaggagcaagagatccccctattgtaaccttttgtcaggactctaacttcctctggggtcaatctctgccagattctggctgccttccttttctgcatcccaacttctttgtatgggttctccaacaggtttcagcacactttcctcagttccacttgggtcatgattattcacctgcaaatttgatcttctttctgaggagaaatggcatccaacatctctagtcaactgtctggggaaaaaaactaatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaatgatgacaggaagaaaaccaacaaagctacctgcgaatatttcattacataattttaaacaacttaactatagataaaattgttttcagtaaacaaaatactttaaaaaaaaacaggtaagtcaaatcaaacatttactttagtgaaattgaaattattatttacctacctaagtgtcatctttaagaaaatgaaaatcaccataaatatttgtcaatgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttaggggatgcacatggtgtaataagttggaaatgtttaaaaaaagtgggttcacattatggaagacattcttgaacatccagagaaatagttgggcgaaaggtactataatgaaagctgttttaaaaacactacaagagtaactcatgcatgaggaaagaataaaaaatgaatgctgttgaagcaagaaagtagctactgcattcagcctgatgggtagtggagaaggttaaaccaatatgatactgtattaaaaaaaaaaaagaaggaattggaaaaatatgagagaattctaatgaaataattgcacggatgaatgcttctgagcccatcacatcctagtcacaattcctggtttcatttattttgtttcactgtttttcaatagcaagagaggaattaacagctaactgaggcaagcatcagcacagaggcagggagcattaggggtggagcagtcagggaacaggaagactgcagtgtcatcttgagtgacaccaaagaatatagccccataccacctatttcctccatctgttaacaacatttctcaaaaccagggctactgtcaaatttataaatactgttatttctaaatgtatttaactgatttaaatatgtttgctactgctggttcccttataatctccatttataatatttaaaaggttctgtgttggcattcagatggaagaaaaagcatgagaaatttcatcttgaatatgaggttatctaaggaaagaattcggttagcttcaggtgaatttattcttcccccctccagccccatcttttttatttatttatttatttatttatttatttatttatttatttattttgaaacaaggtcttgctctgtcactcaagctggagtgcagtggcacaataacagctccctgcaaccttgaactgccaggctcaggtgatcctcccacctcagtactctgagtgtctgggactacaggcgtgcgccatcatgcctggctaatttttaatttttttgtagagttggggtctcactatgttgtccaggctagtctcaaactcctagactcaagcaatcctttcactttggcctcccaaagtgttgggattacaagcatgagccactgcacctggcccttctttttctttttaccaaattatgcgtaagtatttccctgattggtttggggtgtttcgatttagtttaaaatagaaatatatgttttaaagtagtgcagacctctagcttttaatccagtgacagcagtaaataaaatgagatttgagaatatgctgtcattgatctgccctagcttcttttgttcatgaaggattaatagagaagaggtgatttttcagtcttctgtataacaacttctttggttcaatattacaggagccttgggtcactgtggtgaccatgttccctttgaccttttactttttgggttttttttttttttagattttctttgcaatttatgaacctcaagtgtcttaataagtaagtgcctctgtaggtagcctattgtgcagagttgcaataaaggaaaacactactagaaatgcaacacagcactaatcccattaacaaatgcagccagtgtcagagataccataagaggcaatttgactgagatgggaggacatcccacatcgtttatgggctgttgaacaagagactttcttagcctcatcagcaggttagctgcatatgaatcctcatttttatttagggacagagccccttgcttataatgctattggtcaaaaatgagcagtttttactgttgcctgcaacgttgctagcaccttatttggggctctttttataaggacccgcgatgaaagttgtagatggtaactgtgaagaaatctcccctccctatacccaccttttcaggctctgagatttgaataaaataacttttatagaaaatattttctatattaaattctataactctaatccaaatttgtagatcctcaatcttaaataaataagcgtagttttcttcaattttttatctaggatattttgtctcaagatcctatcaatgttacataatataaatcctcatattctcaccctgacccactaacttaacaagcagctgatatactgcccccatcttggccattctcacggattctataatacttctacagccacatctgctgtttccagctctccactaaatcatcaatgggcctaattttgccagaccctaggcccttagcactgtgatccaaataagttaataagaaatctctaattattggactagtagcaaaacttcatgcaatgggcttgggctgataatgcaacacaaacagtaacatccccttgttagaaacatcccaggttgccgtgcctgctgctgattcctgaatgcaaattgcaggtatgtttgggctctagaaaattagaaccagaaccccattagacaaaatcaggtatcaactcctgatttcacagttgagaaaaccacatccaagagtgttcaattttctgaccaaggtcacacagagactttgtgtcaacataaggccaagaatttaagtcttctgacttccggcctaatgttctttccacttcattttactgccactaagtccaagtcattaacattaacataaaaataatttgagcacatactccattgaaaacagactacattaaaatatcaaagatgtgaactgaaacatcagtctcccaaatggagtgagcacaaccttggatcgttctcacgttttagagagatgcctgtcagtcacttaagacccttaagattcccgaacccatgttaataaatttctagaatactttggatgctttagactacaaacatactagtaattactgctaaaaataatgtaaaaaatggaagctttattagttcacaaaacaataggccagaggtggtgaaagtccagagttagttaattcatcagtttaacaatgtcagggttctggttctctgtgattgtatcagctttcctttcctgatgccactatattcccaggcattagacacaaccatgggcaggggaaaaagtggctaatgcctgcctgtggcccttttctcagagttgagaaaaatttttccagtcaccttccccagtatattacagctcattagtcagaactgcatcacatgtccttgcctaaaccgatcgtggtctagaaaatggaattaccacaatttttttagagtaatcaacattcttgtgaatcagaaagccttcaagtatcttgacaaaatcagaattctgttggcaaaaaagaattaggatgtatgtaagggaggatggtgattgattcatataattgtgctatatttcttaattaccaggcatatggttctttttaaagatagttatgatgtaagatatcaggatcctggattcatcagcatctaacaagttactacttctggtggccaaatctggaagcgtctgttgcatgcaataacatggcacctgggaatatgcacttctgtgcccattatgactgatatgcgatacttggaagaatcattattctactcacagaaggaggaaacccagcaaatgttagagaacaagacttttaacgtaagcagtagtggaagatctgatttactcaccccagcccctttcccagatgtacttgaataaaagagtgagagtgaattcttttttttttttttttttttttttttgagacagggtctcgctctgttgcccaggctggagtgcagtggtgcgatctcagctcgctgcaacctccgcctcctggattcaagcaattctcctgcctcagcctcccgagtagctaggattgcaggtgtgcaccaccatgcctggctagttttttgtagagagatggggtctcaccatgttggccaggctggtctcgaactcctggcctcaagtgatccacccaccttgacctcccaaagtgctgggatgacaggcatgagccaccgcgcccagcccagagagtggactctttaacaatcaggctttatagtgcttcaaaatttagaccaggcctaagcaacagggtagtagggtaaggttgcaagtgggcaagcagaggtaacaacaggcaccttgtcttccaaacacacggagtagactaacttggctctagccgacagctcctgacagaggtgttgccagaacccgagctgaagtagaggcaagcctggagtgaggatctagataagttatgagcaactaaaagatgctacccttttccagctttctttcataaaaatcttactttttacgttatttcttctaaagctttctcattatgctgctagaaacccttctaaagatatattaccttaataaactagtgaaacaatgccagttttgaaaatgtgatcaggctgagaacccccttctccttctccccacttatgcttcaaagaagtggagaaaaggactgctctacctatggagtagccattctttattctttcctttcctaataaacttgcacacacacacaccacacacacacacacacacacacaagaagtgtagaaaagatctgaaaggtcaggttgtgtttagattctgaagggtttcctagtgctaggccaaattatttgtagtctatataatgcactaagagacgcagagaggaggtatgtacagagtagggaaagaatgaaaccagggtttcagagacattaatgtggttgggctgtgtgggagagaagagcagaagagaagagactagggcagaataaaataaagaagtgataaaatcccaaaccagggaaataactgaggcagaaagatccactggaaaaaaaaaaaaaaaactataataggaattaatgaaggactatctatggtaatctaggtgaaagtcatggtagaagttgactctagtggccaaggctgggtgacagagacaatgacagaaatgaagattatttttttaaaggagcatcagtggttttgttttcctgaccacaatattttcttgaagaaaaagatggcattcttctcttcctcacatctcatatttgtaaccccagaatatctcatacaatgcctggaacacaatatatgctcattaatattattgaagaaataggagcttgatttgtcatttagttgctgtcaatatgtctctgatactgtgatactgcagtggtaaattaacaatgaaaactaattttgtcaagcatttttcaggatatgcttttcaaatagctgccttcatctatagcatagagcatttctctactgcctcacatcttaaaatgttactctagcaccatctctagtgcgacaaaattacacacaggatacaagctcaggtgaaatcgttctgtcaatttcagtaagcttatacttattttctagactcctctgtgttctagcccctaccaaacagtccagcttcatctcttgctacttcaccttatcgctaaccctaaattcttctatctagccacagtgactcttctgatttctcaatgccatgctgttttctttgggtccttagttataggtagccacctttgcctggaaatgtttactccacttttacctttatgtggcacagtcctgctctttttaagcttttagctcagttacttccttccagaacttcttgtactcctacatatggggtaagggcctcccttgctcccatgatactctagcctttcttcacatagcatgtaccatactatttaattgcctgtttgtctacattcctcctgtatgaaccatattcttgtaagccccaagcatatatcctggttgtattagtccattttcatactgctataaagaactgcacaagactgtaatttacaaaagaggtttaattgactctcagttcagcatggctgggaaggcctcaggaaacttacttacaatcatggcagaaggtgaaggggaagcaagacaccttcttcacagtgcagtaggaaggagaagggctgtgcaaagggggcagggcgccttataaaaccatcagatctcttgagaactcactcattatcaggagaacagcatgggggaaactgcacccatgattcaattacctccacctggtctctcccttgacacatgaagattatgtggatgacaattcaagatgagatttgggtggggaggcaaagcctaaccatatcacttgtacttagcagttgctcaataaacattgtgaaataagtattgtgaagtaaacactacgaaattaattaatgaagaaaataaatgtaaagtatgttggttggcaaagttagaagtatttgttaaaaagtccattaatgatcttgtagaatcacgtaaacatgttgatatattagtataaatatattgcctacagattggcatacagtacagtgaaagtactacagtaagctgtacttggtctattttatgctccctttttcttcccaggaaaaaagagaagaataagataatggctatcagagaaagaataattggaacaccttagtcttaaataggtttgtttgacaagagtatgattaaaataatttcacatatagagtttaataaagcaatgacaaaagaaggaaaaatatcttcatatagccaaagagaacaaggaatttgcaaaattcatgaatagacatgaatagatgagaataaatgatgattggatatttaactattttggccactgaagatattagtaggcatttgcatagaaggcaaagcaaacattctttgctgatgttaatattcaggtttacaaatcactgtggtaagcacagttctgcccaggaacacaaagtgtgcgttcaacctacacagttgaaggcagtggctctggttctgccctatttactaggccacaattgctctattccccaaattgttctaatttacttaaagttactatatagtcaaaagggaatttcttgaattgtaacatttaattattttagacccgagatttttattttagtgtacagaaatactagtttagattccaataagtctgggacataatttcctttgtttactagactataatttgtgcttattagactggtatattattgaaatcaaataaacactgtaaatgaactctgtattttgtaaataataaaatattgataagaaaattcaaaacagtttcaaagtcattaataggtatattgcccaaataactccacttgtccttaaggttaaacctgtgttttgttgagaaagcctgctatacccccaatctgaattagctgctttgttttgtgcttctacaatactttgtacatacattattgttttagtcttccttattaatagataacttttaagtttcaaaagttacacctgcatttctgaaacaaatgaaaacatagttgtatgaaaagagataattttgtggattttcctccacatgtttctctgtcttggacatatttctatccatgctgttagcacactgacttaaaattgtttgttttagatccccctcttccattgaatctcacctcacccctggctgcaagttagaatcaccaaggacatttttcaagacactcaaatataccaacatttcctccctaaattctgatttcaatggtctgaatgaggtgaaaaccaggtgttacatttttaaaaccaccccaggtgttcttgctacttggtttatctctgtattccccatgttttattcttcctcttcttgaagtctcataagaaaatggtacctatagttgttaaataaattgattgtttttaaagagataaaattgccttaattggactagagaataccaaatctatttctaatttgcatacagaaatgcctcaccttaggcaaaaaaaaaaaaggcatcagaaaaattgaaagcaaaatgtattgccaaaaaataaattacattttcttatagaatttatataaagttggggtatattttagatggaaacatttggctctaacaagttaaattataagttttgaatatttcaagtataattaaattatggttcaaaattaacctgcacactcatctaccaccagaaaaatactagccattatttataaaaatcaaaattactcagtgatagttacttctccagggaagaaggtgagtcggtaataagctatgcccccataaccttacaatcacgctgggaagcagcagccagtagccaaactgcatcctggtggcactgactgatccttctgggaaccaagcccatgaccctagttttgtttcaaactcaaacacagaggatccctgcaaatccggttactcactgatgtgagaattcattttttcaaataaactgaaagctatggagtcttttttgggcactctagtccattacttttagctctttcatctaaaggaatttattctgcactttgttgcttattctctactgctgtttcttgattatttgctgaaaggtacctatcctgttgaggatggctgttgatattgcgtatttagtatttgtcctacggtttttatcctaatataaaaagcctgttctttcttctgtgctctccccgtctctctacctccgctgagcttcagattgcttttaaagggtgacctggcacacttctgtgtgcatgcactggtattacaaaacacaccttcccatttacttgtgagattaaatatatatatatatttatttatttatttatttatttaaagggattatgcttatatttaagaaaagaatttatgtctatataaaggaatatccatatcaagtattaggtcatatttatctcaagatgggaaataggacatattttaactacatgggtgagtagagaaataagtagtttaaactgctgttgtttgacttcccaagctggccacccctaagtgtattaaatcaaggatttttctcagcctagaaagttaaatagcaggtgtagtacttaatgaactgcagcgagttggacttattggtgtggcaaatagattgcgatatttctttccaattaaagttcttttgcaaagatcaatgaagcacattttcacaaattgaattacactaaactaataaacaaaattctcccattcccactgatggcaaattattgtttccttaacatttaaaatcccatcacaccattaattataaaatgcaagggctaggaaagatcaaatatttatttgctcatgtgtttctattttacttccaattttataagaaaggtaagaaacattatatgtaaagaaagctgcataagaataattttccaaacttgaatttttttggtctttgatccataagcactttttatttactaaataacatgcatgtcctaatgattaaaaggtctgatctttagtaaattagaaaagaatctgctatagagtaacctttaattaatgaatgcatggaacacatttacatcagaaacaatgggcttgatagaaaaatgaaaatagcttaggactttgcctctagaatcagtgagctgcttcagaaaaattaaaatattagtttagcaaccttaaatgtcattactttactcaaataatgcataaatgttatgatattcattttctaggacctcctcacccttcacctccccttgatatttcttttcaagtatactttggaagaaagtttatacttttatgtagttttcattttaaagtttttagtatttcaatattgatgcaggataacgaaaatggagtaacctcagaagcaaagaataaagctttaataggaacttctgttttcaaaccacaaaaggcaatatttggtgaagatgcacatgcaagatttcctctctaagaatatcctaggacttaagaagactttcccacaccgtggtctactacttcaaaattttcccagttgctcatgagaggatctgtattttgtgaacattcctagcatgatgaagagcctatcaaatagtattcccaagcctagtggcattttggtgacttgccaacccacgtctgtgtagcatctccaaagagatccagcataaagggaaaaaaaatagaaagaaaaatgtaaagaaaagtttctgatattccatcccaccccctcctttctcctcctctactaactccatgtttctctttagtggctcatctatgcagacgacttttggatttttatgggtcatttgatttaatttaaacagaaaatatgctgtgggtgtttgtcaaatttattttgcaaataaacaaacatacacacaggcatgctcaaaggcatgtcatttgtgacatacagttgcacacagaatgtcaaatgcatgtcataaatgaccatctgctaccattttatgcaggaaatgacattttaataccaaaaatagtagaaaacccataatatcagaaaaaatatttctttaaatgaaataagtttagcttcccaaacttacttatttttctcatttcttcatacaatggtgatgtttgtcataaatcaacataagcccacaatccagcttttgagaactacaataccaaatgccgtggctcaaccctttgtactaactagaaaggatctgaattatttctcaaagcataatatgcctactacttaccagggatcttgttaaatggacgtgctggtttggtaggtctaggagttgcctgagactccttatttaacaagctaccagatggcactgaggatgctcatctgtggaccaaacttttagtatcaaggaacaaaactgttttcttcccagtgttaatagctagcctgtcagccaaggcattattctttttagaacttttaagtatgtgtgttgggggttagtgggttggttattataatgagaagccttaaaaacccaaataatttaatctgtaaaaatgatgtaatggggcatcatttggagggataatatcttcttaatctagtaacctaaaccagaccaaacttaatttgtttacaaattatcttgggtcaaatcatgccacattaagtatcattattcttattctagttggcaatatcctcaccaacatttgtttctgattaaagcttctttaaattatttccagactattccttattattgattagctttttttttttacatgtattccagttacagatgaagcatagtattcgtatgacatccaatactttttcactggttagcatactgagataaaaagcagaaaaggaaatagagatattgattttaaaggaaaagtaacttccatttttgtagtattttatgatttccaaagggttaaccacaattaaactgccctccatgagcataggaatcatgcctgtttctccaaaactagccctagcacacaagaccagtgcctggccaataatataataggtatagtggattgaatagccccttccatcctataatgtgtcaatgtcattttatctgtatatagtggattgaatagcccctcccatcctataatgtgtcagtgtcattttatctgtaaaaagcatctttttagatgtagttaaggatcttgagatgggatcatcctggattacccaggtgggctctaagtctaataaaaagtaaccttatatgagacagaaaaggagacaaaacagaacagaagaggaggcaatgtggaagttgaagcagatactggagtgatgcagccaaagccaaggaaggctgcagccactagaggatggacgaggctaggaatagaatctcccctagagcctctgaagggagcatggccctgctgacaccttgattttggacttctaaccttcagaactgggagagaagcaatttgtgttgttttaagccatcaagtttgtgaaaatgtatcatggcagccacaggtaactaataacagtaaaaaagccaatattcatggaatgactgaacagctgaagtaggacagatatgagaaatcataataagaagagagaaattcagagtggcagagtaagttgcctaagtttgctcagccccagcatgatagaggtatttgtcaaatatctttttttaaaaagtcacagtacttccggccgggcgcggtggctcacgcctgtaatcctagcactttgggaggccgaggcaggcggatcacgagatcaggagatcgaggccatcctggctaacacggtgaaaccctgtctctactaaaaatacaaaaaattacccgggcgtggtggcgggcgcctgtggtcccagctacttgggaggctgaggcaggagaatggtgtgaacccaggaggcagagcttgcagtgagccgagattgcaccactgcgctccagcctgggcgacagagtgagactaagtctcaaaaaaaaaaaaaaaaaaaaaaaaagtcactagtattctgtatactagtgttggtctactaaaacttataaaatctgactagtttttaaactcttacaagccatccacagaagacaaaatgttagataaaataagattgtgaatatctttctctagagtaaaattaagcatttttataaatacctttcagcatccagtttttaagaagtttaagaattataaaatgttcacattataatcaaactggaccatgtttgtgagacatcagtgctcctgatcgtttaaacaatgagttagtccaattgcatgataaaaagaggaagtagttaagaataaaggtgaggcaggaaatttttgtcagaagacagacaaggatttgaatcatggctctaccatccaggtgcagtgagactttggccaagttacttaacctctctgtgcctcagtttcccaggaataaaaattataattcttttgggacatgtaaagattaaatgagaccacatttcaaggctcagactctggcatattgtggccattactatctagcaacaagcacacagtagaatttgatcagcatttgttgagtgtatttattcaaacctgcagttggactataataaactaagataatttaactgccttttggttgctcgagtcatctcagggcaatagtatactttttaagtgcaattcaaactattaacttagctacatgaagtcatataatgtgcagattctagatatcaaattttttttttttttgcatcctctcttgggtcatgagactttcaaaggactaccattaagagatcctgcatttgagaataagaagaaaaactttggtatagattcttttttattcaaatgcccattattctgaaattgatttactcttcctgatggaaaagtataaaatttgttggcctgcaggggaatttgcaaaaggcctatctggttaataagtcacttatctaattgatactagagtatcagcagggtgggttatgaaatcatgaaacaaatgatctgacagtcaattaattctgtttcatctttgtgtatgttcctagaggctctatgataggatccagtttataaataaaaaataaagagatgctttttgtctaggttaaacttgatttcattctgaacttatattgtacagttgttcatgagcatgagttaattgacaatgtttagcagtctttttttttttttccttttttgagatggagtctcactctgtcgcctaggctggaatgcagtggtgcgatcttggctcactgcaacctctgcctcctgggttcaagtgattcccctgcctcagtctcccaagtagctggggctacaggcacctgccaccatgcccagctaatcttttgtgtatgtattttttatagagatggggtttcgctctgttggccaggtcggtctcgaacttctgacctcaagtgatccacccgcctcggcctcccaaagtgttgggattacaggcgtgagccaccatgcccaacgtgtttagcagtctttgagaaaattttggttgaaggacattgtgttggatccaagtatactttggacacctgagctcccgcaatttccttgcatgagctactgaaagatagaaattacacacttgggcagtgcaattggattgaaatggatttaaatctcgtatctcaaattctatctatctttaaatctattattttataaaattatatagttcaaaatgcacatgagaaaaaagtgtctattaatctgacaattttcaatttatcttttgatgatgttattaaaactatccaaatctacttttggttgacatattctcttctaacttcttcatgaaagcttcaattcatgtacatgtgataataataataaaagttaacattcattgactacttattaggttctaggcacgggggaaggcactttatgtatcatttatttagtgtatgtggtttttttaaagcttggagtgactgttcaggaaactagcctaaatttttcattatatacataagaaaactgaggcacagagaagctaagttacttgattagccgaggatacaaagatggttagaatgtaactttgtagcatcatatctttgtgacaaaaagaacaatagccaatctgtgacgcaaaaacaaaggcggtttctcattccattctgtgcaaggcagagctgctcagagaacaaagctgtctttgaagctggggatggctccatctcaaatcagctctgtggggtgcagagtatgacaagatgcagccaacacagcagaaaatcaagttcaaaacactcaagttatttacaatcctttggtgccaaaccttaaagaaagaattcttattatgttttatgtatgtttctaacttgtcttcattagcttccctttgatatttttggcaaatcagtttaaccttcaaaagtcttcatttattctacttgattaaatcaaacaaatgaatagataacatagaatcaaatagcagtattgtctgttctgagaaagcaacagcacaaagaggtaaagaaaatgcaaattgaagctagatgattgtatacattactttattgaatgtcttaaatctgctcagatttggatggtggggaaagaaatacaaatgtttctagaatctacagttgaatatttgaactgctgggcatggaaggtttaaaaacaaaagctagttagaaaaaaagattgaaaaggtaagtttcagactctggcatttttgtcttttttaagttagtttctgttgaagccctaccttcaggattttcttcccaagtactttccctagagtatataaatcaatgcaacagtaccctgtaatagtatcttaacctggagaaatatcacaagactataaaaaaatgcttttagcaaaggtgtcaactttgcccctatatcatcgatgaaatgtcagcttgaaagtctaggtatgttggaaccattagagagaaaaagaagggaagacagattaaagaggccagaaagtaggcaatttaaaatgaaaagtttaggctgggtgcggtggctcatgcttgtaatccctgcactttggggggccatggcaggtggatcacctgaggtcaggagttcaagaccaacctggccaacatgatgaaaccctatctctaccaaaaatagaaaaaaaaaaaaaaagtagctgggtttggtggcgggtgcctgtaattccagctactttggaggctgaggcaggagaatagcttgaacccgggaggtggaggtggcagtgagccgagatcacgccattgcactccagcctgggtgacaagagtgaaactctgtctcaaaaaaaaaaaaaggaaaagaaataaagaaaattgtatggcacggcacaaacacagctagaacttttagctccataggaatagaattgaagaagttgaagataaattaggaaatggaaatgttgcaggaaaatgaaagggcactgttttacttcaggttccccaagaaatactctgagatgaagatctgcatccaggagtcttattagaaagtgctcttgggaacacctgtaagagaatgagagaaacagaattgtacagaaggagaagttacaatgcagtggcaacagaagctcagttgatcctacggaacatctggagctgggatggctcttcatatttgtctcaaatcaaagaaagggtttgaaactttgacccctacatcaacaagtcattctctgctagctggccttaggaaagggacaaactcttgagcaaggtaacttctttcagctgagggctattcctgacgatagacccaggtgggggccaaaaggagccaacactttctcagctgggagaatgaatgttgtggtgccaaatgagggatcaagtggggtatcacagcatccattagggctcaaccctgtgcttctcagatctccttacttcatgcagtcaattcatatcatctgggagcagcacctcaaagaaagattttggttagtctttgtcctgaagaaacttacaggagaaagtttcttttagacagactgtagccccatgtagcagttgttcctgaggttactcattgattctcttcttaactttcattctgtatttccatcaccctgggctatcatctatgtaggtctggtgaagtgacccaaatcctaattcctggggctccggcaactggtctctatgcccttttcaggctacagtagcattgcttgttcatttactgtcaaaattgggcagagggagaaccatggaatggcaaagtggatcacctgggtcccaaacatactttttgctgtttgcttctatagcaaacataggtaggtaggtagatgcctagctcttcctgatcatcaaggtcagttactccagccagggtaatgactcctctgcttttcttctgggccgttggcatgatgagcctgaagtgaccaggtggcaatcacagcttaaagtttaatggaactcttactgtgtacccagttgaagtgttttcccctgagaatacatccacattacttaaagttacagagacagaaaggaaaaattctgcaatcgggcccttgggaagtacgtaaagctacttctacttctatcatttggtctctggatttatatattcctatccactgggaacaaagcaccatataatagtcattggtttagagtgtagattgaatgctggagaatggtaccccgtccaagcaaaatattctctctaatctggcctcctcaaaaggccatcccagagctttctcaggtagacagccttggcatcatcttgagcacatttctacatctgcttttctgtgaagaaggtctctaggtctgagattatcttaggtgttatgctatgccatttgaataaacactctgtaagccttctgataatggagctggctaaagctttgtgtgcagaaaatgcagacccatacctggaaaatgtatctatttcagataagaagaaaggctacttctgccaggatagaaagtgtctaataaaacaattttgggatgggcacagtggctcatgcctttaatcccagcactttgggaggctgaggtgggcagatcactcgaggtcaggagttcaagatcagcatggccaacatggtgaaatcccacctctgctaaaaatacaaaaattaactgggcatggtggcatgctcctgtgagcccagctagttgggaggctgaagcacaagaatcacttgaacctgggaggtggaggttgcagtgagccaagatcacaccactgcactccagcctggtcaacagagtgagactctgcctcacaaaaaaacaaacaaaaaaaccattttgtcacaatgttgctttgtggaattctttgaagaatttttctgtatcagtgacccaacgttggtttcttttaatggtatgttgtgctgttttgtccacacacagctctgttcctggcaccacagctactggggtggctgatggaagatactggctgttgtcaaacggctaagtcaatctgtctattgacttgttggtacctctttgatggtagatgctctcttgaagacattagcatgtaatttacaacacagtggttccatatccattacatgaggctatgttcctctgttctatcagaggtaccacatctgatacctcagaagcattagggaaaatattttttggtgttttcagtgctacaccataatgaatcaatatctgtctcatttttgaagtgatcagattagttagttaaatggggatattatggagactaccacgctccatctttttatctttttaagggtgactctaatctccaaaaatcaccccctcctcacatttgatttttcccattatatagttcagaggctaaggaactaatataggggttctgtcacctaccaggtagctgaaaatgatcactagatacgtccatggccacatgtaacctggaatggggataggagttccttaattaccttgcctttatatgcccatttgcctcaattttaacaaagaaagttatgatgtgatgctttagtctcgagatatcaatgtcagcaattctcaaatggtttaaatatttcttttttcccattatcggaggaaatggctgtaggacccttttaagagaggaccaagtgaatgactactgtataccccttccatgatgttgcaaaatctttctacaagggaatcatgcctttccttttaaaatatcatagatctgagaattgactcaagtctggttagttagaaaagagatcttggctttttattggtgcttctgagttcagcttctcgattatatatgcttgatttccttggattacatagattgagcaatactctagttggctatctatcttgcacctagcaaagctatgttttaatcactttctccttaatgttctgcatgtcatgccaccctggctacccactctaatctttccactcgttaacttaattgtgcccaccttgcatctgacagtctaatatcatcacccactttctactttggaattcgatcatcctccttgcttactgaaaactcagttctgtaactatctatcttactgtcagtgctggcctagaaaggacagctgccactaccttcccagtgtcattggtgtccctctcaccggaacatttctcaacactttgatgaatggaataccctgtgggctcttccagagaacataatcaggagatagatttcctgtgcttaggtaacataccactctgccatccccacactgagacttggaggtcagactgggtattggagctccagagaaggtggaatcctcagtctttagaaaattggctacaccaaattcagggctttgaatgggaagaaaaaatgagacccaaagaattgagatggaaacaactgagtcaaagcacttataaattctaaatctccagatttcaccatgtactgcggcagtggcatttgtgagtatttattgtaggttattgctttttactcagtcttccaagaataatcctagtagtatattattccattcttccagggctattgccaggttgttaatcctttattacaggagagtgctcccatataggtaatctctcccatatccaatatgtcccatgccccttgacccagcaccctcagaaagcagccatttatataatcctgtagggctgagggatacatgtcagttacatcatctatctccttcggcatgcagttcctcttctaacagattcagcacttctctaggttgatcacgctctgatttaactctggtattggccaggttgccaggaggggagctatagatagatcctgaggggggcacatattgccttgcaagactcagttctttgaatcatctgcgaataaggggagtactaaatttaagaaaagcatgctccagttttgataacccagaaggctcagaggaatctggggatttaggatttttaattattttcacccagatgtcccatctgaattctttggatcccaattttccttcccattcaaggttctgaatttggcatagcaaattttctgaagactgagaattccatcttctctgcaattctgccacccagctttatcctcagtttgtactgccctccagttggtggagttgaaaatatcataggttgtcaaggagatcctctgattagttaccctcagccttttattatctccaatgtatccctggaatccagcaatagccatgaggtttcagagtccttctaatggctatttctcaaagaactgagatatgccctgcccttctttcatttccagattgcttactgtcactggaatttccattttatgtcaccactgataacattttaacaattgcaaagcttcaacatgtcaagagctctttgtacaacacagcctaccagcattaatggggtcctcattgccaactggtctatgaataatctagatccacaatctcattttaatgtttgctttctaggacctattctggtaccaaatcttttaaaattgggttccagggaaatagactttgaggcagagatttatatgtcaaagagttattagggatgctcgcaggaaaagaactgtcgggagtgagagaagcaaaaccgatgaggaagaacagtaatgaacttgcaacagaggcctcagctgatcctataggaagttttgaagctgcggtggcccttcataactgttccagatcaagaatgtgaccaggtcctgtaccctcatatgaaccagtcagtggatgcctaacaatgagcaaggaagctgtctttggccaaataaaatttccagtgatagagcctagttgtagccgtcagtagccaatactcctagcaactggagaaataagtcttccattcctgaaagaacatctctgtgacgccccgcagcatccgctacacactgaacacagaatattgaagtgaaggaactgcctaggtgaataaaaaataactatttttatttattgaaacaactatgggttgtttcaaataagctttctaaattaacatggaggaatatatatatatatagatatatatataatttcaacctttccacatttaagtaaaaactgtacatgattattttagtgacgatgctgatgtgctgacgatgctgatgtgtgtatttaagttccagctatatatttctaacagtcttctggcctatagtccagttataagcactaaacttggatttatgtagctctaccatcccgtttatggtgtcatataaatgtttttctttcctgtgttatgtttagatatcaaccatatgtctattattttattattaggattcttttttttttttttttttttttgagatggagtctcactctgtcgccaggctggagtgcagtggcacaatctcggctcactgcaacctctgcctcccaggttcaagtgattctcctgcctcagcctcccgagtagctgggcctacaggtacccaccaccacaccccctaattttttgtatttttagtagagatggggtttcaccgtgttagccaggatggtctcgatctcttgacctcgtgatccacccgccttggcctcccaaagtgctgggattatggctgtgagccaccacgcccaagcctattattaggattcactttacataaagtactcattagtagttgaacacatggatttagttatcttgttgcaatttgaattggctattggaaggaagacaatattaaaagtgtagttgaaaacatttttatggtgagcttcagggcatattatttgaagttctttggtgcctttttattttttattatttaatttggacaaagaagattctatatttattatattttcctttgaaatgggtggggtctcaaatcaccctttggagcataatccagttaaattttaaaagtatttgctaaattggagacatctggacactctggagttaaaattaaataggtataaacaaagaataattcaatgaggaagactaagtaacacaagtatagacatgtcaggccctagtgtatacctttttggagattagaaaaataggttgaagaacacaaatgaaactagcttagaaccaggataactgatgcaaattttcaaacatgtatataaatataatagccagtattacaacttaaggcatttttgaatactttggagaaggctcattaaagatgatataaatgtaggaaactacactgtacacaagactattcaatattagaaatattgagccggataaaggctgaggtgagagttacagtttgagttagatagctgtacagtttgggttacataaaggaatatcaaatgcatagaaatagagtgtttttgttgtaagcttttacttaaagaaagtaatgtaatgatatatctctacaagtaagatttaaggtaggagaaagtttttataaatattcagaaaggattaatgttagatattaattttctaacagtataaagactaagagctaggagttctctgctgttgaatgaggcttctagactacctcacttcttccaatataactgatcaaagacaagtttacagagacagaaaattgaagcaaaacagtcacttgcctgcaggtacttgacgccagtcccccatttctgaaagaacaaccttatcatactgggactccattggaacttctaagaaatcatggtgccaatcctttctgtatgaataattgctaaggttattgctgtgtccaaactaattttttctctttcgtagtaaagttctctcactggaaatgggtaaaagagactacaccatttaaagaaaaaaagagaaggtttaggaagcttgttgtaaaaatactgaagtcacaaacttattaagaaatccactccctagaatcttaaccctgacctaaccattagacacctctcacacagttttttctgtcaaatgagactcaaaaaattgactttgaagatctccacaagcatgtttcattattttcttgcagatatcagggatgtagatggctgtttctgaatcacagctgcagagcagctacatgataatggcagtcatatccatttatatttcaaattaacttaggagtaccatgaggatataatgttgtttgggccctgttaaaatcaggtctaccattctgatattctagggagagaacaataaaaccaacagacctcctatgggtattttttacaggaaagtgcatggctataggggatgatccaatgctggttcacatttggctcatgagagccaattgtgacatccaattctgcattaagggatattacgttggtaggttgattttcagccatagtgggaatatttatactttggtaatcaacaaaccctaaaactcagggcttcctttctgtcttttatcttctttttttaggcttagtgttaaatatttctacttgaaaacaagacaataaaccaggtgactaaagaattactcttaagaccttaattttttttttctagcaaagaacttggattcctgctagaaattcctgctagaaaggacatgactagtggtagagatgatgagatatttatctaaactggcggaaataacatactctttttttagaagttgaagatattatccactttaaaaattatatataggtgaaacccaaagttagctaattctatttgtaagccattcagtttagcatatccactacaaatagggaggaaacaaaatcaagtttatgcagaaaatcaatagaattcattttgaattgatagtatatctatttcctgtaacttttaagaaaaaaatatcctcagccaagtgtggtggctcacgcctgtaatcccagcactttgggaggctgaggcaggcagatgatcaggtcaggggttcaagaccagcctggccaatatggtgaaaccccgtctctcctaaaaatataaaaattagtcgggcatggtggtgcatgcctgtagtcccagctactcgggaggctgaggcaaagaatcatttgaacctgagaggttcaccctggagatcatgccactgcactccagcctgggcaacagagcaagactccgtctcaaaaaaataaaataataaaatttaaaaaaaatcctccagtggtattcctatggttgtgaaattagattgctggtccttctatcttttgtttctctctcttctgttgattctctctgggacctttattatcaacatagcttctaaataaggatgctccataatagaatgaaaaggtgagccacaattctatcagctttttctacttgtaatgggttcttaaaatggtttggtagaaatactgtaacatatttcaagaatgtctataattatctgaaatcctaactatttatgattctccagtgcctctgtcccaatgtataatattgccactacagaatagttgcgatttttgttgtttttaattatttctttggacaactttgaactaaagtagttacatcagctatgtattttgacacttgatagcatccagttcaatgttttattaacactggttagtactgtcttcatttttgatatttataaatgatatttctgccaacagaaagcatttttgatatttcataagtattcaaccacagcaatcagaagttttagggctagtaaatcaatagatacccaatcaaatgaaactgataattgcttatgctcaaagagagttagatttaagtaaggtgctatttagaggttgattgcattattaagaaattgcctgttaagtttgggttaacagctcagaggtgactgagttacctttttggtaatataaagaaggaaaactacttctccttaattacagaaaactgaaaagacaagtccacacattttttttcttcaaatatctcttgttggtctataatcaaccaggcactagattaaatgatgacagtaaggcaaaaataactgagatgactaattttaaaatgtattataaaataaagtaagtatagtacttaggctggatgggccacctgctgtttaagtcaaagcaatgttgtaatttaattttccatcactatttcatctctttttaagacagccaaaccatcctagggaatgtttgatagaaaatttgttgtaagggagcttctcaggagtagaacgtctctatttcagccaaacaaagctttctgctcagcttgtagtattagaaaaacatgcttatttgttcttacttgcacctattttatctgtcatttcctgcaaaataaacttctcaatataaatttctcacttttagaaactgacactttattattaaaataccaccttgtctttttaaaattccctcctttcaatttgggcagaacttgtgattgtgatgagatattactctcttgattcggttatgttactggacaaaaggggttttgtagatgtcatttagtttatttatgagttgacactgagttaatctaaaaggagattatccaggtgggcctgacctaatcacagcctcagccagcaccttaattgcagccacgtaagcccctaagcaaagaatccatctatgccatgatggactcctgacccacagaaactgcaagataataaatatgtgttacctgaagttgctaagtttgtggtaatttgttacacagtaatagaaaaccaatgcattctacatgcaagggagggaaggattgaagaaagaacaagaacgcaagagagtaagagacatgtgtccctcatctctcatgggtgtcttccatccagatccctgttccttaattttctttgacgatagacccacactactcattcttctgctccaacctcttactccacattcacagcatatgggaagggtacacacgtatacatcctttcttcatacatttaacataccctttcacctgccccagcgttatccatttttgcatcaggagcttttaaaagttaacacagaattcctggagggttgccaatttctttttagaataatttatgaaattttaaatgaatctgaatataacaaaatagggcagtttccaagtatatgtagaatattgcaacattcttagagggagaggaatatggatgtgagtatttgagttgtttctgctggattccagtgccctgccccagagcatgatgggccgtgggtgaactgcgcacctgctgctgctccagcaggcctgatgtatgttgcttggttcttcctcttaccacaaacttagcagcttcagataacacatatttactatcttggagtttctgttggtcaggagtccattatggcatatatggattctttgcttagggccctatatggctgtaattaaggtgctggctgaggctgtgattaggtcaggcccacctggatcctgctcactccacatccaccctctctgccccactgggttttcatctccactcagaaacagtcttctttaactggcaaccagataaaatcaacctaagtgaaggagtcacctttctccatattaatggtgcatcatcaggtatagaaagggaactaattaacataaagaaaatatcaagataataaaagaaaatttgttcctggaggacacagatcattggaaaacagagagatcttttaaaaatttaagtaatacactcagaacaatttgtgaatacactggtgtcccccaaaaaatttttttgcatagtgcctaaaagggaacaacttgaaaaagaaagaaccgtcctaggtggaaagctatgattgctaaagtaaaatatttaactagaaagagttgaaaaatacatatttggaagcctaaaaagtgaaaaagaaagacagaaaacaagggatggaaaatacaaaagacaccaaggatcaactcaagaggtttaatattcattcaacagcagttctagaaagaaaaaattaaaagagagggaggatagcaaataaatgataaaagaaaattcctcacaattgaaatacccaagcctttagattcaaagagctcactgaaaactcagcatattgaatgaataagagactcacagatagaattacccttgaactacaaattttcaaggagtctgcagagaaggaaacttgtaaatgagaacattctaaaaagcttctgagatttcaaaaaaatgacttgcaaaggaatgtgaatcagatgagagtcttgagttctcataagcatctgcagattctggatgaaaaaaaatgaatcaatgttttttaagttctgagagaaaatactttcaatctagaattctggagccagccaacttatcaaccctgaagcaatatcaggataagcacattttcagacatggcaaaaagttgatgttcaattcacttttttccttagcaatatgtttagaaatgtactccagcaaaagaacttcctcttaattaaacaggaaactagaaaacaactgactcattccaggatggcaatgaagaaatcttctagattaactttctgcagacctagagaacaagttccaaggtctaagggctctggcagggaggtctccaaggcaaaaagcaccgttaacagaagactacaagataaaactgactaaaagttctcttttttagttggggatgtaataaagaaaaaacgctacaagaaaaattagaaaaaaatgagaaactccaagaaaaaaaacaaaattgctcaaaaactcatgatctaaatctggtataaactgattttaaggaacgattttaagtaattggttatatgtttaaaaaataatttatttgactttaattccaggaacatccttctgtaaatgtcctaaagcaggggttactaaagcaggggttcccaaagcaggggttcccaaacccatgaccatggactgatactggtccttggcctgttagaaactggaccacacaacaggaggtgaaaggtgggtgagcaagtgaagcttcatctgtatttacagctactcctgtatttacagtacattcttgcactagtgcctgagttctgcctcctgtcagatcagtggcagcatagattcccacaggaagggaaccctattgtgaactgcctgtgtgagggacctaggttgtgtgctccttaggagaatccaatgcctgatgatctgtcactgtctcccatcatccccagatagaaccatctagttgcaggaaaacacgctcagggctcccactgagtctacattatggtcagttgtataattatttcattatatattgcaatgtaatagtaacagaaatagagtgcataataaatgtaatgtgcttgaatcatcccaaaaccacccccagtggaaaaattgtcttctgtgaaactggcccgtggtaccaaaaaggttgggaaccactgttctagaggttacaaaatccttagaaaagaatgcaatctatttggcctattattaaacatatttatacgttcataacatagtcataagcatatacacacttttcattatccattattagactgaacatattaataaagttgggtgtactgtttgaagccatagcattgaatgtaactctccacaaccctgacaatgaaaaggttagctggcaaaagatgagatttgggagatgatggaaaaaaggggtgaaggcaacaggcagggaattgaaggaaagtcaagtctttaaaatgtacatgttacaaaatgggaaggccaaagatactgccaaaaatgccatgttacaaaaaaaagtataataactattttatttaaaaatttagggtactaccaaacattagtggaagtagaaagaagaggatgttgtaagaaaaaagtcctcatcttatatatggaggaattaatagatacctcattaagaaagcaaatcaagaaacagagttgtacacaaatggagttgccaaactggctgtaaaactaaaagtagaaactggagaatcagatttttaaaagagaggtgttagaagacctacttttaataatagatctttctatattattttatttttaacacacatgagtaatgagggtaaagcatattattttaaactggattgtatttggtcataggaactgatagaaaaaaaattaaaattgaaagccaaagtataaaatacatggcaaaacacttcaaatcctgaaatgtttatatatgtttttacaaataaggtatatttgacaaaatgttaacataggtgttatatgtcagtaattacactattatccctagcaggttagggagctgacattaagccaactaagacaaacttagacacaatggggaaatagatttaaaaattaattaaaagctatttccatttagttagtctagtttctacccaagaatgtcttctgaattaactttcagacttcaaataaaccataactgaaataactaaatgactcccaatgcagtaaataattttactgagcataattaataaaattgaatatctggcttactgagtctggaataataaagtagaatgaacaatggaatagaaagaacccagcaatgatactaaggtgagagtacatatttagaatgcagttctgggtctcaaactcaaccatatgcgaatggacttgtgaagaacaaataggttttttgttctcttaccttaataatgatgggtgtccatttctacaatataacttttcttttttctcaaccctcatactttcactgaaagcacattcatcaagtaccatttattgaaaatgctgttctatattcaagagagagtatcagtatgtattggaaaaaggaggtatgtgtagatgttgtgcatttgaatgactattcaaaaccttactttcttgtgtagaggagataacacttaataaagtcaaagtcctttcaattgtttaactttttaaaatcagaaagtcatggctttgaagtatttgaaataaaaactggctttcctggtactacggaagcttcaacttgactctgcttttcaaacttcaaaaatcaaaagacttttatttggggtatcaaattccttgcttttataaatatgaattgcttggagaaattatcatttttactactgtaatatgaacttttgacaggttcttttgaaaattttttaaattgaatatgattgtgtgttcttcttcattagccagaagcaaggtcaatattttgaaagttcagcgtttctataattttttaaaaataatgaaaatcagggtcaaacttggaattttttaacatgatcttatctaaagtgtgacctaaatcataattcatatatggattataacatgggaatttaagatcaccaattctataaggtatgttattctctgctcctgcagctgaataacgttcgaaaccagaatcactgaaacttgttgcagtttcagactaagaccatactctggcatcatccctctccacagagaagaaaataaacacaattctgaactgtcagctccagaagctattgctcctcatctcatatggttttccttagttctagtaactgggctcttcattcatgcacatttgaccaagacctccccttgtacctcagttcaaatgaatgagtattttttttccttattctcagatatatatttattcattgacccatttatcaatttttattgcatgcctattatattccaggccacacaatatgatgggaaacaatcgttcttacctttagtaaacttaaagtccaacagaagaatgaaataggtcagtagtcttatttgactactgaacccggtatcccagatttgcttccctaacccagtcttcctaaatgcttctagggctggagtcctacccagagcccagtcactccacagttggattttgacagctttttgcaaagactttgttgaaattgacttgccatttgcctggacttgacatttggctaatatctgctgttggtccctggcctgatcacagacacagaccccatgaatatttctgatttcttggatgtgctaattcccattctgtctgtcttagtgacaaacaattcagcccgctctcatctctccctttgtctccttccccactgtctttgccttaactcagactttttttaatttcttgcctaaacaaaattttcttctaaaacaatttttctgtcttattttcctactccaacatataaactatctgctctatttaaaaagacaactattacttgcatcaaaaatgttgaaacccgaaagttctctgaattataatttataacataaatatacccctgaaaccactactcaagtctaagaatagaacattatcagcacctcaaaagccacccacaagcccactcccaatccctttctgctccctcatctccagaggtaaccactatgctgactgataacaccatacgttattattatattataataacaggccactattattgaactgtaaacaaataaaagcacatcatatatattctgtaccctggctcttatgttcaacatcacatctgagagattcatcatgttttcacatctaggaatagttcattcaggtttgttgctatgcaggataccattataagaatatactactaattattcattgtattattggctaacatttgaattattttcatattagcttattacaaataatgctgttgtgaacattcacaaacatgtaaatgcatatatgctgggttataattaggtgtgaaatttttctcatagagtacgtgtgtattcagctttaataattgatgccaaacagttatccaaagtagttgtgccaaacatagtgtatgagaatatacccacatgctttcaaaaacagttttgtcagtcttgtaaattctaacccttccagggagcgtgttgtagcattttattatagtttaaatgttcatttgtaaattctaacccttccagggagtgtgttgtagcattttattatagtttaaatgttcatttctcttatgactaatgtggctgagaactttttcaagttaattgactatcttggtattctctattatgaagaatgcctgattcaaatctcttgttcatatttgttttgggttttgtaatggttctatatcttggtgacaagttctttggcacttctattgaaagatggggtctatgtcccctcctcttttctttggcactcctattgaaaggtggggtctatgtcccctcctcttgaatctgtagaagcttgtgatttcaataatagaaaactgaggaaataacgctatgtgacctgggactaggtcataaaaggccatgcattagccacattgctcactggaaaacttgcttttgaagccctgaaccacaaggtacaaagctcaattcccgtgagactacaattttaaaggggccatgtgtaagcacttctgctaaataagcccattcttccagccattcccaacaaagcatcagacatgtcagtgaagctgttctgaactcacaacactagctcattctccaaatgaaactactgaatgatctctgtcgacatcattaaaaatggaagaatcatctatccaagccttgcctaaattccctattcataaaatcatgaatcataaaatggttattttaagccattaagtttggggtttgtcatatttcagtagacaatgttaacagaatttggtacctgaaagtaagataagtgttataataaaaccaaaagtatgtggcatcggtttggagatgaccagcagccttgaagatgctattggtaaaggctcaaaagaaaatgagtacactgttattggtggtggaagaaagcagaccctggctacgtagctgtggaaagtttggcaatactgttgcctgtggtaacataaaaagttgtcaatgtacctaataaacttaatggtctagctaaggagacatctgagcagagtgttgaagatgctgcctggcttcttctagctgcctataataaaatgagagatgagacagatgaactaaagaacaaaatattagggttttttttttagtagaatttggaaaaaacataaaggctcaaggtagtcttatatcccacaaaatatccataaaataaaatatagctgcaaggcaaagatcaaatcctgggcattaccagtaaaatattaccctggggaatccaggtagggctgaaagtttctttattaagatgttagaaggacttaaggtggcgcctcatagatcacctcagttaaacaagagtcttaagtaatgttaagggcattatttaaaactctctgctagaccatagtgcttctaaaggtattatcctgacgatattatcacagtggtgttatgagttggggaggttactctcaaaaaggtttgtgagtgaactttttgtctaatggagtagctcataaattgatatataagcaacctaaaggaattatatcagcttggactagaggggatagacagtacaaaatgaaaagaggcatttgaactctgaacttttatgtacagggagtaagctcagaaaaccattcagctgtgaacacaagctactctccatggaaaaattaggactccaaggaaagcatcaagacctcagaggacagagccaagattcatggagaatcattcttagaggggcagttctgggtcctaagcaaagaattggcaacacacacttgggaaattctaggatcactacggaccagtgactgctgtgcaccttttatctcccacttttttgagcagagtgtctactgtcactatcttatgctgtcccaccattgtatacgggttgtgtggagggcagataacttgtctgtttcacaaggtgtcacatgaagaggagtgataacctagaaactgaacctaaagcatctccttcacacatggacataattcagattatgagacaagattgtgaaccttgagccacacaggataagactttgggaagggagtttaaaagggatgagggtgtttttcacatggaagaaatgaaaatgatttgcgaccagaggttgggctctgacaattttttgacatggccataaattctttgacattccttcaatcaaatagcaagatcattgttttcttcctttatatctttgagggcttgcagctgctttggtcaatagagtatgattagaagaaattctatgtgatttccaggtctaggttaccaaagttatgaagctgcttttttatttgctgaaatgttcacttttggagtcctgagctgccacataagaagcccagttaccgtgagaacaccactctggagaagcaagtgcaagtatcccatctcagctaggcttagccttccagccatccccaacaaggtgacagaaatgtaaatgaagctgtctcagaccctccacaccagctcatctcccagcatataccaccagatgactctgttggtgccacgtggggcagaaaaatcccccaccgcaccctgtccaaattgctgaccaacaatatcatgagctataagaatatggtagtgggtataagcctctaagttttggagcagtttgttacacagtgatacataaccagaatagctgtcttttccaaattgttttgttagtgttctttatacattctggctataagaatatacggtcatctttatttttttttacttttacaattaaatttacaattcacttgatctatttgcttatcctgaataaattcaacactaattattgtaactcagtaatgtcttggtatcccactttattattattcaatattatcatggctattattgatcctttgcttttgcatggcacctacctgcagggagcagactccctgcatgtgtacattcaaggccaaatagccaagtccccagaatccttgaattcccttaccatttcctgacaaaaagaacaaataaaatgtgaaaaaagaaggaatgaaactgttaccacttgtagcaaacaagattatgtatgtaggaaaactatagattcattttgcctaaaacaatttcatataaatgcagtcatacaatatgtaatcttttgtgtaagtcttcttttattcagcataatgttttgaagattaatccatgttgttgaagtttatttcttgtcattggtgagtttattatctgaatatattatagtctgtttatccattctcctattgatggacacctgtgctatgtccaacttttgggcattttgaatagttatgaacactcttgccaaatactttctgttagcatatatcttcatttcattggtataaatgcatggaattgatatagctgggtcataaggtatgtgtaagttttagttttataagaaactaccagagcattctccaaattgttagtatcattttatgttctcaccaccaatgcacaagagttccagttattctccttcatatcaaaatgtagtgttgtcaatcttttttgttttagttattctaatgaatgtggatggtgtctcactgtgattttaatttgcatttattttatgacgaataagttattttttcatgtgctcgttgagcatttgtgtatctatctttatgaagtgtctgcaccaatattttacttacttttttgagttataggggtgctttctatagtctcagaaccattcctttctcagatatatgtgtagtgcatattttttcctaccccttggtttgcttattcatttcttagcaaagctaatgttcctctcaaaactttatgagaactgctattcttctgtatgtaatttgtcctttttttcctggctacttagaggatttttctcaataactttgaatatcagcaggttgaccataatgcaaggttttctttttatttaccctgttttggttttactggtttcttacctctgaaacttatatcttccagcaaatatagaaaaatgtcaaacatgaactcttcaagtactttttgcttcattctctctttcctctcttctcggactccagttgcaaatataatagacactttgatattgtcccacagggacatgtctccgggctctcttctctgtcttctctcttctgctcttaagccaatacagtgaatttttatttcagattgcatttttcagttctagaattttcctgtctacttaagcctagtaaacaggctttaaagaaccatcttgagtagataatatatcttttgatatgtaagagacacaggattattatctgactcctacctagagaaatctgataccaagaggctatatggagttggcaggaaaagaaaaagaagcctgagttgggagtgagctcctctcccatacagtgaagcaatggtgtgtatttccccaggtctacatgttgtccccttggaaggctcagattcatcataaaagggattctgcctaagagaatctcatggagaccatatgatcccaccatagtaataagctcctagaagcctagaagctaaagagaaggttgttgacagctagcaggagcaaaggcaataccaggtgaatggatgtgtaataggagatctctaaacaggagatctctaaaaaatttctaaaatgaatccatgaaaagaaagatatcttcctctgagcataacctaaagttgccccaaaacatcagctaaaaggcaacttggaataagaaaagaaaatagaatttgaccagatattccacctgacttcaagcatccagcctgttgcaggctaagctggacaagcagagaagcattaattggatcagagtggagattgtaatactacttgggaatgaggatgtatgatcaatacactagaatagattttattgtaatccttccgtgactagaaaacctatggggtttaatatttaatgtaagggctgaaaaaatattaatgcagaaagcaaatttgaaattactaaaagagaaagaataaggttagtatctgcatatgtgtatctgtgtgtgtgtatgtttgtatgtattcagtagcattgtaggatcacttctgtcatattatatccatatattaaagttatctatcaattatatgccttcatggtatatttatacacagataggattgtctgtgtgtctgtgtgtgtgtgtgtaaaatacttaaacattggccgggcgctgtggctcatgcctgtaatcccagcactttgggaggccgaggtgggtggatcacgaggtcaggagatcgagaccatcctggctaacacggtgaaaccccgtttctactaaaaaaatacaaaaaattagccgggcgtggtggcaggtgcctgtagtcccagatgctcaggaggctgaggcaggagaatggcgtgaacccaggaggcggagcttgcagtgagccgagatggcatcactgcactccagcctgggtgacagagcgagactccgtctcaaaacaaacaaacaaacaaaaaaaacaacaaaacttaaatattgacagtgatgcatgggaaaattgtatcaattttttttttagtttttagattttttaacttctacaatgaacgtatattctatttgacacacaaaaaaaatatactgtctttttcaatggactgtgagtctcttagtctgtttggtctgctataacaaaataccatacactgtgtagcttataaacaacagaaacttatttcctacagttctggaggctgggaagtccaagatcaaaatgccaacagatttggtgttggtgagggcacatttcctaattcataggtggtaccttcttgctgtgtcctcccatggcagaaggggcaaacaagctgccttgcacctgtgttctaaggttcctattgccattcgtgaagactttgccctcatgatcctatcacctcccaaaggtcccacctcttaataccatcacattgggcattataatttcaacatatgaatcaggagagacaccaaacagagtatagcaatgagttagtacttttcagttaacaaacaagtatctcagatattctaatcatgtcctcacagttatcatcattttcaaagttttgattttaatggtttgacacattagagagcaagtatttcagtatatttgaaggataaatcacatttaattccctttattaagtgatacacttgaaaattcccaaatactattgtaacattctccttaaggaactgcctttatttagactttcttcagtcttgaaattccattgtgatactcagcctcagagctgtaacatttgtcacacagataatgctttttgtccttgactttttttctctgtgtgtgtgtgtgtgtatgtgtgactatctcctaacatttttttttcatctcttctcttccctggatattgattacagcattgaagcatctgcctaagtttttactttttgaggctgtttgacatttaaagtatacataaaaaattctggtaaatctatgtgctttggtcattctttttttatttatatttttgctcttttactgctggctacataaactaaactatttacactccctcagtttttatgctgcctgtgagctaatcatttaactttaacatacattttattttgtcattgaacttgctttcaattattttctcctaacatttacagagagaccttacacatagttactatactgtcaccccatgttaatagctctctgctgtgggttctagacataaatgggtgtgtcagggtcctccatttctatttttcccccttacaaataaatgctttaatacattgaatgtgtaacttgctgccctttctacttgcatcttctctggttcttttaattattttatatcaccctgttacaaatgggtcataatctaaatatttatttggtctaactatcaaatgtttctttattgaataaaattcacaaaaatctgtggaaaaaatgcagtcaagaaagagggaggtaactttaccaaaaggctaaaaatcaagctgattaattcaacatttcttaagtttactactaaatatatataaaattactgaggaaaaaaaatcgacagtgatttccttttctaaattctgtgataatactatgcatagagagatcagtgtaataaatttcttaagctcaaaagataatcaaggctaaaaaaagaagtcatattttcaaacctacaatttagtttagattggtttaaattatagaatgttctggtacccagaatcaatctgcaagagatgtagcaatcttgatgaaggtctcagtaaattctttctttacttctagagggagtttaacagatcacatactgcctttacaaagtcctgtatttcataggtaacaaaatacccagtcagtcaaggatcaaatgctaatatgtggtgtttaatcacccaggagtgaaagatgccattgcataaagatatgattcctcccctagatttcaaagatatttaaacttctcctgcatctcaattctcctttaatcacaagaaaatcaccatgttatttatacggtcagtgtaacccgtaattgcaattattatcacatgaaatatatcaaagccactaatttccaacctgcttctatcacacttgtggttcaagtatggtagcatgtgttttgcagtgactgaattgtattaatgagaaatatacatctgaaaatataggctgtagaaaccaattgtcttcactgatgtcagtctcttcccattcatgctcctcaataaagatatacacaaaggataaatacttgaggggatagatatcccattttaagtgatgtgattatattacacattgcatgcctgtatcaaaacatgtaccccataaatatatatatgtaccccataaatatatatacctactatgtaccccaaaaaattaaaataaaaaaatcaaaaaaatgatatacatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagagttgtagtatagtttgaagtcaggtagcatgatgcctccagctttgttcttttggcttagaattgacttggcaatgcaggctcttttttggttccatatgaactttaaagtagttttttccaattttgtgaagaaagtcattggtagcttgatggggatggcattgaatctataaattaccttgagcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatctggctctctgtttgtctgttattggtgtataagaatgcttgtgatttttgtacattgattttgtatcctgagactttgctgaagttgcttctcagcttaaggagattttgggctgagacagtggggttttctagatatacaatcatgtcatctgcaaacagggacaatttgacttcctcttttcctaattgaataccctttatttccttctcctgcctaattgccctggccagaacttcagattaaagacttaaatgttagacctaaaaccataaaaaccctagaagaaaacctacgcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatcaagaatctacgatgaactcaaacaaatttacaagaaaaaaaaaaaacaaccccatcaaaaagtgggcgaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcgatcattaaaaagtcaggaaacaacaagtgctggagaggatgtggagaaataggaacacttgtatactgttggtgggactgtaaactagttcaaccattgtggaagtcagtgtggcgattcctcagggatctagaactagaaataccatttgacccagccatcccattactgggtatatacccaaaagactataaatcatgctgctataaaggcacatgcacacgtatgtttattgcggcactattcacaatagcaaagacttggaactaacccaaatgtccaacaacaatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattaacaatgagaacacatggacacaggaaggggaacattacactctggggactgttgtggggtggggggaggggggagggatagcattaggagatatacctaatgctaaatgacaagttaatggaaatgacgagttaatgagtgcagcacaccagcatggcacatgtatacatatgtaactaacctgcacattgtgcacatgtaacctaaaactttaagtataataataataaaatttaaaaaatgagaaaaaaataaaaagaaaaaaagaaaatgatatacattttactcctgaagtaaacatgttaaataaacacattgcttgtccttttgatcaatgtcagaaattgtggggaaaaaatgagaaaaacattttcctacataggattgcatgcaagtgatcccaattgacacaatatggaagacagtggagaaatatctaggctgcccataatttatcaatcttctctctgccctcttctctgtagtggacatttggtgtctgtcaaagaacaaaacaactatgtatacagtacttgcaaaaaattaatgttttctaaagcattttaagtttttcttttcttattttggatgtactgaaagccccaccccaaccatatttctctcttaattcatagttatatactctattttgcttcttctagcagttactctagaaatttcaacataaacatttaccgtaaagataatccatgttaactcttcagaaccatgcaagaacctataagcaatttatctcacgccacagttttctctcttggctaaacttttataaggtgatattttagttctatcttattttttaacactaaaaattatgttaaaattttaataatgattttgtattacctacatgattactatgtggttgtctcaagttttcttcttctatctcatacctttcttttgtggtcatttgtattctggaaaatgttactggcagtccattcatcccaagtaatctcagtgtttgtctctaataccctcattttgcctattgtcttcaaagtcttattaatatggatttgtagggaaccattttctttcagcagtttgaagacatccttctgtctccttctgtcttctggctcccactcttattatggagatatcacttttaatctaatagtcaccccttgaatggtccctgtcatttctttggctactttatgatctcctttgtatctttggttctctgcagtttcactatgatgtgcccaatatgaatttctttacatttattattaagattggtgctttttatcaaaagcaccaatggattattatgtcattttcttttggaataatttctctccatatcctatgatctcctactgaaatgccaatgagaaatatcttataccacttcacactattctcctttttgtcaactttaatattcccatctctttgtctctctgggctacatcctgttcaatttcttttcatgtatcttctagtgtattaagtctccctttagctatgtctaatctgctctaccccctcccccagtcttctgagtttctcatttcaattcttctctttctcctttgtggaaatgctattttgttctctctaaaatgtgactagacatttgtatagtctcttgttccttcatcattttctgatattgtcctttattttttaatatattcaatgtgcttattttagtattgataatactattatctacaatctttgtgggtctgacttgcagtccattattttttataactctccttcatgtggcttgttaccttatttattttgtaattgtatttattgtgacctctgtttcataataattctttgagaactggatttaaagagattcctctagggaaggcttattcatgcttctgcaggtatctagggatgtttggattcaagtaaaatgtcaaactattagagtcagggcttttcaggtcacataattcatgtgaatcctgggtccaaactcttaggaacgtgagtttatgattaacaattttcctggattttaaaaaacaaaatcctgtttcttgtctacccagaaccatgctggaacctgcacatattcttgatgtatctttctgaagtgcaagtttttctccaatttactcaatgttggcgtctcccagagctgcaatattcaacttcagtgggtactattcacattgtggtccatgtaaaaagcattccctggaggtgtgtagtgtcttatgcgatgctcttggtgtcaccatttggacatcccagttttaaatgagcatctctgatccgacccttgcatctacccaagcttggttttctttccccagatcacttgatccattaaagtacacggttttctaggtcaccagaaatgagcagatagatcctttgggcaaacgccacctttagtgataccttatctttagaaattttgcttattagttttccctcatgccaaactatagcccactctcccatgcatgccaattaatgaattttaaaagatttctcacataatctgtacattattgttatatgttttttactggaaggggttctctggacatttggtttatcatattatcaaaagcagaacctatggaatctaccactgaaaacagagacctaatcactcttctttctgcttctcataccacccctgtaggcagaagagtcattagccatggtttcagataataggagctctgcttgttgcagtcttctgtactctagtggctttctttgatcatggagagcctccaaggactcgaataataatgggagttgggggttgaggggcacacagttagaaagggagaacaggaggaaacttgtacttctaacttgtcaggttgatcatttgttcctatgtttggtattcttggcttccccttgtcatatacattgttatttcatattataaaataattttgcctactgcatttagaacctatgacttcctaataaggaattcattgatattaatttgctacctttttttccttctaaaaaattactgactttcttacagtttcacagagttataagaggaaagaaaggatcagttattgaaggcataatataagactctgctgtgtactatgtatgagttatttttattattcctattttatagagaataataacagcaacaatagtaatagtaataagagctaatatctattgtcaggcactgctctaagtatttgacgtgtatcaaatataatcttcacaacaacctgtgggttaagtgctatttctattcccattatatagatgagaaaataatcttagagaagttaatttttcaagtttgtataggtaatgatgataaattgggggggtttaaactcaggtctgcctgactgcagatcctatacccttactatatacaaaataggctactctcctaaaatcatattgggcatttgggaaggcagtatttttacttgacaaaacaacaacaaaacagcatttttggtgttgctaaagagttaatacaactttagagcacgagagagaatattttatcaaactgaaaaaagtttaatgctttggcttttcaaagagcatttaattctcataggcatgcctatcctgtatttcttcatcaattgcagatgaactattaactttcaaattggtcactgcagggttctatttacatctttaatagagtaaatatcaaaggaacataaagtgtaggttaaatctaagaggattttcaagagaaataagtgatgagagcaacagaatgtatctcaatgccctatatatcagtaaagaattaattaaatgtattaaggaaaatgtagtgtcaatttgctctaattgagaaaatttttgagataaattattaaaaaaacatttaaatgaagaaggtttggtctgcataatctgcaggaaacttgtctggccaccaaggacttttttgctaatgagctttgacttggttacagtccctctgagagagaagatttagtctacaattggcttactaatgagcactgtcaacatgtggattggtctcagatgctctactctaaaacaaggtggaagttatcctctcaactaaacttgttgaacagaacttggtcagcaattttccctaccaccttcagtcagctacaaatcaccacaattgtgtaatattctggacaggatataacgaataattattgtaatatgagatgaattataatttttgaagcatcaggagtttccctttaatagctctcccagccaaataactgatggattatgaattttaaagatcaacattattagatatttcctagatttaacatatattggaatattatttgagcaagaaaaacaaatattttctatatttaagcaagtctctttaactcttaaatagctatactcagtctgggtgttgacatgtcattttaaccaaagagaacaaattgaaaagcttaactttccaccaacttcacttttataaacaagttctaagataatttgaaataaattttgaaagctctaaaattttcacagaaacaaaattctatagtttaccatattgttaagcaagattgtgattgtcattttttctgagatagatgcaaatccatttatcctaaaagtttatcactatgcagttatatacttaattagtccactagggccaaaacttttcaaaatagatgaaatcactttagtataatagtgttgctacaatttaaaattatcctttgctctgtactagtgcagggaagtttaaactttccctctgaaggttctataattgaatctgctgaaataaactgacaatagacaaattagctggaggcaaggcttacaaatttattatgtgcaagcacaggggagtcccaaaatatatgagactcaaataagcgtcaatggttgaagcttaaataccctctttctggggaagaaaaaagcgaggaatgtagtcaattttagaggaagagaaaatgatttttaggggaaatgaatgggcccccaaaaatctaccacagcctgggacaaggttcatctggactctgagtgtagtgtcaactctagtcttccttcttgcacgacattcatgaatttctttcagttaacaagatatgtggagaagggattcacaactgaatatattctggaggatccagcttttaggtagatagggaaacttcagagaaagccttttcactgcatttgctattcacgatgttctctcagcttgaagtccaaaatggcatatattggggtatcattttatgacccccagtgctagttagaaatggccaataatttaatattaatcggtaatattgatcagtaaaagcactgatgtgtgctttcttgatttgcttcaatcttcttattgcgcaagtggttgggacactaaccattatttagaaatctagttatcaagtaaatgaaaattcttaggctacattctacacataaacacactcatttatgttttggcctttgtttctaagcttatctattattatagagtcacattaaatgtgaatggttagtctaaccgtgagatcactccttaacctaaccttagttctccctgcagctatctttaggaagagaaactcaaacacttcatccaggttgttttgtttaagcatataaccaattttaaagtttattttagtagagatggttggacttacaacttttgtgttgctttttaacttgtaaatttagaaggctctgaagattctggaaataaaattctacttatcagagacaacatccccacttttctttttagctcctgtccttttatgtctttttaaaacccaactccaagtagaccctttcttctgtgaagccttttaattatttacttcacctgtttccaatcattttgcacagcattcaaaaattcacctcaaattatatttcacaaagagataattgcgttatgttattcttaaattgttttattgttgatatcttatctgcagctagggtgaatgtttatcaggcaataggcctttcatctttagaactgaagatatctctgataactacttctcttctggagagaaggattatcagtcaggattgtttactgtggtaacaaacaatccccaaatttcagtaacctacaggagcaaagttttatttctcaatcacataaatgttcattgcagggacttagattctggttcatgtcatcttcagcactggatacaggttgaggaagtagctactattctggtatactgttcatttcattataaggagaaggaggaaactgataaaacatgtcacttccacacttatttggtcaaagtaagtcacagagtcattcctaagtacatcagaatgtggctgtacacttcttccacattgaggagctgaagcaatcttatggccaagcctgaattccatgtttaaggaagaggtcatacatgatactttgaatttaaaacaataatgctttctaccacagagggaaaatatagaaagataatgaacgtatatcagtataactttatctagctatttgttctaaatgggtgaattaacttgatatttcatttttcacaattctttttttcttaatgcggggaatcctgacaatctcgcatcctctccagcctcatagcctaatatcttgccaattgtttcctcctcactgtggctagttgataaagcattacataacaaatatatgtttaacaattactatttaatgagacagctgcaaaaataccttatatcagttcctcttgaaattgcaattcaccaagcatagttccaagttcattaaggaaacacaagaaaactcaacatggtacttgatattaagcatcttataattttataggaaagttaaagtacaaatagctgtaattcagggtggaatgtgatgaatgcttaacaagaaataaaaaaatgccataataacacaagataggaaccattcactcacaaatttggagccacttaactgccccaatttttgtcatttccatctctaaagttccattgattcatatttgtcttccttcaatgttcttgaactattctttaataccaggactcttaataccattttcttcttttgcactgcagggtcaggttcatcatttcttccctctctcctattactttaatctctacctttttgttattatgttttctccaacttaccacttttcccaagttttcttccccatcaataattcttctgaacatatatttcactttccttatagttctaaagcttcttgagctagaagtctcgatgtactacctgtacttctgcaattctcattcatgactccaaccactgtaatctgcccctgctatcatcctcaaaaataaaagggcttctcgatggctaaatccaaaaatttacatttctgcccttcactattgaaacctgttgaccgctccttatttctttaagcaatattttctcttagtttctgagacatctctagtctcaaagtacatatttttaaatcaatttccatacttttaaatattattttaatgttgatgtgtcctgtggacccacatttccgtttaccacatggatatcttacatgcaattaaaatgcaataggttaaaaactgaccctgtcaacctaaaaagaaactcactcagagagacaagctctccagaataaatgaatttattttggaatagcagagaatttcaattcagagtacacaagcaatggcaggtcatgggcatatgcaggggggctgaggaaagagggcatcttttaaagacaaagaaaagaagttcatgtaagctattttgaaaccaaaggttacaaagaccgaaggtaataggggttacagaagttggtgttagctaatttctaggtgagtatccttgggcaagcaacttacctggaatgctacaatcttgaaaaagttcttgctataagttttgttcacagtttatgtggaggaatgtcttttgagaagtcctgttacaaacattcaagcatgggagcttctttctcatggcctctctcaactctattttgttagaatttgacacaagtggctccgttttacaacccagacgtattctttctttagtattctctaatttgactaatgggttcaccatcccttctaatcaagaaacccaaaagatttagtggactttttaccaccttcacaccttctcatttctaaagagtcaccactatcttttcattctattacaacatgacttgtaattcttcctgctcctttcctctactctactatagtatccccagtgactagtaatgtcggacatataccagattctcaataaatatttgttgaattaattaactcattaccaccttttgatgtttcttccatgtaaaatgtccttcatttgttgtacttgtacaaatagctcaagtcacgctttctccttaaaatgttccctgactccaaaaagaggtacttactcctctgtgttcccatagtactttgttaataagtctattataggtgaaagttatttaccttttatgttatatttatgctactgtttgccttatttttcccattagacattgacattcttaaggacagtcatcagagtgctatttatttttggtatcctcaccgtctttgcaatgtttaggtgaatcagcacagggttggatattgggatggatgtgaagttactaaaagcttcaccgaagagacagcatttaaacagtgctgttttcaaagtggtttctgattaaactgaaagtaaacagcattttctaagagtgcccagaaggctaccttagctgaaatacagggacactttggaggaagaattcatggcaaataagggtggggtggtagatcagagatgattgtggggtctcctgaatgacagataaatgcattccttttttttcctttgggcagaggtgaactatatatggtttgtgagcagagaggtgtacctttctcaaatttatagctttaggaagttattcagatgtcagtatgtcatgtgaaatggtacaaagcctgcaaaggctattggaaaaatattgtgacaatccagaagggaagaaatgtgtaaatgagaagtaaaaaaagagaatggtaaggagacacattgtaaaggtaccttccaaaggaccaaggaatgtggctgctagaggataaggaagagagacgataactgagatttcaagcctgagtgacagaaggcgcgctcctgcttttaacaagagataggaaatacaagaggaagcatgagtttgtgggagaagattatgagttcaattttggatatagtgagtttgaagagcaaatatgaatctgaacgtgaatatcagcacctacttaaactcttcatatcaggattgctttcctttccctattaagtgacttgaagaactgtcagttggtcagatattcaagaccaaattctttctgctaacagcagcctttaataatgactgccattttgactgattggaagatgctatcctaatgtgatctaacagttgaagcataaagtaccactaccagtgaagtgaataacaaaattacaagacatcagaaatgtaaccctatgaattttaaatagaagagaatgcatgcttcaggattatttttatataatatgagggtagtgttaagaaccaaatggaaaaaaaatccttgtttccccaaattgattaaaattttgatttttcacagtatttccattatgatataaaggtgactgatgctcatttcctatactttagatcttttgaaatacattaattttccctgctgtgaaaaatgacattcaaaaacagggttgtagggagagatgacaactttattagtctgtcgtataaaacaagttcttcactctcttcaagatctgtttctttctacaagtgacagtctgacatattctattatcaaattctaagtagccttgataaagcaccaataaatttatccttacaactaaaaataaaaaggaattctataaatgcatacctaggaaaaaaatgttaagaggctggtcatcagaacgattctatttgccaggttttttttttttttttgagacaggagtctcgctctgtagcccaggccagagtgcagtggtatgatctcggctcactgcaacctctgcctcccaaattcaagtgattcttctgcctcagcttcccaagtagctgggactacaggtatgcatcaccactcctaactaatttttgtatttttaggagagatggagtttcaccacattagccaggctggtctcaaactctgactttgtgatcctcctgcctcagcttcccaaagtgctgagattgcaggtgtgagccactgcgtctggccttgccaggtatttttaaaggactcttacactgtgattcctgtgcatgactgatactgtgactatggtcgtagcaggtatagagcttctaccagtagacttttccactatggaggagagttttggtacgacctacttttgtaaagcattactcagactagaaatatttttaaattttcttagagaacgattactcaacgcagtgtaaagtgatggtttaaaaacatatatgtttctatatattatcatttatggattatatccatttataatccataaacgagaattccagtagataactctggggattttggaatttaatgaatgtgtatcaaattaagatctgtgcattatatcatttatgcattgaatatgtttgagttaccataaaatcaaccaaacatggtttgattgctgcctgaatgagcttctaatcattggaaaacaattggaacacagcagggaaaggtaaatacacaaagagaaagtaatggaattaaatgcccagtgcttcagctcctgccatctgctttaacttagactacatgtagtacctaaacagcttgatatagttgaaaaaaaaacacatttgttagcatgaatgctgcccccaagtaaactttcctagcctgttacatcccaaaatctgttatactcttttcagatcgaagccttaaactctgaagcccaattacacagaggtggtaaggaaggagagagctatatctactattgctcttggcctctctccaactgcacctctttggtcaccctagggaggagggttcctgtggggaattagtgggggacaggattggaaagttggcagagacaaaattcttgttgctttaaaatgccatatcaaggaattgaatttgtaatatcttaatgctttcatacagaaaaggttaagagtgatgaaaaaaatatttaaaacaaatttttaaaaaccaaacggctagactctcaagagtggaaagtttggaacctactataacaattcatgtgatcaataaacttcacatctattataacaaggcaaacgattcatagttagctgcacttgtactgactgatttcctgtaaagcatactttcattatctttcatgcatgtttgaaaccacctattctggtatgagagggaggaagagtttcataacattaaagaaactctacatcaaacttaactgaccctaattagcctaatggattaatgacattttagtacttatgatttatagtaaacacctaaaagcggaaaaggcttctatgatgtgtgattggaagtagcagttctacagggaaaagatgaaaactctctgaactcaaagaagattcttcaggaaacatagatagactacataaaataatgcctttactcccaacatactttttaaaaattctgtagacaaaatgattttgctgtttcatataaatatactcccaactctctcatgccctttttccctaccacttgtccagtgtgacacattgtcttctgattataatcatgctgtatcacccagctccactttttttccttgaagaaaattctgttgctggattgtcattctaaatgttttaattctatcaatttctatctcttcccacaataaacatcattctcacaatatatgaacatttttcccccaattctctgacctatatcttgaaggttagaataatataaacacatgataaaaagctttgaaagcttttgtgcagacatggtggttagaaaaaaatgttctccttttaaagacaaggatctcaatattgagtttttcctatcacagcttgaactttctatgaagtctacggagcctcctctttagttacataagcaaaccattaaaatgctctctatcagtcccttgtcattagcatatttttgaaatcacttttttcatcatcgcactagttatatgtttctttcctaaaatgtcacatctgttcagatatcccatgttcttctttactcacacctgcaacccacatttcattctgcttccaaccctatcttttcctgtcttttcttatcaaacttttctactataatatctcctctgatttcctagtctgtggtcaagaaaaacctctctacctctttgcttcattaatacttggtgttctctcacaataaggcccaataggtcattttcacaagtagagacttcatttttcttttctcagcataaggagaaatttatttttgttctatttcatcctacctcatgctactcatctcaggttagcataaagtagttcaccctgttttgaagcaaaatttctacccatatcaacttaatctcacctcaatcaacaacctctgggccatccttccctatttttggaaaatagtacctagtccatagttaccctctttccactattactattatcctgaacgaatgtaaaagatggtccatctactttgattagaatctaattcagtctttgattcctcgtactccaatgacagaaattcaagtcagtttagaaactaattcacataatcacaccatggacctttgtaattagctgaaacccttatacctctaagaatctaaattctgaaattcccatttctgcctatatcttaattttacaattctttatcacctctactctctttcatatccccttaatcaaaaatcttcaccagaattcctcaatacttatgttgttcaacttcgcccttttggatttgcttctcaccttccacaacagaaccccgtactttaattatttcacgtgctgttgcctggccccttagtcctattgtatatatatattctcatttacagattatatccatttataatccataaatgagaattccagtggacaactcaggagattttagaatttaatgaatatgtatctaattaagatttgtgcattacatcatttatgcattgaaaatgctgtgttcctttatcatgggcacacctcttggcaacctctcaccttgtatcaaagtactgtctcaacttaaagactgtatatgaagaaaaagaagaagtttggtctaacatggaccagaatcttcttctgcaactcactactagttttgtaatgctgcgagcttcagttttcttgtccgtaaaatgaagataacttttcttttcatattataggaggttataaaagccacatgacataaataccctggctcagggcagacacttgataatgattctccttgcttctacctccttctccacttaaagagggtctgtaacctactcacattttaactgtatctcaatattcttcctcggctctttttctcattctctacaataatttatttcaatgttttctttagacatatgcccccacacctggttcctgattctcaacatgtggcatgccctctttctttcctttttctagttaaaagactctaaatcatgaggttatgaactccctcaattttctttccacacttatttagatattttcccctgctatctcaggggaagaagtaacttcttttcaaggtcaaactgtctatcactaatattgattttatcatattttgcctctgctaagatgatattctatcaatgatttcttctctggcattaataatctctcacctctggatcatgtccccactcaactaatctgcttcatcctttaaaagaattaaaaataaaaatatacatttctacccctcacctcagtaatgaatgttgaaaactcttttttcaaaggtcaaaaatgatctggtcattggcaaatgctgacccttcatttggttcttatctctgcagtttcccacaatattgcccagaacctctcttttaactatcttcccatggtgtctataatgcttcccttccaggtttatttgccccatagtttcctgagtaaccttgtttatccatctttaccaggtcctcttctgcaattccaccacaaatctctccatattaaactgacattatgtaaataaaatggaattctacccatttttttcagtagagttgtttttagaaaaagaagtcatgacaaaattttaaagttattgctatgtgtccactcccatccatgtccttaatccagtctctaccatgtctctcattttgattgctgtgctgtgtattaaaacagcagtgctcaccataacatgtattgatcttttttcctatgtttattgaggtataatagagaaattatataaatttatggtgtacaatgtgatgtcttgatatacatacatattgttaagttattaccacaatcaaattagttaacacatttaacacctcaccaagagagtgagagagagtgtgtgtggtgagaacatttaaggtctactctcttggcaaatttcaagtatacaatacagtattgttaactatagtatgatctaacatatatgtaatgttaaaaagttgcattcatagaagcagagagcagaatggtagctaccaggggctggggtggaggaaatggagagacgtttgtcaaagagtacaagctttcaattttaagacatatttctctttgtttatggatgccattttattgaaaaatctaacgtgtttatttctcataggcatacgttagagcaaactataataacacaattctgttgaagggatgagcaaatgaagtcatacttgggccaagtctctatactatccctaaacttcttgatactttcaggtctactcgtagctgaatgttccacttccaggcttttagtccccatcctctgtgcttgctccagatcgcattagagtcctggagggattttcactttaatggaggcattgtcagtttcagagattaaggtgggctattactgggataatgcatcacatctgattggaggtctccagaatgtagactaacgttgaggacattcttcagtgaggttgctctaatatatatactcgacagggaaaatgtgttgtccctgtgtaatgacagcctactcagtgttttaagaagcatatgttggccgggcgcagtggttcacacctgtaatcccagcactttgggaggccgaggcgggcagatcacatgaagtccggagttcaagaccagcctgaccaacatggagaaatcccatctctactaaaaatacaaaattagctgggcatggtggcgcaggcctgtaatcccagctactcgggagtctgaggcaggagaatcacttgaacccgggaggcagaggttgaggtgagccaagattacaccattgcactccagcctgggccgtaagagcacaaatccttctcaaaaaaaaaaaaaaaaaatagtatatgttgctcattagtatttgcttggtttcaggaagataaattcatataagccaacaatataaattataacacataagatatgaaacaatatagattataaaattataaatatatagttatagataataatttttttttttttgagactgagtctcactcagtcgtccaggctggagtgcaatggcgtgatcttggctcactgcaacctccgcctcccgggttcaagccattctcctgcctcagcctcccaagtagctgggattacaggcacctgccaccacacctggctaatttttatatttttagtagagacgggatttcaccatgttggccaggctggtctccaactcctggcctcaagcaatctgcctgcctcagcctttcaaagtgctgggattacaggcatgagccactgcacccagccgatatgtaatatattatgaattatatatatcttatatgtagttcattgctagaccttctcctgtcttctctttgggaatatttcagtctcattgttctctcctattgggtctctcctcttttgcataaaattgatatatcaggtaacagattcatacagcaatcagatattagtgattctttacacaggagatttgatgttcaagaatcatatacaaaggtgattagggacctaaatttcatgctgtattatgtttcgtctctattatagaaattgtataaacagcctgcagtgtgttctatttcctttccatggccaaatgggacaaatagtgatttcaactttccttgaagcatcatgccagtgtaagaaacaagtctctatcatttaagctgcaaatttaaacaagatcagactttctttcctaaaacaaaaaaatcaaactgtatatagtcaaggatacaacaaaagcttgagggaaaacagaataaaacaaggaatcttcctgtttaacattatttgaaatatatctctgggaattgttttaaaccaaattttaagactccaattttttgttgagaatacaaaggtaggtgtcaaggtcagcacataaggcctttctctgtgctatttatccgcatgcctggagaggattacatggatttcagagacttagtcccaagaaatttacaattgagggcaaaagaatatgtcatttgactatgtacagtgttttataatatcatgacttcttgataaaaggattaaggaaatgggatatatgtatatattttgccaacatgtagtagaaaatcccaactcttcctctgctatcactgttcacttccccccaccccaaataaatgccatgacattctgtcacccaggctgctgtttttaagattagaaataaaacttgtattgaaatggagctattcaaatatatgtaccagcaaatggggctacctgcatttcctgatgctctgcaatgacaaagcagtattcacaagggaaggaaaaccatgatgaatattttaggtagctccaagtctctgggaaaatcagagagtataccaaagaatgtagtaaaattgtatgtttttaatatttatgaaatcctggtgaggttaaatatgcctccagactggtactttcttaatacagggaaataattgcttcagaaaaaaattgctttcagaataaactataatactgaggaatttgtttgggcaattttataatatctttaataaaatgtcactttctaacaaccaacagatacaaagataatagggcagtgctatatggcaaagcaaaaatatagaattacagttttcctttcatgatgctactgattacatgagacataactaaaaggcaatgaaactgatcacaagagccacacattgtatagttaaaccttataatgcagattatcctctcagaacaataccaaaggtagtgtatttgtgtgtgggatcaaaggtaataaattatttattaacgtgagaaatagaaatatattaaattgttaaataggctgtccatggcagggaatgttcaatttattaattatccatgtaaagaactagagagagagaaatcttagagcaaagaccccaatctatcagaacaacggctcttacttcctaatttaaaagctctttcaatgagggagatgattttgctgatgggagtgcaaactgggaaggagaggccttctttaataaagaggcagaggtggagaaggtgagcaatttacttttgctgcatacctttttttatctgcttccaatgatgaatggaaacagaagatttttcagattttactttctcatagcaacagtatcataaatcatggttatatttgaaagaatgtgaatgattccttcaactaaagatcatttagcaacaatctttgagcgcacactatgtgcacaaaactgaaccatgttccagggatatggaggcaagtaacacagacatggtttttatccctgagcttgtcagtctaatgaaagccaaagctagaaaaattagaatatagtaggatctaaggctataacagaacgtagaaagtcagtgaggagcagtggctggcaatggggttaagaaggtaggttgaggccagcttggcaaagaacctaccttgagttataggataaagagattggattttatgttatgggcaacttgtaaacactgcctttatgccaattatgttaaatgaacttccaaaagtatctgcttggcagcaatataccaggaagggaatctagaaatgactctaaaaaaatccagaatgattttcctcagatcaaattcccaagtaagcaaatttgtccaaaatctatttgccagaggttaaaattaatccttacaataaaatatatctgatgatacactgcacaggacagggaattttaggagttaccagcttatgaacatgaacctctcgatatttcatgaaaaataaaaagtatgcctgttcacattcatcctttaccagctgatacctctagctcttgttgccttacaaacttgtttttctaaaatatttggtatcataaactcttttatcaaatagaacggagtgaagcagaacagcaacaactctaaatttctcaaaaatatgcaaaatgctggagaggcagcctgcacctgcagccccaaaagcaaatgtgttgaataatcagggatcccaaacagagctgcactagagtaatttactcagctaatcattatatgaaatagaacattagatttctgcaacaaagttgcatcaaagtagatgcatacctcattcgattaactaaaacatcacaaaatcatttagctcattagatggtttttaataagcactccttcctgggagagggcactgtgtcttttatttatttcttgtgcttgacgtttctggcacatggagatgtggtctgcatgattcaatatcctcaactattcatctcagtccttagtatcttgtagaaagatcaccgtgctttcagatatttaaaatacccttaagataagcatggtatttgtttgtcagtaaaagtttgaatttgggtcttgaacatgtgtcagaacagggtatctcaccttaatcagccacagaactaattttcaggcaggtacgtgttaaagattagggaaggacagcagctttagctcacttcctttagctcacactaactgacctttccagacctcaaccaattttgaaacagaacttcaatttaaatggttttctagtgtaaataaaagtgcttgggtttccaagaaaaatatgtgaaattgttagaaaatgtggaagttgaagtgtctctaaaatgggcaatggtagtattctggaaacttattacagttgccaataaccagtttacgaagtagggcaaacatttttctcttctattttttcgttaccttggccttcaaattctcagtttattatctgagactagtatatagcttttcatgacatctcctacagcgaatagtctctcaaccagtatgagagtgcacgctagacacctgtccatgcccacctacaacacacaaatacacacacacaaacttacttatacactgcatacaagaaaaaatcgctgtgcagcaatactgttcctgaaatgtgaacgtatatggtaaagttgtggtaacttagtgaagaaaaggaagagtaaaccaggtatgctttgttgtctaacactgtatctatagatttgaggtatatagatttctagccatggagagttgggaactatatggcatcatacccactgtgcttttgtgtttgtttttttcttttttaacatatctacagttggtaatgaactaagcacagtggttacctctggaatgagagaaatggagaaggaagatttcactatgtttgtattgatttcacaagttaacatttctacaattggaaattgttttacaattgatagtgtgttggtttaattggaaggttttttttctttcttggtggcacataaaataacagtgatcttaagatctatatgcttcagattctgcaaaatactcagtttttaaagcagtagcatatgggtgatttttgctttcttatgatcttaggtgtttttaaagtttttagataaaaaagaagaaggaataaaaaataataaaaggaaaatatgtgacaaattgttgagaaacaaaatagaagccgatagtggaacaattcatggcagaattaaatattataaggtgaattaaatgtatttaacttattagtatacctgtctcgtctcaaattagaatacaagagactgtgaaatctaaatcacctttgaattgcctctgggatacagcaccttgtctgctaacaacttagtaacttagtaaacattggttaaataaatggattatgaagtaagttaacttttaaatatactgtgcaaaatcatttagaccatgttttctatttctcacattccttaagcatttcttcaaactctgcctgcttgacctaaggaaaccaaacctatggcaatctaaaaaaaaacagttcaaaataataggaccaaaatggaaattgtttggtttgacactatattttcttgataataatcttgtattgtactgacattatctttgatatctctgattaaaaagagcttattacagtcagcctaaccaagcatttagggtgagggttcttctctgtgttcacatggcactgaacattctctgacaagatctcccaacgacttgtctgtttgacctttttgaaaagggaaaaggtttcattcatctttgtaactgagatgcttagtacaatgcctagcaatgagtgttctgtaaatgttgagtaaatcacatgactgaatgacacagtttcacaatgtagtatcagttgaccctggaacaacacaggtttgaactgcctcggtgcacttatgcaaatttattataaaaatttaaaatttagcaaaacatacacatgcaggcacttacagaccatacatggtgccattcccaatggagagaaatggaaacaaatgtaaagatacagttttaaataataactacctaaagttaactctagaacaccctgtactactgtaataatttcatagccacttcctgttgctattgtggtgagctcaagtgttgtgagtttccacttaaaacaccatgtgacactaaccatctccccgtgagcagttcatctcttcggtaagttgcagatcccaataaaaagtgatgtctcccggttccagtgtatttttcattgtgctttctgcaatatcgtaaaccttaaataacaccgttggacccatacgaagtgccactagtgatgccaaaagttctcccaggaagcagagaaaagtcttaacattatgagaaaaaagttgaattgcttgatatgtaccatagatggaggcctgcagctgtggttgcctgccatttcagacagatgattcatcttgtacacagacaatgtgaatttgtggtattgataaatacagtacagtacagtgaaggtattttctctttcgtattattttcttaataacattttcttttctctagcttatggtacaactacagtatttaggacatataacatacaaaatatgtgctaatcgactgtttacgttattggtaacgcttccaaccaacagtaggctattagtagttaagttctggggtagtcaaaagttaagtgtggaattttcaactgtatggggtcagcacccctaacccctgagtattgaagggtcaaccatacttgatattagcagtgcttattggtagcagaccacaaagatctctcttaggaacgtagccatacagctatgttaagcaggtgtggcaagcacaataatggcccctcaaacatatccctatcttaatccccagaatttgagaatatgttactttatctggtgagagggatgtttgcagatggattaaattataactcttgaaagattactgtggattatccaggttggtccaatatgatcacaaatgtcctggaaagagggaggcaacagtatcagagccgagaaaggagatgtggtgacagaagcaggggtaggagtgacacagggccgtaaaccaaggaatgcaggctgcctgtaggagctggaaaaagcacagaaagggattcttctctaaaacttccagatggaacacagccctactgatacactttagacatctccagaactgtaggataataaatttgtgtcttttaagctactgaatttgtagcaatgtgtgacagcagcaattggaaactaatatatcaggcaaatcgttggagataatttggggcttcaaatggcaggaaactcaaactggtttaaataataggatagcaagaagatgcattggcttagatattaggatgtctaacatggggcagaatgagttgctccattggctcaatgatatcatcagtgatgccacttaatttctgtctctatctctgccctgtatttctgtttcactgatgttatcctgaaactggttcccttataagtttgggaaggctgccagtagcaattggagttaaatttgtccttgttcacttttatcaggaaagagcccaccttctcataattatctaccttgatagacttgcactaatcaggacccatccctggagctccccctaagggctacctgtcacagggcccatgcctgaacaaaatcagggtcctattaggaaaaggagagagggggtatatgccagacagaatatttgccatgcaccacaaagaatgtcacagaatcctgtgccaagaatgtgaagggataaataaaagtggttaaacaaattgcagggacactgtgccctcagtcacagacctaggaaacaagttccagcttttacttggcaatgtttccccttgctctataaggacagttgtataatggaaggagcagcagcagttagtaaaacctcatgactcgttctgccaggcttagactggcagttagactggactttcttccacctggggaatggcaacgtgcccagcaccttggctcatcataccaccgtctggcttacctgctgcaggtcactgaactctggagtagattgacatcagatagcctcttgtgaattatccctaaaatgatgggtttcctttgaaaactgctaactcttcatacatttctacatatactttactgcattcttctgtgattgaaatttgcttcttaatatgttttataaatatccaacatgacagttcagaggaatttcctacccaaccaactctgtagtcaaagtaacaggaagaaaaagagacagatgggaaattatttcatttaatctccaacttccaatgaattattttctctaatattacagaagaggaaatttgagaactaaggaactaagctgcaaagcctataatgtcagagctgttattagccttagggaaatatgattcccaagcccatgctcttccttttgtattccttggagtcactccaagagttggatatatgtataaagttgatctacaagaaatgtctccttctaatactctccatgtgacttaaggcttattccagaactggtcctcatgtcctacagggaggctaagaagtctgaagacatcggacattctccaaatttatgtaaattagagatagaggtgaggaaagatccctctagactagttccagaagaaagcaagagtagatcaagttgcttaatgatctccttaggcctgttctttcctttaattgtaagggaaatctaagcacagtcacattgatcatcagaattgattagggtaatttggcttgccaggtgggcatactaaccatggccctaagcacttgcagaggactaacaaacaccaaagagaattcttcctcttcattatctttctgtttctgggaatcctttgagaaacaacacacaaatcaccccaactcgtgtatatagctcaggatagcactggtctccaggaaacagctccagacttaatggacataaataagcaaggctctaaggttcatgagggcacactgcattgtatacacactgcattcttagttccagacatagtgcctgacccctggcaaatcactagtgttatatgaaggaggtaagagcaggatggtgagatggtggtgaagtgcactagatttatgtcattattcaagaaaaattacagaaaacttttccttaaacaaggtagaccaaacctatagtaatggcctttaaaacagtgcaaatttcactattgttgttcacggggtagaaactagaggcctttttacccaataagatcatacgaattttcaggttttgcaaaatgtttgttagcatttgaaaagcatttccagttactggcaatcttcaagaaaatgcctaaaacaattttcagaaatgcttctattgaactctactgaaattacattttatgtagtcctgtgtgattgcttctgccttattgttcaagaactgttaataatgagtgagagttttaatatgcagaaaatgagcaacagaatgggacccaaagttcttttattttattttttaataaaaatttaaagaccttgttagagtcagtttccaggaataatttactggcatgtatgttgtttaatttatttctaatttaaagacaaattaattaacacataaagaacttaaaacagagcatatcttcaaaatgagatggctcagaagcattcaggattcacaaaacgttttttcacggcagttgtgaatttaaatcacagaatagaaatgataagcaccacagcatgtcgggcagcagcagtatgctgaacatggacaccactgtttgcatcactgtttccagtggacattttccacgatgtgaagtcaattattgcttccacttctacattagtgtaattggtttttgctctccagaggagaatttattaaggcaatttcagtaaataagggaaagggggtccaatttgctactgaatccattgggtatggataatcacttcgattttcctccagatcctaggggaattcttggtcctgctgcatgtattaaaaccctttttcctctttgcaagggaaagcagaatgctacctttttttccccaggaaagttggtatgcttgatgaagacgattctacgaagcagtacccctgaaagtattgattagcatgattttaaagaatactcagggcttgtacagagaacagttcaaaggaatgtacaaagcatgcgccttctctaaacatttttaaatgcttagttcttacgaagaaaacacatgctaaagctaaattttctaccgtttctgcatcaaatcagatccttgatcaaatcaagaggtgcttttctttcattaaagtaactctaagtatgaaagagcaatgatacctttccatgtgggcaagttctttctgcatagagcataagacataatgagatataattcataaagatgttgcctattttcagccaacatttttcatttacagtaaaatatttttggaatgcccaggagatttcattatttgaataggaggctggaacatcacatttacagcatgtttggcaaagtttggaatataatgtagaaatcagaattatctgcaaaattgttgatgcattcttcacaaattctgatgctgagtgcagctggattctatgggtgaagctcagagactccaggtgaagagcaacatcactatctgtgccatgtccagggagacattggtgactacagtttttctggccctggagaccccaattcaaagtagtagtcaatctgttacttaatccaatccaaacaaagcaaagctaaagaaaacaaaaacactctattagatgtctctgcaaatacaccaagggctagaacaccatttaattcaggtgaggacaagcagttctgcccctattatctggagtgttgctttaaccctcagctttgctttgaaaaccaggcctcgctttgcatcctcagtgcaatattaattcagaactgacttggatttgttccttgggcaaaaggttaagtgatccataaatttatttccctgtagatttggaaaaagaaaagtaaatatcacggtgatttgttagccaagttttgcagcaacagaatcattgaatacccctccagtaaccagagtcaatgctgtgtgatgaatagaaaataattaaaatatttatggctcacccacgtgaatgatgccaatgaccagaaagatcaaatcctcacagaaatctgattaatgagaaatgagtctaacctgcttcatgtttgactaagaactaaattccatcacaaatgtgcaaagaagcataattcatccctgcataatggctttttgttaacataacttcactgtgaagaaatgcacagtatctctaaactacaacatatttgttgcaaaatagaacctacatttttcaaaacctgaccttagattttgtgggcccctatccagtgactcaacattagtgtaataagtacgtttataactcatggcagctggtgccatgtgcagcagatcttgtttctgcaggtaatagccttcagacttaagctctttcacggaggagggtgtgcttgaaaagataatagtggtggagagattcttagagatggcaccatcctctctcagcaacaatagctcagttattgagtatccatcaagtatatgacattagtctatgctcactgaaagtttccatattgaatcctagtctcctttttctaaatgaagagcattgctttcatgtccctttgtgtctccaaataattgttcaatatgcagccagacaataggctttttcttttgagagtgatggaaagatatgccaggtacagagagcatcatggagtagaaggagcttcatgagatccgcttgtttgggcttctgcctctctaagcatgactgttgctgaagcgtttcataaaggagctctgaatgtcacacaactgaggccatgcctatccccatgcctgtacctttgctcatgaagcccccaccctactttcatgcccctgcctcactctcctgtcccacaaaagacaactccattcatctgaaagctgctatcctcttaaaacatactatgcttgtccctgagaatagaggtgaaaaaacacatttcaaccttcactgaacttataatccaatagggaagataggcattatgttaagattatcacaaataattaagtgattacatattgcatggcactggaaagaggttctgatactatgaaggcatataataaggggtcctaagcatagtctaagaaatcaaaagaggcccccaaaagatttacttagactacactgggcacagtggctcacctctgcaatcctagcacttcggtaggctgtggcaggcagatcacctgaggtcaggagttcgagacaagcctggccaccatggcgaaaccccatctctactaaaaatacaaaaattagccgggcatggtggtgcacctgtagtcccagctgcttgggaggctgaggcatgccaatcgctggagctggggagacagaggttgcggtgagccaagatcgcaccactgcactccagcctgggcaacagagtgagacttcatctcaaaaaaaaagaaaaaagaaaaaaaaagacatatttagactagaagttgaaagaaatgtatttaatgaggataacaaggtgtttagaggaaagaccattccggccagacagaatctaacttgttaaggctgagaggtgggagttgggtgagggcaagtgttgtgaaaagtatatgggagagagattatgtaaaccacaggcaaaatgggaagtcatcaaaagacaagtgatgacatgatcaaatttagatttcttaaaactcattctggctattgtatacattattgttcagaaaaagataagtttctagaccagagcagaggctgttgcaacaattcatggacatggcaaacctttaaatctctgttgataaaacaactttgcccatcagcctgttatcactgacatattacttttttactccaggtgattaatatatatttaagacactggacccagaacgcttatgatagcattgttattttgaatatgagctactaaagtgtccaagaccatctcagaatatttcaatttaaaaccaaatctgttttttaatgaatatacctattaaaacacttaacataaagtacacttccccttaatcttggccactgaagatattggagttgtctgaaaggacttgctattcatgaaggcatgacaatgcctatctgcactgtttgttataatgctttttccccaatcatttttgttttataagtggaattttcctttcctacttaaatactgttggtacttattagcacccatttttccctagagatgctacagataatcctgtgaaacatgaggtgaagaaagttaaatataacagttaatatgaatgtactaccaataatacctatgtctccagtgtgacattttactcaggaaactgtgttgggtttcagagtagtgccatatttcatacaagggaggaaggtctgacaaattttcctctccacaaccagtatctctgctttcttcctccctatcccatgaataatgtataagaatttcaagcatcttggatgtcctcctggataaacaatctgtatccttcaccaagcaatgggtatgtacttacaagccagtggcagaacatgttttccaggcagcaaaactctttttcatttccctaatttctgcaataggtcatcaaacatgccatctgctgagctgttttccaaagcatatggctgctgcttcaagtggcaatgtagaagaataactaaaagaagtcatatgtaggagagagtaactaaagcacatactattgagtcactcgtctccatgtccttaattctatccctgagtcaagttgaattcctaaagtcctcatacttgaaacacattagatttctcctttccatattcactgtcaatgagatccattttaacattatattttcaccattgacaaccagagacaaccatagaaaacccatggtatgtttactatcaaatggtattgaaaatgtgcttagtcctgtcataacactaatagtcattagataggaagtgagcatgatgtgctacgcacagctttcattgttccagacaagcagcatagctagtagttcagtacacagttcagccaagacacctgggtacgggttctgaatctgtcactcaatagttgtatgctcttgagagttaacttcttagtgcctcatttgtaaaatggggtgaaagataacagtccctacctttgggattagtgtgaagattaaatgacttgatatatataaagcacctagatcacttcccagcacacggtcaacattatgtaaatcttatatatcagtatctcatttaaaccacatgcaatctctatttgatatatgaagaatctgagtcacagagggctaaataactaccaccaaggcattctgactctagagcctatgatcttaacgagttctttatataaagacttgtgagagaatatttttatttttagggttatatctttgttttattaaaactctaggccgggcacagtggcttacacctgtaatcccagcactttgggaggccgaggcaggtggatcacatgacgtcaggagttcaagaccagcctggcccacatggcgaaatcccgtctctactgaaaatacaaaaattagccgggtgtggtggcacgcacctgtagtcctagctgcttgggaggctgaggcaggagaatcacttgaacctgagaggtggaggttgcagtgagctgagattgcaccactgcactccagccttggtgacagagcgagactctttctcaaaatataataaatgaacaacaacaaaaaaactctaaacttattttttgagttggctgacaacaagcacagatccaaatctgaagttcaacaataaagtcattgtattgaatttgctggtttccatttgctttcacatggtctctttttcgggatcttgattttctattaatattccaatttggctctcacatattatctgccttttataataaccacctcataaaacgacttaaaaagacaaaagtagggctgggtgcggtggctcatgcctgcaatcctagcacttcgggaggctgaggcaggctgatcacttgagcccagaagtttgagaccagcctgggcaatagggtgaaaccccatatctacaaaaaatacaaaacttagccgggcatggtggcattcgcctgtaatcccagctacttgtctacttgggaggctgaggtggtgggatggctttagctcgggaggcagaagtggcagtgaggtgatgtcacagtgagccaagatcacaccactgtactccagcctgggcaaaagagccagatcctgtctcaagagaaaaaagaaaaaagcaaagacaaaatttatgaacattgttttttaagaaacatttttctctgtggagtcagctaaatatggaaatatggaaacaaagtttatcaaatagataaatgttgttctaacaaggaccactgaagaatgaaaatgagaacactgtataagactatgaaacaggccaggcaatgtggtacatgcctgtaatcccagtactttgggaggctgcggcagatagagcacttgagctcaataattaaagaccagcctgggcaacatggagaaaccccatccctacaaaaaataaaaaagttttagcctggcatggttgcacacatctatagtcccagctactcaggaggctgaagtgggaggatcacttgagcccaggaggccgaggctgcagtgagccaagattgtgccattgcattccagccttggcaacagagtgagacccttgtctcaaaaaaagagaaaaaaaaaaaacaactatgaaatagggagaactactttgcttttgacagttgcgtaacttttctatctcagcttctaacagtcatatacaggcacactgcactccaaacccaattaatttaacttctccaagtcaaatttcttgacacattatctttttacctggagcatttttactacttccttctacccagattgttttctgttcagtctttttcccttcaacttccttttatattttaagatttagctcaaaggtcatctcctctgtgaagtaagcattgtctgacaccttagccatttgatgtctctccctcttttgtgttcttaagatgccatatatataatattggtaaggcattctattgatttattttttattcttttaacaaatattcattgaatttctgctatctaatactctatattaaagtagaattatcatatatatgttatttccacttttaaaaatagggcgatgtttgatccatcaggaacctgaaacagagcagcatctcagtatataactgttgagggaaagaactgaccaaataagataattttatgatttatagtcacattctaatttttaaccaaaggtgatattattccaattggacttttactttccaccacattctaaataccttttggtgctttcaaaaaataaaatctacccttagaaatattcaaaagtgtggtatatgtccatcctcacgctgctaataaagacacaccagagactgggtaatttatgaaggaaagaggtttaattcactcacagttcagcatggctggggaggcctcaggaaacttacaatcatggtagaaggggaagcaaacacatccttcttcacagggcagcagaaaggagaatgagtgcccagtgaagggggaagccccttataaaacatcggctctcatgagaactaactcactgtcaggagaacaggatgggggagccaccctcatgattcagtgatcttcacctggtctctcccacagcacgtgtggattatgagaactacaattcaagatgagatttgggtggggacacagccaaaccatatcatgtggttataccataagttttacatttctctccaagtgatgaaaaaaatacctactattgctatatttttaatatatattttaatcataaaatgctaaaattatcctagtacatattttttaatgtatttgatacatttttcctgttggagagattcacatttttggaaatgctagaacaaaaagaatgcacatattccagatctactgacctggaaaaatattaacaaatatttttatattttatattttattaacaaataacaagctcacaaatagatacaggtttggtagagcctggcacataaaatagcagggtccctatttaagaaaaaaaaattattaatagaaaattgctaggtcctctccctcctaaggccttggaagggcctatacaagtgaggggccctaaagtacatggttcattaatgtcatggtatacctgcctgtgtctgttatgtattgttaaagggaagaggaaaagttaaagaatatatatgatctttacatcctcctgaaaataattaaaccactttatgttatgtatatgttttatgggcaaatgaaaactctggaataatgcagaaccaaattattaaaatcaccttcatcaagacagaattaagtcagagggtaagataaagtaggagtgtgtgtgtgcatccacgcatgtgtctgatcattttttagacacctttattttcattattacagcaataatgcactacttttaaatttcaatcccaaaataaactttactgggtggggaacaaaagcatgtgcatgtgaaagaattccaaaaaaggaattttttggatgtctttggaataagtccatatcttcccaaagttactatatgaatataccacatatattggtttctgaaattctgctatatttgatacaaaattagccactttcttttctgagaacattgcctgtattaatagactgttccccaggcctctcataaacacaagccacaagacaatcagataagaagcgagaacgtaaaagctcagtgacctaccaatggggtgccaggtaaaccatctctggtaaataaaagacgcccactgtatcaccctgaaatcacttaaatcaatcatgttttgaaatcaagagaaatatttctctatagataagacaaacataaaatgaatacaaaggcatatgtaacccacaagaataaaatataatcaagacaagtcaagccaaaaatatatctcaaaacatccatgcgggaaccagttgattgtggcagagaaaaatccaatatgtatttcaaaacaacttatcacaaaaagaaattaaggcaaattcacactaggaaaaaaatgtttttcaaaataactagttctaccaaaatttgtgcaatctaacgtgtgtgacagagttgtgccaacagtattttccagcaggagactctatggttccaaaaggcagaatttcatagcaatacagggctaatgattgcaatgtatgatggtagttctagcctcagctccaagcatgaaagcagatacctttctcttaggtgttctgacaggcagatattaaagagcagcatgtgtcagaagatgtaggaaatcaactggcctctttgacagattttaatgtagaatgtttgtactgccagggcagtgggtatgacaaatttgagagatgacagtaataggagtgtttaagtaagagaacaagcttaatagagatgccactattgacaataacttgcttatgttaaaggaagagtccttgctttcattttccactgaaaatcccaatgccaattttttgaatccatttttactaaatattacaaaaataccttttagtcatttgcaaggatagaagactaaactgccagttatattgcctcatctgtttttcaagatacctcattccatcatatcattgacattcttcagttagggcattagtctggaccgaggcagaacctatgtaaaacgttgaagtgactgtgaaatgactgcctattttttgttggagtgcacttcaaattaaccttggagcccaagctcaggaatggttattaaccaacgtttgtactgaagcccgacactatgtgtaggataccttgtaattatcttaagccaattgtccagttattctgtaccacaaataaaatgtatgaaacaatacaatttttctctccaaaaatatatacacattttgtatttcttgcatttctctagtattcaagttaattacagtttcaatattatacctccagtaatggcctccttcctaggtatttgaactcctccagaaatgttttactctaactctgtatgcatggtcagtggtagagcatttgggagggtgaagtgccagttgtgaattgatgctaaatgaatgggtatgcttttttttttaaaaaaaaaaaaaaaaaagtccttttcactcatgggctttaatacccatgtaattataatgatttcaaattctctcaaggctaaaattaaacttggcttcctggatggccaaacaattgactattcttctacaccactcagctcccactttatctcaggctcactttgagcacaaactggttaaaaacagtcataatccaaatgctgaattaaatatgactaaaagatataaactgaatgggcagtttaaatctagtatcatccaattagaaccatagtggagcattcatcccctttccacctccccacactcccaatggagtgggagaggcaggggagcacagcctgagttctaggggcaagtgtgggtcatggtgctaaagtccaactggatggaatatgtagagccaaggggaaagttactagaagcatagttccattggagagcaagatcaatgtcacagagatgatctgaaatggagctgccagtctatagaaggcttggcaaaagagacaaggccatgtacaaaattgataggcagaaacaaggagattttcatgagaaaggagtcttgaaacaagtgcagagtaaaaccaagaaatattgctaaggttgtgaagaggcagctgggtgggcaagaggattaggtatttgtgacttcagatgtgatggttcttagaagatcttaaggacagtggaggacactattactacaccagagatcacaaaatcatgacctgactgttgacaggctgtttgcatatggatttgagcagagacactgaacccaaacatactgggtatgaatcttgaccctactacttactagttttatatgatacaaggcaacttccctaagctttgtagcttcaatttcctcttctgtaaaattgggataatcattagaatgattttgagcagtaaattggttaatatatgtaaaacacttaaggaaaatgaaggtcaaagaaggaaaaataaaaatatttttgcttcatctttttcattcaaaatttcattaaacgtatttcttctgatctgatgaaataaattttaaactatattcctaaaacttagattacctaatttattgaataaaatataaatgggaaaattggcactacattttatccaccaaaatgaaaatatcacattgaagaatgggttaaatatggtcaattaaatgccaaagctttaataatagtaaagaaggaaatgggtagaaacacacaaggccaaaggaaacacagaggatacaacagagggaaagaaatgtcagtggaaaacagatcatggagcggtaactgacttaacagagtgggagaagtagggactcaaatgcctaaagaagacgacttccacataaatgagctaatttccaccactgagctccctagccattctggaattgatgtcaccagctacaaagaatttaagaatgaagtttggatctgacacattgtataaagagcattctaagcccctagatcttctctccaaccctgctcaaccaggcaactggttctatttgaaccacaattatcaagagaaaggaggtttgtccttcagaaaagttaaatcaaaaggggccctggactcaggaatacaaggcacaaaatatgaacacaacgcagagatttggaccaagagaattctgtccatctttccccttatccagttcctggaacacaggtcaccagtgagcaaaccacaagattcattgctgaagaaattgaatagaacccaaagaaaatgcctacagatactaacatttgagggtcacacattaaaaatgtcagcttgccactcagtctcagaattttttttcttctttttttgagatagggtttcactcccatcacccaggctggaatgcagtggcaggctcttggctcactacaacctctgcctcaagcaatcctcctaccttggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaagaaataatcttaaattcatcaaaatcatcaaaatgaatttgatgcatttgacctggggaagaatagtattgaaagaagttttatagttctgaagaagagtttaggagtaattagtgacaggtagatagaaaaccaacctacaaaggaaaaaaaaaaaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttaaaattgatgtattaagaaatactagtggaattcattattatccaagcagctaaaataatttaaagtaggtattgctgggaatgaaacttcgtggtggaagggtttaaggcagaagttatttttcactatagttctatagaacttgatttcttaaaccatgtcatatattttctcaacaaaagttaaaattgaagcacaaatatcttgtatgaaagcagtcatctaatctcttttcttgaaattagattaaacatattttcgtgaatctcagacagtttatagtgggtaacttatctttgttttggttgaatgttacaatagtttatgctctgctctttggctatcagcccctgaaggaaatatacaaaatttggctttgtcttgccatgtcccatctatcaccaggtagggaagttttgttcaatgatcccctgaattgagtttaatatgttattttttaatgttagactagtccactggataataaacataaaaggcaagatatttatttaagtatgtactcaatggaaattagtattttcaggtctaaaaaatttttatgaatattttcccaaaatagcaaaataattaaactaaaatataattatataaaatataattaatgaaaataaattgttatacatatcaagatcatttaagtcaaaatgtgtgtgtcatctgtgcaaaattaaacatgatcctatatctcttttgcgtttgattggaacaaaggatattttagacccccaatgctttacaacactcataatgtgaaattggaaaaacaaaacagaaaattgttatacatgagaagtaatgaaggtattaatttctagaaaaagaaacacatcaaagctttagatttgctctaaaaaatgttttgaagggtgaatattgtgctattttgaagagactcctaatttagaaagctcaaataatgtctattttttaaaatggaatctttctccagtcataggaaatgtaccaccacaactatgtaatcaatgtgaagcagatggtggagcaattatctggtgtatttgggcactaccattggccaatacacagaatatgggccaggaaatttattctgtgttttcaagctgcttttgggttgtgatggatagtgttgcttaatgaaaatctttgtattaatttagtttccattttacagtcctcatctaaataggcatctctctttgtctctgtctctttctgtctctatttctctctctgtgcctcttttttctatgtggctttttttctctctctctttctaagtcaagtaagatctatacagtgatgattttagaaatctaataatttgagctttatttttaaatatcagcatagcttgttactttttttttgaggaaatagctactccctataccagtgtacaaatctgagttatttcatttacttaaaatcatctagagggttcacaattgagagaagacactattttgctgattctgattatgtaattgagtaaaaaaactttaaaaatacattttaaagcacctactttgagcacttaggataatatcatcctaagagatattttacctttaattccaactaaaaattagctattaaactcatattggtttcaaacttttattttttactttgtctttttagatcagttttagtttcacagaaaaattgaaagtacagagatttcctatatatcccctatccccacacatgcacagcctccttgattatcaaaatcccctgccagagtggcacatgtgttacacctgatgaacctaaatgacacatcattatccttcaaaacagttcacttttggtgtggatttggacaaacgtataatgacgtatatccatcatgatactatggtatcgcagaatagtttcactggcctaaaaatcctctgtgctctgcctattcatccctacctccccacaactcctggcagccacagatctttttattatctccatagttttgccttatccaacatgtcacataataaaaatcagacagtatgtagcgttggccgattggcttctttcacttagtagtatgcatttatgtttcctccatgccttttcatggcttgttagctcatttctttttatcactgaagaatattccattgtctggatgtaccacgctttattaattcacttactgaaggacatcttggttgctttcaacttttggcaattatgaatgaagcttctataaacattcttgtacaagtttttatgtggacataagtttccacctctttgggtaaatacaaaggaacactattgtgaaataattggcaagagtatgtttacttttgtaagtaaactgctaaaccatcttccaaagtagctgtaacattttgcatcctcaccagcaaggaatgaatgttcctattgctccacattctcaccagcatttggtgttatcaatgttctggtgtatgtggtaccttactgctgttttaatttgcatttccctgatgacatatgatgttaagcctcttttcatatgcttattcaccatctgtctatcttctttggtaaggttgtttaaggtatttgacccatttttaaatatttttatggtaagttttattttagtttcaatgtgcagatttgtgatataggtaaactgcatgtgacaggggtttggtgtacaaaatagttcatcacccaggtaataagcatagtacccgataggtatttttttctgatcctcttcctcctcccaccctccaccctcaagtaggccctggtgtctatttttttttcctttttgtgtccttgtgttcttatcatttagctctcacttataagtgagaacatgcagtatttggttttctgttcctgtgttagtttgcttaagataatggcctccagctccatccatgttgctgcaaagacataatctcattctttgttatggctgcatagtattccatggtatatatgtaccaatttttctttaaccagtcttcagttgatgggatttatgttgattctgtgtctttgctattgtgaatagtgctgcaatgaacacacgtgtgcatgtgtctttatggtagagtgatgaatattcttttgggtatatacccaataatgggattgctgggttgaatagtaattctgcttcaagttcttctgcgactcatcacactgctttccacaatgttggcccatttttgaattaggttgttttcttattcttgagttttaagagttctttgtataatttggataatagtcctttatgaggtatgtcttttgcaaatattttgtaccaggctgtggcttggctttttgttgtttattttaataaagtcctccagtttgtttttttaatgattatatttagtatcttcatttatcactcactattttgctctgcagttgctaaaagtacttagacacattgtatatatacctagttttagaatactttgtgcttctctgataattcaaaattttgagttctatgtataagaaatgactacatggtaataatggtgatctgtaattaatattttttaatgttttattgtttttattttccaagcatacataaaagtgaagaaaataatctaataagccccatttgtccactacccaggtttgacaactgttaatattttgacagttttgtttcattgatcccttcttcttacatgttcatgtgttttgttcttaagattctgaattcccaaagaatatatttttaaatttaaatattgacaacagcaaaatagtatggtttctcaaaatgattccacaaaataatttttatctatttggttgtttatgttcttatatattattttaaaaatgatttctttagaaataactgaaatatttagtattcagaactttttatagatctacatcaagatcttttgaacatgtgcaaagttgccactgaaacataaaatgtatcatctttgataaatagcccttaaaaaaagcacttttctttagcttttttcctaaaaatactgggatttactaggaaagtataaaaactatactgtatgtttctaattttagagtttataaaaattttattctgtttaatataataaaatccagtgcagcttgctgtaattgttgattttggcaagatactctagtgtatgaatgccactgagatattaataatcatagtatctagttaatgcaaaaaagcttgaatttatataaattttttaattttcttttttttttttttttgagatggagtctcgctctgtcgccaggctggaatgcagtggtgcaatctcggctcactgcaacctccgcctcctggattcaagcgattctcctgcctcagcctcccaagtagctgggactacatacaggcatgcgccaccatgcccagctaatttttgtatttttagtagagacggggttttgccacgttggccaggatggtctcaatctccggacctcgtgatctgcccgcctcggcctcccaaagtgctgggattacaggcgtgagcccccgcgcccggccatatttttaaattttctaatgcagattgcttgtcttataggtgttcaaatttttctattccttcgcaactataattcccactttacccctaccttccctgcagtttatccttgggagtttttgcatttaatagcctcactgtagatcaagggaccccaaacattggcagtctatttaacaaaatacttgagctgatttattgataaaactagatgcaatttatttgcataagagtcttttaggaggcaagaggatagatagatagtcaaattaaagacaatagaaggtaaagcacagttttcaaggcctacaatgtggcttattatttctttgttttcttctctaatgcaaaaattggctctgaattgcacatctggaatgactatctgaagtagaatttttttaaatgcctagtgtcattcctcctaaaatgacagcatcttgttcttcatttgggtagttctccgtatgcactctcacttgttctggtcagcacttaatcctggcctggtgaattagtaaatcacacccttccgcctgccagccacatgatccaagctaaccaataagggaaaatttttaccccttatgagactgctaggcaatagaggtactctttccatggaatttgaatttggtaggccatgagcctgaacccagactaccaagtggacagagtctgcctcagtatggatttacactgctggaatcagaatatagagacaatgaaagaaggcatcctaataacatcattccaacctcttgatccagccattattggagtcagtttatttgaatttctgtgtgataaatatatttgttaaactttaaaaaaatttttccctttgccacattgagttgactttccttcacttgcaactgaaaataccctaatattccatttattcagacaagtcacactccatattttctaataattgtacttccaactttgccatttttatgcctcctgtatatagctaaatcatgcgtgcctcattactttaactccaagtactcatcagtgcccttgatctcaaattgtctactagctttcagcaaaagcccatttgatccaagtgggctagcagatgaagaggttaacagtgagaaagtatgatggagagaggctgaataaagaacaaactaatcacatgttgctttaaattttctatgagatataaagccaggtcatcggaatgtaatattatagaatgttagctgaaatttccataaagatgccttcacagaattattagttaatataaatttatttagcagttcatgtagcagccaaattagcttaactttctggcataactacttttgtttcccctcaggctgcaggatagaggaaattttatagacatacttggttggcatccttgttcaaatcctaactctgttatcttaatggaggtctttcatgtctctatgattcaatatctttctctgtaaaatgaaaataataatgttgcctttgcatttgattgtaaggattccataataaacagatgtgaaatatttgggaaaaagtgagataataattgtaagctagtggttctatcttttattatcaagcacttcaaattatttaaaaggaaacctccattaggtattatgcctgtggggcttactcaggtaatatatagtgacatatataaaattcagagctaatctatgatttcagagagtttaatattttttaatcatccgattatactacatactacatttaaactaattaatttagccattcccagttcatacaagaccttcgcatttgatattgcagccattcttttgctcttgtgaggagggtatccatctcaattataattcttttatcacatatttgcatatcttttttttactataactattaatggtgtagtgatgctgatttatcacttagcctcttttacctaacaatgttgccctgaagtaggaaaggatgaagttctaaaattaggatgtaattattaacaattcaccacctgaacattaactaacagaatctgacagtggctttccccacagacaaacctccacattcaagaaagaggattcctttataatgaagttagttctgacaccaatgtacattaagagaacaactcccaaaatattataactctgacttttagagtcttaaaatgtagttatggtttcagtagtaaaatctgagcaatactaagggtggttttattactttacaataagacaaaaatgattaatttcttaattaaatttttgatattaaatataagcccttggttcctttgcctatttctaaacaacaaagaagaatatatcatagtctatgatttgctatgaattatgttttgtgatggcttatcgaatcctcagaactgaactggaacttgcatttcctctgttatcagcaaaagcttttctgaaatgtttgcaaagctccagatatatggggttcctgaataaatattatcccaacactgatcagctgcataggtgaagaccaagttaggaaataggtctacaaggatttcttaatgaaagcaggtggctgttgatattttaaatagattcaataattaattagaacatttttaggactttaggtgcatttcacaagggatttctgtaatattcagaaggtagcccatgtaggaaagcacctggttcaagatcatcattcatgctctcctaataggggggaaatatttttaaaactccacacaggccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaataatataaaaatataacaactatttatgtagcatttatattgtattaggtattataaataatccagaaatgatttaaagtacacaggaggatacgcataggttatatgcaaaaactctgccattttatagaagggacttgagcatctgaagagtttggtatctgtgggttgggaaggacctggaaccaacaaccccatagatacagaggagcaacttatatttgtttaaaaccatttttggcaaacttctaaaacagactctgtgcaataaaattcacttgcttaataagtcacattccataccaagttcacataatggtagattatcctcaacttccatgtgtttgatgtccattcaatattttatgttttctaagtaaggtaaacaaatctgttgactagagctctgaagatactgaaggcttcccttccttctctgttaccatttttgtgatatgaacttctaccaagataaatttaaaatgcatttgttttatactctatgttttacactttgacatcaactaatctttgctcacaaaagaaaagttaggaccctttagcattaatatacatagtaaaaaatgctggaaaagtttttaaattgttactagcacttaggtaagttaaattcgcaagcaatatttttttctgaaatgcattgatcagcagtaaggtacaaaataaactaaatcacatttcatatctcctttctgtggtgtttttgaaattctgagtaatgaccctggttgagccattaatgcaaatcctcaaaacttaagtagtttcttgatactttccattttgaggcatcttttaaagaaacagcagatgcctctccacatgcattcaaaaaatcaataaaattaatcaataacactctccacaggtaatatatgttcagaagcatttctgcctatctatattgatttagagaattgcttcaaatctgttctgatgtgtataaaaatcatttccttattcatcaaagtttctcttccctgatatgttatttcatatatggcacacaatgatttttgtctctattcttgtatatttgtgataaatttcttatgatctgtgtatgagactcatttgaataaaatataaaatgagtattttgtttctttggagaaacctattgctcaaaatttaatcaaagaatgaataatcatgagaaattactgaagttattgtaatgagaaacgtaatgatgtatttcattcacatttttattatttataataagcttaaaaggtttgagtttgcttctatttcttataacaaagctccattcctgcagacacattcctacaatccagaatgacactattactgactatataaataatagaaaaatgcatagttttagccaattgctgactcatagtattgctagaaaatgtaacatgttcaaacctataagtgaattttgtaacctttttgctagtgtatgtgttacgtgtttagacagagtaataagaaaaatagatattctgaattttctgaacataaagaaatttaaagttttgatagatataacatttaataattctcattaaaaatgactgtatttaattaacccaaccaacttatatatccacagttaccttaactaacagtacctgataactggtggctcactggggaaactgtatttgatcaattaaagagtcccccaaggaaacacaactcttaactcttgatatattaactagtgttgtgaattattcctctaacaaaaaatcaaatatttctgtcaacattatttaataaatttcataactaacatagggtgctccattacaaaatgacatcatttggccagttaatacaccaccacagtaagtgtgcctcaaccagtatcttcttcaaacttggatttattaacaagtttcatgcctctcagtggtttttccttggaatttcagggaataggaattttcatattgacaaccgaggtccaatacctctctctaccttagaagattttactttaccaatctatcaaattaattttgtcttttcttaattcttaaattaagttgagatctttcagcaaaacaagaactgttttttttttcaggaacaattagtgtaaagaattggataaaatatattcactgtattcaaaaatattatttgggtgaggctaaggggatgtttgccaacatagaaagcataagcattggaaagaaaatataatctggtttgtttcccctatatcaaaaattaaatgacaatttttaaataacatcttaatataaaatacttacctaaagatgtggaagtgttttttctgcccactaaggcactgggtacattggatggtctccagaagctctaaaagaatagggcagccttcctgagtttgtcacttattcccaggaaactagttgtacaatcagattcttggaatcaatagatgccactagggcgaccatgaatataaaatttttaaaatatttcttttacttatgtaaaaattaatttaaatatattcctagagatgagcatagattcacactggaaactggagtggcacactcaagagagattttgatagacacatctctccatcatgttgtgttttagtaagggcagctgaatcaaagtggaagggatgacatggagccaatccaaaaaaaaaaaaaaaactcatctgggcatatcataaaagataacagcatgagccttggagtcatatagacctcaaatccggatgccatcacttacaagctgtgtggccttggagaagttgcttttctttctaaacttcatttccctcttctgtaaagcagagtatatgctagtattttctaataaaaatatgtgatatgtgatatactatgataatagtatgttgataattttaaattttctagtggacacatttttaaagaacaggtaaaattgatatatttatttatatatttatatttatatatgagatatatatttatacttattaattatatacatataaaatatatgttaaaatctataaaatgtacccaaaatggtatcatatcaacaagtaatcaatatgaaaatgagtaatagcctattttacattctttcttcgtttgaaacctggtgagcattttacaattacagcacattccaatttgtactaaccacatttcacatgctcaatagctacatgtgtgtcatagctgctataatggatattacacgtataacctaccccatagggttattgaagaataaaatgagataatgcaagtaaaggacttagaacagtgcttggcaaataatatgtactacaaatggtagtgtgaaagctgctactattatccactgatattgattatatcttccttgctctgctgggggaatggaaaaatatatggcatggcccctgttcctgagtaatcacgaagttaagaatgtaagacaaatatatagttaactagaatttttgacatcttattatcacatgaatggtatgaatgaaatgcaataagtgctcagaaaaggcagatcttgtactaggaatcccttgtaccaacttggtgaagaaaatcattttgaactaggatttaataggtaggttgatttttgttaggaagtaatggttagggaccatgaggacagctaggaaaaatattccactatagggaattacagaagaaacaatccaaaggtagggaagtgaaaaatacattcaagaaatgagggcaaattgtttgatggagagcacagagttcatgtaagagtgtacttgagttagcaaatgcagatttgtatcagagtgtagagatcttaaaagccatgctaagatacttggacattattcagtgtctgaaagaaatagtaaaaaagagcactgatttaggtgccaaagatctgatttcagccatattctgcaactgccacacgtgcattttcctaccttggccaagtcacttcagctcagctgttttatttgtaacataagatggttggatctaaaacaaaacaaaacctgagaacgtcagagatgaaaagggcctctttgttgttgttgctgctgctactgcgatcattgttctgtttatatttgtggtattttaggatgaggataacattactgaagaaatgcctcaggaattaatataggtagatttaaaagtaaaaatatgaaaatgaaaagatcattttgagaatcatttcagtggtcctagtgtctttaaaaaaaggattttaactaatattgtggacataacagttggaaatattaataaatggctgggttggattatagaaaatttgtttaaaaaaagaaagaatggctaggacttggattgaaggtggagagggaggcaaagtgagaaatgaattttattacagtttggagtctagaaaaaaaaataattagtattcataatagaaatggtagaaccagggagataatttggctggagatatgggaagggatgtaaaatgagtgtttttagttatcgggtacaatttttagtacatattatatatgcattagaatgtatgtatttagagattaatggatatatatagtgacttttgcaagaacatgagtattttagtttcagagtttcacaaagtagtagaatcaacattaaataaaacaattatgagattaacatgagcattaaagttaagaacttatgcaactagagaattcagtgatattcataaagaggccccaaagtgtgacacttatctgagtcttttttgcttattttttgttattattttagagacagggacttgcgctaccacccagaatggagtgtaacggtgggaatagctcactgcagccttgaactcctggactccagcaatcctcttgccttagcctccacagtagctaggactacagatgcatgccaccatacctggctaattttcttttaaattttttgtagagatggagtctcactatgttgtccaagctgctctcaaacttttggcctcaagtgatcctcctgccttggcctctcaaagcattgggattataggcataaacccagttggccctaaatcttaatttatgaaagaaattctaaagccagtaaatgaagcaagactttttgagtaataaagttttcaattcaaatcccaaatcaaggctgggcacagtggctcatgcctgtaatcccaacactttgggaggccaagatgagtggattacctgaggtcaggagttcaagaccagcagggccaacatggtgaagccccatctctactaaaaatacaaaaaattagctggccgtggtggcaggcatctataatcccagctactccggaggctgaggcaggagaatcacttaaacccgggaggcggaggttgcagtgagccgagattgcgccactgcactcaagcctgggcaataagagtgaaactccatctcaaaaataaataaataaagaaaatcccaattcaaccttctgtgagtctccttcttcattttctaggaggaaagaatagctacatcacagtgttgagtgaaaaacatgtgatgtaaaaaagaaagctctagacattcaatgaatgagggctaccatcaactcattccagtaaacctggatgacaaagaaatgggctcaaaccctttctatttaaaaatgtcataaaggtttttgtgctcctacttgtaacacactatgaatcttcaagcaacaagcacatattaagtactgataagtcaagttccatgatcataaaaaaaattgcaataataagcagcatgaatctcaaccttaaggagaacttggctacatgagaaggaaagtaagtattgaaaggtttaaggtaactcctggttattctaggtgtacactgtcaaaatcaaattgacttctcacacgtgtttctaaaattaatttaaaattcaataaaaattaatgaaaattgattgaaaagttttaaaaattgtagctagaaaaagtgtcaatattacacattttattagcatgagagtaagagtttccaaactatgctagtttatataaagtgatttttacatccagataaaattttaccactcaatttgtatggattaattcattctgtaaacttcttcaagggattctattgttaataatgcttaaattagtaagtatattcaaatattcaagtttttataacaaattcaattgaaactgttatgcctaagatattagtgaaactacttattaaaataaatacagcatataaaggaactatattgtattaagaaagttataaatttatttggaactaactttgaaagaccctctaatttataaaattagattgaatcatttaatagcagagcaatactttgaggttaggagaaatttaattcttgtcttcaaagccaaaaggagttggcaaattcatccaacagagtgaaatggacagcaacatatgctcctcattgagtcctattggtcaacagaaaaggtattgatttactaaacatgaaaatattctgaaagtcttggcagataaaaataagtattgattatatattttaagacatatgaaggagtcataatcactcagtgttgatatatactgagttatttgtataaaaaatagcagttacaaaattaaatcaatcttctccctagactgtttattttctttccattctgtgaaaagtatgacatccttataacttgaatgttaacaaaagaaaaaaagcaaggcattttttacataacagatgtttaaacatttatctgtattttaaaatacctttataaatcaattttgaccatttttatttttaacctattggtaaactactctgtttttaatcacaaatttatttcatgtgatttttatggaatgtgtgtattcataaattgttataattattcttgttaaaatactaagctaaataacaacttaataatctgttcagaaattacatgttacaagacaatattttgcttttaatattttaataaaagatttaaagtaaaaataaattatttaatttcacattttttaaagagacatatttacttcaatatgaacattattagttcaggtttcacgtaagttctcatgacgctatttaaaattgtatttctaccatattttcattccattgaccaagttctgatatagttaaatcttttatcctccctaaatttgtcattaagaccctgacattcagatgacaagtgatttgcagtgtggtttgtttttcattgccaatcaccaggagatttaaaaagatacccatgcacttctgtataaacactttctctataaatgctccactttgtggagatgctaccagtaatgagactatggcattttttattttctttctgagagtacctcttctctctcaaaccaattggatactaaagtactaatgtagcaattgacacaccctggtaagtaattttgaacattttctaacttagaaagaggttagcatccctgttcccagcaaaactaatttttaagtcacacattacatgccgtgtaataatccaatatactgtaaatgaagttgaacatgattataaacttatattcattttaggaattagttacgatacgtactcagtcttgcaatcttctgaaaatgaattcaggtaaacttgaaaaaccgcataataaatttgctgaccaaaatctgttcttgaaaaaacaaatttttggaacacctgaggcatggtgctgttgaattaatatgaggttccaatatcattttctgtattttatttaacaaactttcagaaattaccagagccttcataaatatttccaattattatttttagagatgtgaataatgatttaaagctaaatatttttctttttctttatggacttggttctgtttcgttttgtttggtttcacaaatagaaatcagtgtttaccccacttttcagctgttgtataaagactacaagaaaaaaagttatttgggaaagtcacaaacagcaattgcctatagagtgaggttggaagtgaaatccatatgtaatgcctctgtcagcaaagacttagtagaaaatggtttataataaatattcacatctgctgctttggacactctaatccatcctaaggatctttgctgtgtcaggttttgttctagatgaagaagcccagtagttataaaggtttgcaaataggttgtatttatcatggttagctttacttttataacttttctctgttttagaggtattcatgatgtttgggggtaaaatttgtgattaaatatttcactatagcttttatggtgatataattctagaattcttattataaaatggaccaatgctattttcacaatatatcacttacctaaaatctgtcaagaaggcatcattgataacaatgctatgctggctgtggaaagcaatggctaaaagcccaggctctggattcgaagtgctgtgattaaatgctagctccttctatacctagggtgtcattatgagcaagttacttcgcctttccaagcctctatttcttcacctacatagaggaggcattttttacataacagatatttaagcatttttaaatagtactaactatttaaaatacagataaatagtactatttaaaatattaaatagttaatactattaatactaactaatatattaaatagttaatactgttagtactatttaaaatattagttactactattagtactaactatttaaaatattaaatagttaatgctattttctttatcattagattactgtaacgatcattcagaattatccatatcaagcactaaatataaggatcatacggaattatccatatcaagcactaaatatagtatctatcacattaaaagagtttaataaattttaaatgttattactgaaacaataatatgccttctaagtatgattaaataatcccatggatagtactaatgtcatacttatttacactaagtactgagcttatgtaaacatatcctattgttttacttaactccaagtcccatgatagtttgttactggacttccttaataaaaatattaattaaaattggatccctgatttgttttcactttgaggaaatgagccactaaaaaatatatgatacaaaaattatgcaaataccctgtgctgtatttagccatcttatgtaaaaaaaatttaatttatcaaaatttgaattctaagctagagtaaaaactctcaagtcattttgaaatggaagtatttatttccacttcagcttcaaaaaaatttgttgagttcatgagtatcacaatttttaaagcaggaatgtatattgagttgtaagtaatgattagcataattattataaataagtttaaagaagaatacaaatgttttccataaattttgaaagctatgccttttaaaactttctaacatataatttatttgaaaaagaaagttgccttgcatagttgctttcaatctcatctcctcgaaatgctttattaatcacaaatataaaagaatagtaggatgtttgatgaaatctgcatataaaggaggtagaccattaggctctatgtcccaattagaaaattttataacctaattattgatgtgtcttaattttgactcaacttatttcttatacctacaggagctactgcatatttaataactgacccctaacacagaatgataattgaaaaaaatagaatgcttcattgcttataaactgtgaacacttgaaataaaactttgattcattctctctctctctcctctctgtctccctcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 946 - DNA, 1126123 bp, Homo sapiens; identical to SEQ ID NO: 945

SEQ ID NO: 947 - DNA, 1126123 bp, Homo sapiens; identical to SEQ ID NO: 945

SEQ ID NO: 948 - DNA, 33607 bp, Homo sapiens
gccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctcta

SEQ ID NO: 949 - DNA, 285130 bp, Homo sapiens; identical to SEQ ID NO: 735

SEQ ID NO: 950 - DNA, 285130 bp, Homo sapiens; identical to SEQ ID NO: 735

SEQ ID NO: 951 - DNA, 285130 bp, Homo sapiens; identical to SEQ ID NO: 735

SEQ ID NO: 952 - DNA, 8124 bp, Homo sapiens
ttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctcttt

SEQ ID NO: 953 - DNA, 9771 bp, Homo sapiens
ttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctctttctaggacaaagtcccccaagtagggactgcaggatgagcactagctatacctccagccgagatgtggcagcccagtgctgagtgttctaccagtccaggtcccaggctgctccctcccccacccagtccctctccagtccccaggtcctcctccagctgccccgggagcccactgctggctgagagcacactcagggaaggggtccagcaaaccaggggtccagctcctcaagcaactcctttcccaagcctcaggcctcagatgagaccctcccctctaagggaaggaaagtgttggagccaagcttgcccctgggcctccagccccagggtccaggttgtagacggctcaggcctgttatggggaagccaaggactggctctcacctgagaaggagcttgctcttggagtggcaatctctcacctagagggagaggctcccacatggaaagggaagtacccacttgaagtgggggaaagagctcacctgggaatagaagctttcaaggggaatctcacctagagggatctctgacctaccagggaatctttatcagcctggcaagttctgatacagggggaatcttccctctgcccagaggcacctacttgaagtcagagaaagatctcacatgggaagaaaagacctagagggagagggttctcacctggggggtactctcccatagagaaagctctgacctcgggcgaggctcccacgtggaatggggaaaagctgtcacctgggaatagatctcacagaaggatcttacctgggggaaaactctagcctgttggggaagctttcaccagtcaggaaagttctgatctaggaaaagccctgacctggggagaggatcccatttgagggacaggaactcacctgggaagcgcctctaacctggctgtactgttggaggagtgtggagtgggtgcaaggaagatcctcagagactcttgggaccgctatctcaaggagatcgtagagccccctctcctttcctacgtgagtcactcaggtcttcttaaagggctccctcccccgacaacttgggacccgcgtttggagggcggagccttgatcattggcccctccctgtaggaaggcaactggggccagaaaggccggagcgctcactccgggatcagtggagctgggtggactcgggactcagctgaaagcagctagtccacgggccgctgccagggactcccgtgccccacgcacccccgccggcacatctcctggccgggctcctccgcacgcagctgcctccctgtggcccgggatggccctcgggcgtcacaccagcggctttccgcacagcccaagggactggggtcgcgccggctcccgcccccaccccttgctgcagaggggcagccgcctgcagaaaatcagcagaggtaaaccgaggcgtcgcaagcggagaatgcctgctccagcgaggcgtcgcaagcggagaatgcctgctccagcgaggcgctcgcgcggggccaccgggaatgtgcgctgaactcaccccgacgcatccgccagccccatggctcgcaagttgtccggtgcgggctgctcctgctgctcgagctagaggccgctacgctccggaaggcggcgccgggaccgggtgaggccagctgcgctc

SEQ ID NO: 954 - DNA, 9771 bp, Homo sapiens; identical to SEQ ID NO: 953

SEQ ID NO: 955 - DNA, 9771 bp, Homo sapiens; identical to SEQ ID NO: 953

SEQ ID NO: 956 - DNA, 26453 bp, Homo sapiens
tgttttctatagaagtttattcccaaaacagagcgcggcttcacggaacaatttacacagacaggaaagagggccgctgggctggaggaggggaaccccagagaggggcatctacgaaacctaggacatagtaaagacaccctcccacccccagcaggccactcagcccttcaagagctggggtccttctcggtaaggagagtttgggtcctggctggtgggatttagctccagtcagggaagtagaatttctaatctcccaggaagctgcttcccaagagtatgcatggggtggtgggtgaggaggtgtctgcacagaccaccccccagccctgcacagccactctcccccgtggttagaggacgcctactctcaaggtcttctggatctgctgttaaacgggactcaaggctgaccttcggcctgggagacctgggggttagaaaacccctcaagatggccaggtcagggtcctcacaggtgggtcctccaagtccctctcccactttccctacctttcacttggaaacaaaggaaaaaaaattatctactgtaaacaaagtgtaaaactcaaagttttgagttgtaaacaaagtaaaaacattttttgaatctggacttgtaaacagtaacaaaattttaaagtcttcagttctggacagcagacaaaatagcaaaagtaagagttttgtgaacagggtcgtaacagtcatttttccctttttaagggaataaaggaggagtggaacggagtcacttcctgcagcccaggtgcctagggccacggaggatcctgtaaacataggaggcagtggcacctacattctgggtcttgaattcccttgtttctgctccctttgctcaccttcccaccctacccttcggaatcaattcaagcagggggcagtgtcagggaatcaaatggcaccacagacaacttttgcttgctgcaggggcaggtgaatgacccctccaccgaccctctgcaggaatgtctgactagaggcccgagcccctccccgtgggagacagggaagccttgctctgtaaacacgacatcagctgctccaccagcaccccacagcatcagtcctaggtcataaggcagtaagtggcagggactccacataataaacacacacatccaccaggaggggcggtatgagcaagcccccatgaggaagtcagaggacccctgtttccaagaccaacccccagccccagaagtttggcctttggagcattcaataaaaagcaaagaacaattctgtactttgggcccctgacgatactcagatcaacttgggggtggaatagggggaggaaggcatgtgtcccacccatctgagtccaccccaggaaggagagagagatgagcatagggtttgctcaggacccaaatggggtcaaactgcatctctccctctatctccctccccctcccagcccagcctcaaaccccccaggagacagaaaagctgaaaaataacataagcatctctctggttacaaaggtacaaaacgtataaaagtctccctccagtcccccgtctctgcacctgtcacacgcatgctcacagatgcacatggagcctcagccctgccacaccaggtagagctggggcacccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctccttgtcctatatgaccccctaggcgaaccttcccaagcaaggcctcctgctctcctccctgccccttgcatattccaggtcatctcccacttctaggcctcagctcctgccctcccattcgctagctcagcccatcggatggcacctatttctccttagcctgggaggtgctgggaaggctggctggctccagtcacacagccagcaagtccctgctagtcacacccccatttcttgccagattcctgtccccagcctgtggccctctggctgtgctgagcctggggtagcccacacctgtctgccagccctcatccccttctgtggcagaacacagggcagggcacacaggaggttgccctaagctgatgagggtgcaagcaggtggctggaccatacttactctgagtctggcgacagctccgagatgctgtgagacgtggcagaacgtggcgtggagggcccaagcacagaggctgtggcagaaggtgtggcagtggtgtgagggcccaagggtgtgcttgaagattgcacagaggagagggccgaggagttgaaagaggcaaggatggaggaaagaatgtccaactgttctgtggaggggccatggctggggccactgaccgagtcctccctagctctgagcagctgcgggagtggcccaagggcttctcgtgaggggtgccggctaggcacctggtccagctgctcccgagagttcgagctcctagacagagagtccagcggccgggatggcaagagggggtcccttgagagttgccgctggggagacaggggcagaggtgggggctgtgggtcaaggtcccgggtgcggcggggcggaggcagcgtgctcaaccactctcgaggtgcccctaagtcgagcgcatcccgtgacccgaagcggccagccatggcgccagggtagtcccgaggtggctgcctccgtggcagggtgctgccccgatctttgggctccagtcggcctggtgcagcatccatgcattcctgggaccctggccggctcaggggacgtagaacaggggcaggggcttcctctagtcgctcacggctcagttgccgccggaggagcaggtccagctgttctctagaagagtagcggctggctggctgtgaaaggctgcccgtgcccccgccagcatagatgcgaccgtaagaggcagctggcacagcacggtggcccaaggtggctgcacggcaccaggacagctcaggggcacctcgggtctgtggcaccagtgggtattgcaaccggttcttcaggatgcctgtgagaggaagaaaatggggggcagggtttgtgtgggagggggagggcaggcaggaattgctgagtctaggggtgtggcagcccttgggatccttccaacacagggatgggagcaggaaccccttggggagcagcagaggcaaccctggtggtcccagagaggcagcaggacaggggtcagagtggaagggcagtcatcttccagttgtggtcccggggcagggggagggcgggcaggtctcatggtgcaggggatggggcaaactccctgaggtcagaagaggggcagccctcaggtcctgacaatgcaggcctggctgaaatgcaggaaccccccgggttggacaggagcagtccccaggtccctgtgatgcaagggtgagggcagaaacctcttctccgggtccccataaaagcagagtagggggcagaaatcttccagatcagagcacgggctctgggatctgggtggggggcagggggaagcagctcctagggtctctgaaaaacagatgggctggggcaggagtggtcgcctgtggtccccctgtggtgctggccagggtagagggggacagagaattcccaggtcaggacaggagcagtccctgaggaccgtgaagcaggctagagaagcagaagcgccctaggtcagagtaagaagagctctcagtttgggatgaggaagctgcaatcccttggctcagggcatgagcagcccccagcgtgtctgcggtgtgggccagggctcagggactgtacctttcctctggcgctgggcccggcccagagaagtctcatccccactggtcagggccgggtctggctggttgttgttagctgcatccttgctggtgtccagccccaggcgcctttcagagccccaagtctgcagagcacagggggctgcctcgcactcccccagggctggccagtaggacaggaggtcattgccatccacatctgtggagccaggtcaggttacaggagcttctgggttgatcccagtgactcatgacccctgaccctaatgacccttgaaaccctggctgttctcattgagcagaggtgggaacaggagggtatctcctcagagatcaatgggtgggggtgactggtgagctccctccccttaactggaggtggacagagactaaaagttggggaacctgatgactgaggggtcagaaagaccaggatgaaccccaaccgcaggaaagatggggagctggagggataacaaatggggcatcccttggtcacccaaggggtcagagggcgcctggcacctttggggtgggtgaggagcctctcactctgggctgctcggcagagtggccgttggaagcgcccccgcgtccggccattgtcctcgctttctgaagatggaatggagagactcctctcctcctccaaggacaggtcactgtcagagtcggagtctgcgcctggagttgggaaagtcagaagtactttcagaggtaagggacttggagataagggaatttggagttgagggtctagaggtgggtacggcaagggggttagggttggggacaggaaccggggcttgaagtggaggtagcagcagaagggctgggacttatcagagggaaggacgaatcaggagtggactgggagaaccagggctggagaggtaggtgcctcctgaggcagggaccctgggggagatcgtcccaccccagtcagccactgctcccagtatggggtagaagaaaaggggatggggagagatcctctgcctccctcctccctgccccaggccccaactccaccagcatctcgatggaacatggccacgtccaggtcagtggggccagcatgagcctggaggctgtggtcagtgtggtcagcggctgagccatgtcgaaccaggacattgtccctggaaaagcaggagcccccccaccatgaaagagggatgtgatggggtgccttggaggctggagtgtctttgagtgcacagccagctgcgggtggaatggcatccctgggtgtgtgtggtgggaagcatttagggcagaggcagaagcagggccccagatggccaagatgggtggagccacccgccctaggacctggtcagccaagccctggtaaggtggggctggactaagctgagtgttccctcacaaggaggctcttcctctcacctgaggtagctgcggccccgctggctgtcctggtcctgggtccggccggagcgggcactgctcacagaggagacggtggaggcgcccagagtgatgcggatgaggccactctcctcaaagagagccgtgttgttgtaggccccaggtccctgggggtggtagggacagagtgtgagctaaccctgaagcagcctaaaactctggcttctcagggcccccatcccgactcaccagcccaggtgctggccttgcctcctcaggcgctgccttcctgcccagacaggctggcatccaggcagcccgagcatctgcatttaggacacagaagagcagcagcaccgccaggccctgtgggtcagcgagggtcaaagcagagtcggcagggatcaatcagggaccagtataagtcactgtgggtcagcaatggggtcagtcactgtaggctagtgtgggtcagtgaggagcccatgcgggactcagtaagggagttggggaaggtcagcaggggagaggatggagcagcaggagtggctggagtctgtaaggtcggtgtggatcagcaaggggtcgggagccttggtgttggtgaaggtcgatccaagatcagcactcagtctgggatcagtgcctaagttagagtcagctccaggcctgggggcagcagctagggccagtgtctggtctggggtagtacccagcctggcaaagttatccagtaagagtcagctccaggcctagggtcaacgtctgcctagggatggccccagcctactgaaggcccacctggttctggggcaagggaggggcaccagagtcacctggaggccgcagagtccagcatggaggtagtggaaggctaggatgctgtggttgactgccaggagcccaaagagccaggaggcactgaccagcagaagcagcaggaaggagctgcgaagggtcctgctgtggggacatgggaagacacaggaggacatgcaaggctcatgtaggactcatgcagggaacacgggaggacacacaggggccacacacgaaacgtgaaaaaaaggaactcacacgggaacatggaggtctctggaggacactgggggagatgggaggtcccacaaagaaacaggagagcagtcaaagagccatgaggacacgtggggaaaacacaggggtatgggagccacaagggagggcacggaagacaggtgggaacacacagggcagggggcaaagtgagccacccaggccatgggagactctggggggacccagaggacaaggagagacagcagggcagaagcacatgtggggctacagtatagcgagggcgccagagagggaccacaggtcagggcaggtgtgacttcattccttcatctagaacttggagcccaacctgcaccagggaagatctgggggccccagaccccacccaggagggacctgccatcctgagaagcccccttcctccagccagccaactcacagtgcagaggtcttcttggcctccctctgccctgtggagcaggatgtgcgggcagcgaggagaaacatggtcccgttcatctggacccacggccagacatgtggggccgggcagggcagagagagagagagagagagaggcaatgagagacagagagagactaagattcacggagagaggcagaaccagtgagaaattcacacatatacacacacaccaaaggagcttagcatcacagaaaaagaaattgggaaccagagagggactgagagagagaagcagagacagaggcagggacaggcaactgaatctctgaccccgcgcccccatctccatgccagttgaatgggggtggctactgaccagaggacagaaaaaatgaaggccgagcccaggaagcctgcagaatgccacctgaccgccctcagctgagtccactgcacctcctcccccaatgagggagggaagtacagagggggcaccaagtccagggcactcaccactatgaccaggacaacagggccagcaaagctccagatgaggggctcgtggactgagatccagcagaagtcagggttcccatagccctcagggtccaggcccacagcaaggccttgggaagagaaagggtaggactgagggtgtgtgttccagagctgctgaccagcccatgtatgggagaaagcatgggtgagggcagagcagcaaccccatgaatagatggcttggggtttgaggttgggggtcatgagcaggagtggggacagggtcaggggtcaggccatgtgatggttggaggttgggggtcacagccctcacccagcagcacagcagggacgccccagcccagggcatggtagaagcgcatggcgccgcggtccacgttgcgtggctcaacctgcatgcggtagaggtgcagcccctgcacgaagagccacgcgaaggtgctgaggaagaagtagtgcaggaggatggcgactgcagtgcacaccagctgagggcaggggggcgtgtcaggacctctcctgcctcacccacctctgacccctaccccaggcatctgcttcccacctctcacccctaaaccacaatatcttaccccagcatcctgctgaaaaccctggccccaacctgagcatccctgacctctgaccctgagttttggccccaggcctcctgggccagtagggtcatcaggacacaagttccctggccctgatcctgcacctgattgtgggtcctgtgaatccccagcaggaagaggagctctgccacccccagggcggctgccacattggcatggatcccacgcacattggacttgaggctgcgcaggctcagcaggatggctgcagtcagcaccagcgcagccacagacacagccacgaccacgtgggtgaacacagccagcagctccaggtcgccctccagcctctacagagacagggatggttgatgggttgttgggcagaatccccgtgtccctttgaccccccacttccttgggacactgaacacagccccacctcacggggagaggcatccatgaggaccccaaaggtccctgtccggctgcagcgacaccgtgcgtgggacccattcctgtgcaccagctcgcagtcccgtgctgtccacacaccatgctgctccgccctgcagccacagggcagttagacacaactgtgacccagtgtcaggcaggggtttgtgagagatcatgggaagggctgagggtgcctggagttggggtacagcattcctcatggtccgggttgcacaacagcactagtgggggccccaggggaaggctgggactattagttggcctcccaagggctaacgggaccaagggtttccagaatgggggtcctcacaggccaggtgggtcccactgcacacagatcgccttgctccgattcgctgtctgtagcaggcgaaactctaggctgatgggggactccaggattccccttaggaagttgcgtccgtggaacacagccacgctgaccaccggggagttcatgacggggttctgaggaagcctggggagacacccatctgggcttacgcactgctgacctccccatgctcagcctgcttgcctcaccccgtcttcatgccactcgccagggctgacccagggtctgggatgtccccagagtggaagctgtttctaagaatccctccagcttctgctgggctgctgaggggctgagcagctccaggggacctgcaactgtttgcctctgattgccctccctcctacccccatcagtcagcctgtccttgtctgtctctgtcagccctttggtctgtctgtacctggctcatggatccctcctgtgtgtggctctgtgtctgtcagcctgtggctctgtcactctgcacaactccagagaataagattcacacagaacccggcaaggatggggctccctggagctgtgctcctctctgtgtgttgtgaacctacgcatctacccaccaaaaaaggggctgccaggctgagaagttcgtaggaagctcaggggtgaggggcctgagtacctggcacctcggcgttctgcctggaactgggcagggagcagtccccctaaggtgcggtaaacgaggagaatgataatggagatcccaggctctggctctggcggggctggtggggggaccacacttgaggtggtggagttttctatgctgctgcttgtgggcagaactgccaggagagaaggaggagcttctgtcagtgacctttgacccaaagcacccaccaacccagctctgaacccgatcaagcatgggggtctcttccctgcaggagcagaattggggagtgcagggagcatgaacccagaaagtaacagtcaaggcctgggaggggtcatttgtgatgagggagaggctctgacaaagtgaaggtgtggcaaggtggacagtggaggggagatgtgggagggagggtggaggggagatgtgggagggtggaggggagatgtgggagggtggagggtggaggggagatgtgggagggtggagggtggaggggagatgtgggagggtcgagggtggagggtggaggggagatgtgggagggagggtggagggtggaggggagatgtgagaggcagggtggtgggtggaggggagatgtgggagggtggagggtggaagggagatgtgggagggagggtggaagggagatgtgggagggagggtggaggggagatgtgggagggtggagggtggaggggagatgtgggagggtggagggtggaggggagatgtgggagggagggtggaggggagatgtgggagggagggtggaggggagatgtgggagggagggtggaggggagatgtgggagggtggagggtggaggggagatgtgggagggagggtggaggggagatgtgggagggagggtggaggggagatgtgggagggtggaggggagatgtgggagggagggtggaggggaaatatgggagggagggtggaggggagatgtgggagggtctgacactggggaggtctagaaaggggaaaattggcaggagggcaacatagtatctggttggggggacagagagacaggacttggcccaggggtcccctaggggctctcaccttcagatggggatggccgtggggactgggaaggcagcagcacatgggtgtgaggatcccaggcatcctggcctcgaaagaggttgctatggtagcgagggtagcgacgggccccccggggagaactggggtgctccatgcggtcaatgctgagcactacccaggagaaagaaaggggaggcccatcatggacctcttccccctgccaagggttctactccctcttactcgcatcccgcacctgagtcccacaatctgttttctgtgctaccagctcggagcctgtccctacaaaacgctgagggcggtggctgagtctcctgccattaacattggcattgatagccacagcccctcagaccttcaggtacctgccctttcatggcccccctgctgtgccccgccctaccccacccacaacgcactgatattaggcgtcaccagccccatgggattcaggtatgtgagttccatattccttgcgagtgtggctgcatactcctccaggtgcctcaccagtcccgcgctgcctggggagcccccaggggcccgctgccccagcgccgcccacaagtcccctgtctctggggcaagcagtgcagagccggcccacagcagattctgggaagacagagatagaattgggttcagccaggtggtgaggatgtatgaggggatagggcaggcatgagaggtctggacaggtgctcagaggggctccaacaggcaagggggcggggctggagaggacaaggacagagggagagcccaggaccttcacttcccaagagaacagcaggagcctgagctggggatccaggggcaggaggctgggagctggggggccaaggcactgagaacatagggcacagccccacctcattgaagtgggcatcctgtgtggctgtcagcccgaagccctgctgatggctctcgaaggccagcaggtgggccagcaggcgggcagtgactcgaacatcttggctaaaatagtggtcagtgtggccagtcacctcccgtagccgctgagccagcttcttggcctccatggtatccagtgccgtcttgttcagctctaggccatccagctgccaagacaaggagatggttgctctgtggtcccttaggccttcctctaaagcttcacagggagaaagccttgccagattaaagggcaaccaggaaaggctcaggagttcaagggctagggtgtggtatctggggcccaccacaggccaaggaaggtcttaggttgcaggaaaaggtctgggcagtctcaccagcagactgagctctcgaaaggcaggggaggtacagttgaagaggtcgggctccagccaaccctgggcctcatcacacagccgcacagcagcacctggaggcaggcaacccctggtcaggcctggggcctggatacctttgctgaggagataaccgcagcaccctctcctatgctgggggaatccctgaggcagaagtcagagtcatgagcatctatagctgcacccctggaggtagcggcccaagcccaggtaggccccagctgcttgtcaggcaattcctgagagggctgtagaccattctcaaccagcaaccacacaaagcacaagggtggggctgcacacactcacccacgtgggccaggactggctcatagatgtgctggttcacacagacacacaccaatgctcaccaattacacacagatgtatggaccagaccagtacgcagacacacaatgctctctcgcacacacacagacatgccaacacagaagagggcttctaggaacatccagtgaaagtcaggtgggaggattctcacacaagttttaactgccccagtggttactttgctgtcatttctctcccttgtctctggggttgggatggaggttgaatgagaattgacttggatcttaaaaaagtttgtagctaccaacaagagagagcctaacttaatcacagaatcccctccccgcaacaggttcacagacacgtgcacaggcacagagatacacacgtgagcatgcgtacacaaacaatctctgtccagccactgcagagacctcaagcagcagggagtgttctgaggggacctcaggcagtggggaggggcccccaagcagcaggaaggagctatagggtcctcagactgaggagggatctttcgtgacctcaggcagtggggaaagttctatggggaccccaggaactgagaaggggtcagcagggtcctcaggcaatggggaggggtctctgaggatctcaggcatcagagaagggcccctggggtactcagatagccagaaggggcctgcagggactttaggcagcagggaggggtctgcagggacctcaggcagcaggaggggtctgcaaaagctctggtagtgggagggggcagtgcacctgagcaaacacgtaccccttacctgcaccccgcaatcctgcccagaagccaagagaaacagatggaggctcaatgagggtgtagggaggggcccacatggactcccaccccacttccacctctttgcaggaacaaagccacccaatttaggaaaagacatggctctagcagtcagagtacaggcccacccccaccctcagtgatgtcctttccccccacatactcacccagggccccccggggacagggcactgtggccaggacgccaaactttgtctggggccaccacacaccagatctcagggacttagggcaggcatcatagagcactagagagagaagaggtgctgagccaggcagtcagggtacagggcagttgacagccacacccactgcccctccaccaccccccacaaggcccactgcccgccactcctgctggcttctcaggagctgacctgtcagattctgtgacaggtcagcaaagtacttggggcaaaggtagggttccctgggtgtaagtggtctccctcaggagaagcttccagagtccccaaggagccatgtgtgccactgacacgtgatggtggcacactggaaccagccctctatgggtggagctgggtggagcctgctcaccccggcagccgctggctgtcacctctgcgaagggactgtcacagctgttgcactggcggccaagggctcctgggcgacaggggcactgcccgctgtggggtgcacatgagcgcgaggtggagcccacagggtagcagtcacatgggaggcaagagtcactgccccgcggtcggtagtggaactcctgtttgaggatgggccaggggcctgaagtcagaggtcagggcttggggaatgagtggaatcaaggataaagggtcaagagaacagtgctcatgggccagaggacacctgggtcatgcgtgaagccaagggaggggtcacgggtaaaggatgagagacagcaacttggtcacaggacacaggcaagaggttagggcccaagtcaggtggcggaggtcagcaagctggacaggaattgcagattgcgtccaaggaagggttaaaaggtcaggggccaggcgcaccttgcagtgacactgcccatttgtcttgttgcagttgggatcaaaacctttgtgaacatcacagttgcaggggccacaggttgggctcccccaccagccccgtgggcactgctggtccatcctgggggtgcagagccaggtaagatgcctccacggtatcccagtgaccctccctgtccctgccaggtctccccatcgcctcagccccagcctcttacctgtgctcacagtggtgcccgaaatagccacccacacagtcacaggtatagccatggggggctcctggcaggtgccggcatgatccctggttctgacaggggttcaggaggcaggcatccacacagcctgggccgtagtaacctgcagattgggtcagaaagctcaggatcctggtcgcagagcatggaaggaagcaggcacccgtcccgagtccctgcctccttcaggttccccagtcttcatcatgggcccctaacgcctgcccaggtcacccttcccccaaccctctcaaggctcacctggctggcaggtgcaagaaaaggtctgccagaggtcccggcagtctgcgtgaggtgggcagggcccagaggcacaggcgttggtcacaacacagccaggctccgcattcactcggtggctggggggtagcagggccggggagccagagggtgtggagccgagccacaccccctgtggacacacagccagcaaggggtgagaccatgttaaggcacctcagcctcaagtactgcagagccagccacccggtctgatgatccttgacatgcagtcttctgataccctcaaaaaacccaggcctcaaaaatatccccaatttggtacccctgtgggaccctaattgtgctgtttctgacacagattcctaaaggcccttgataatccaagctagactcccacctccaatgccacagaaaggcttgacctagctctcaactctgggtcattcaccccctcgcaccaacccccacttgaatactgcctttcaggtcccaaggagcccctgacttctgacccctgaccctaatgccccatatcacattcccatgctgacccccacctggatgcagccaaccagaccctgaggagcctcctctgcactgccggggggcaggcctcccacgtggagctgctttaccttcaggccctgcagctcactccccaccgccatggtgtcctggaggaagtggggcagtcagcactgagggagaggggcctgatgaacccctgtcatagcccagagtcagtcttggccttcttctagcccttctaggctgccccctccctcctggacccacagtagaccttaatattgcttgattttgaccgggggtgggtagagactggggcagagactagaaggggcttctaggaatcaggcaaagtgctggctacagaggttccccaagaccaggccccaaatctggcacaaagagggcttgagagtggaccaacttggctggtgggtgggctcagtgcaaggatatatggtggggaactaggggtagaacatcagactcagtgcagtggagggaactgagaggagctggactagaggtggggtcaaataaggcggatctggttggaaggctgagaacagactaccccggggtcagaggccagacctggaagaggctaaagtccagtgagaccataaggacatggtggccccgccggccacctggttcctcctgcaactccagccgcagatcgtgccaccggccatcactgacagtcacctggtccagaaggagatgggaagcacggcccgagcccctggtcactgtcacagacagtaacccccgatctagctgtgggcagagatgcatagccctggggttagagccccatgtgggctgggacttggaggtgagatcagagggctcagaggtcaggaatatcagaggtcagaacagtggggtcaaggttatacctggcacaaagggcactgtgccaggggacatcatgttgctgatatggggtcagggggcagaggataggaccaggtgttgtgggtgggttggtgcagcttgcataagagagagctatgctggagccctgcacctgcagaggatataatgatggaaagagaatcaagggctagggtccagagcagggtcaagtgtggttgggacacctggcagaaaagtatgctgtgtgaccaacctgaacccacaagaatgtcagtggcggcctaagagactgagaactgagggtataggggtgagcagggtggacacacctggcaaaggagcgtgctgtgtggcccagcctgcacttgcatcaggaccccctgcgttgcccgtgtccgaaatgccagccccaggtaccatggcacagacacagccatgtcacttccaaagttccagctcagtgtgccgttgccacggaaatggtggggatgggccatagctgagtggataagagaaacagggttacagcccctgccccaggaacagatctgaccctgcaggcccctctgccccatgctgcccacttactaagctgacagtctttgccgccgaagcccacagggcagtcgcagctgaagctgccccagcgctccgagcagaagccactgttcttgcaggggcctgagtcacaaaagtgtagcttggcttggcagcctgggagaggaaagcacatggcggacatgagaacaagggttggggggcacaagtgctggacaggactttagtgtccagaggggctgaaagagaccaagatctcagccccatttcccattttctttcgatgagtggggttggtaagagtcaggccctaaaatctgggctgtagcatggtgcttgccaccaaaggagactggcttgaagtcaggtatggagtcctccacttcctccctatgatggggacagggccatgggctaggctggtggaagcttcaggcctacctgccatggtgccattatttgcgacaaaagccgccatgtccactcggcggccatcaatgtgcaggtcccgcatacagccgatgaagtccttatgggatacggggaagttctcggggaggttggggacacctcccagaagaagagggcccgtcaggtccagggacctggggatcaggggtctgggtcattggtgggactggggccagagtagagttgctcctggggggccacaggaagcaggggggtaggacccagagggtagggtgattgagggaggaaaataaggccgagctgtggaaggagttaggatcttacttcagttggggtgcaaaggggcacccgtgatgggccgatggtctggggaaaggtaggtgaatgggggttgagagctatgatgaaagaatgaggcatctggctggctggggaggggatggagacgtgaagactctgggggactggacatgagatgaagggactcggaggggatgtgggacattagtgagactggggtggggaggtggaggctttggaggactgcctggggactgtgtgtgggaggagggagtatggggtggaatacaggattgggggctagggtgagtaggctttcagggtctttgagaggagaggggaatcttggtggtttgggggaaagatgggagagtttggcaggatgggatgaggaatgggatgtgaagggttggagtgggctttggtaggcaggggacaaggggactagggggcaggggcctcacttcttggagcttgtttgcacaccagcagccgcgcatgagtagttgccaatctcagcaccaaactgcagagccacggccacatcacaatcatccacgcttagcacagccaccttgtccttggaggggccctgtgcaccccctagggcatctgtccggggctgaagacgcaggcacaccagtcaacagtgcccccagtaacccctgaggagcagaagtcagcatcccaactcccctcatacccgatgccagggatggcccccaccttgttgtagtatctcagatgcactgtatgccattgcccgtcactcaagccccctggaactgtggggctgaccacggtgttggattcacctggaggggagatgcatgtggaatcatcaggagcagcggagtcgccccatcccacccgtcatataagcacaaccattcccagggccaccctggatgcatcagatcagtccccccactggtgaccacaatggctggctcagagtgcctttgaacagacaggagaaacagacttcttggagggagggaccttcccacagggaatggccaaggagctaggtcttcagggcttgcatggcgtggagtgtgtgctcaggtgcacagtgaagcaaacctgaggggacttgggccctgcgtcctccagcacacacgcaccctttcgccgtcacatccggggcacccacccgtggaatatgtgagccgcacttggccagccacgagttccagggccaggaagtcgtgcttctcgttcaggcgcccgttgtagaagagcagcccgctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgcaaaagtctcccgtgaatccgggcgggcagcggcagcgcaggccagcgatgggctggatgggtcggaacagcgtggaggccgaggccaggaagggcgcggacgagtcaaagcggagcacggacacgcatttcatgtagttctcacagggctctcgcaggcacacgttgtcgtcgaagggcagtacgtcgagcagggagcgagccgccagcgccgcccggcgcacgtacaactgctcctgcagctcctcggagctgaaccagggccctgcagcgcccgccccggccccacgtggagctagcgccgagaaactcacattgagcacggtgccccctacgtctgtgtcgttctggatgttgaagatgaagacgtcctcagcgggcgtagcgagcaccgcagccacgccctcgaggaagcggcccagcagcggtgacaggaagcgctcctgccacatgttctcaaggcgcacggtcaggctgttggccagcaactcctccgtgatgatgaccacgcgcagcacacactgcgccgtcacgctgtgcaggccatctgcaggcgggggcaggggcagtggtcatcctggggacagtggccacccctccctgggacacaagagggctggggccagcgatagcctaggcccccagaacctctaagtcagcaggctgaccccaccaggacacaagggagtctggggctagtgaccaccagctcccccagcatcaaggtgtcaaaaagctgctgcttcctcccccaatccccaatacacggaggggtctgggccaaggatcaagcaaccccacacagtgcccatgggttagcaagtcactcccgcaacagcactcaagtaccctaagtactcagtaacccacacttccccaagttatcatggtcagcaggccaccccaactcaggacacagagaggagctagggccactggccactcattcccagccacctttcccttctcccctcctccagcatagcagaaccagcaaaacatccccctccagaaaagaagggttccagatcagggatcacctatctcctatttttggtcagcaaattgctcttccatgacactagaaggggccctggcccagtgaagactcaatgccatcctccagaatcctgggttatcaagctccaggggggtcttgaaccctgacatacacacacacacacacacaccagcattcttgagttagcagcctgctcgccactccagacctgggtcctgtggtttcacagtgaccaccccagagatgaaggtgaggtgcttagctgccttgttcgtcttgtccccacaccctagcacatactgggtggtcaataaggatagactgttgagtgagttgagggataaatgaaggttgtgccttctcaggcagtgccaggagtccctgctccagaactgaggaatgagcaccagtgaagcctatttcccaacctctgcagcctccagtaggcagaacttcaagagcctctcccacctgcactctcctattatggaggggtttctgaaagactggagcagatggggcaggaaagaggcaagtggacctctggacattttcccaaaggtcagggtctcaggccctacgaagccactgtccacctgaagcttccatagtaagctgctgttcctgaccactcaagtattggtcatttcctgcacagatagggtaagcgtcagactggacccaaagtaacccttcgtctgaacatgggcatagtgtggactgactggcccatactggctttgcctaggacctccagaggattaccccaggacctctgaccttttatcaggaggggagatatccctaggtagcagacagttctttacaggctttatggggtctgctagatgccttggaatcactgggattctgtggagattatccaggaacctaagcagagtccttgtgaggtctgtggcagatcttgtagggtgcaggaaccctacccttaaggggttcttggaaggcttagaaatccctctttggtttgaggtgccctgtggagtccctgaggcccaacaggttggtgtcactgggtcacttgcctgccccctgcccctcacctgtgacagtcaccaacatggaggccaccagtgggcggttattgtctagctttcggctgagtcgcagctccccactggtctggttgactaccagcagctgcagctcattgccacgctcaaaggagtagaagaggtggtcggagacatcggggtcataagctgggatgcgcccaataatgcccgacgggaaggtgtctgaacggttggatacatagttgttgaagaggatctggaagttgttgagcacagggctgttgtcattctggtcaaccaggcggacgtgcacagtggcccggctgaccaaaggagcagatgtggcctgcaccacaatcacatattcttggcgagcctcatagtctaggtcaatgagtgccgtcagttctccagagaagatgtccatttggaacagctcagggatgttcccctccacgatctggtacattatatgggcattggggccttcgtcagggtccactgcagtgatctgggccaccactgagcccacaatgctattctctttcacccgcacctcaaactcctcagctgggaagacaggtgcattgtcgttcacatcctgcaccatcacctggatactgactggagtccggagtgggggcacacctctgtccactgcgtaggcagtcaactcatacactgatactgcctcccggtctagccgccttactgtacggacaattccagaggtgggctcaatggtaaaatctccatccccatcttcaccattctggaaagtgtactggacccggccattggcatgagcatcccggtcagtggctgagatctgcaggacactggtgaaaggtggggcatcctcagagaccagccctgtatagtgggaggccacaaattgtggagcattgtcattcacgtcattgaccatcacctccacataagtagtgtctgccttctgtgggatgccattgtcccgagctgtgatagccagggtgtaggtcacctggtcctcatagtctaatggggcctgtaatgtaatggctcctgagtctgcatcaatgcggaactggggcaggttgtcctccaggagataggtgatacgagcattctcacccacgtcatcatcagaggcactgatgaccactatggtgctacccattggccgatcttcattcacactcactgagtagtgggcactttgaaagaccggccgatgagtgttggcatctgtgatgttgatgtgcacatagcagtgatcatgaagggcacggtcagatgcagttagtaccagcttgaagtagcgttcctgcttgtagtccagtggcagagccagagtcaccagacccacacccccctgggtgctgatggcaaagcgattccgggtgttgccgcctgtgatctggtagctgatggcactgttggcatcacggtctactgcggtcacgctgaccacactggtgcccacagctgcatcctcattcagtcgtaggtggtactccttcattgtgaactcaggccgattgtcattaacgtccagcacagtcacggtgacactggctgaggcagagagtgggggtgagccatggtctcgagcctccacaccaaagaagtaatgctccacagactcacggtccaggggaccactcacagagacccagccagtggcgctgtttatcacaaaaggagtatcaggtgccacaccagttagggagtactccaatctggcattctccccatggtctgcatcgactgcctgaatgtggatgactgagtgacccaagggagcattttccaagacagaaacttggaagggcgtgctgacaaaaataggaatgtggtcattgatgtccaccacctggatgctggccaggcccgtgttgttggacagcggtggccggccagcatcctgcgccctgatgcgcaaggcatactctctctctgcctcgaagtccagaggtgccaccacctggatctcgccagtgaggctgtcgatggcaaagtgtccacggctattgccactgatgatgttgtagtgcaccaatccgttggcgtccttgtcccggtcagtggccgtgacgcgcagcacgactgtgtgggggcgcacatcctcgcgcacctgcgccacgtagcgcttctcgctgaactgaggagcattgtcgttctcgtctagcacagttatgtgtacgcgcacagtggccgagcgcggcccgggttcctggccctggtcgctggcttccaccaccagctcatagctttccatgtgctcgcggtccactcggccgctggtgctgatgaggccggagcgtggatcaatctcgaaggcggcggcagctgcagcgcgcgcagctggcggccccacgaagcggtagcgcaggttggcgttggggggcgcgtcgccgtcagtggcacgcagctgcaggatagggtagccctcctccacattctcgcgaagggtctcccggtactgcgcttgctcaaaaaccggcgagtggtcgttgcggtcggctactgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgct

SEQ ID NO: 957 - DNA, 87 bp, Homo sapiens
ttcctccagccagccaactcacagtgcagaggtcttcttggcctccctctgccctgtggagcaggatgtgcgggcagcgaggagaaa

SEQ ID NO: 958 - DNA, 314822 bp, Homo sapiens
ctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagaggtaggagctaccccggggctttgtatttgtgtccgtgtatgtctcgtgtgtgtgtgtgtgtgtgtgtgtgtgtgtgtgtgtgtataaacaacaggacagcgtgtgcgcagcgggagaggatctgggtgcgaggggcgtggtgatgacaccacggtgcctggctggacaaatgcggctcaagttgccaaaagcactgctggatccagacttcttggtgctgagggtccactttagggaaaggagagtcatccacagcatatttgttgctacttaatgtgaggttcccaaggccggaacccagaaaacactgtgctagtttagcaaggagaattaatggtatctccagtgaactttggtcccagaccccagtgcccttgttctagggtttgagctgaactaggcacagagaaggaagacaatatcttatgcttcattaggcaaacaggctatatctgcagagcgagctcattgagggtgaaggaagctgtgactccttcccatcgccttcactctagggaggaatccgaggggcagctctgcgcttctttccaactctatcaactttacaagtgcaatcgggccaattgacaggagcgcctcgctggccgcttgttttcactaggatctcagagcgggacctagatgtccctggcctttgcagaggtggctatgcccgcaaaggaggcggtgctttgacctcacccttgcgccctggcgggcttaggggtgcagacgtcgtcctgcttctagattcctttgtttgtggttcatctggaagcaggagatagctagaggccagttcagttccctctcccacatttctgtggcacccgggttgtgcgctgaggcccaggtttcctggaggttaggcaaagcttggctctggtccttgcgcattggcccaggcaaagtgagaggcaaatgtggctctagcgccatgctccaaagaacactgggccaatcaccccatctctcaaattggcggtttgtaacgggttcattgctgcatactctttgttttcccttttggcagcatacttttcttattcttaaccccttcctgtttttgattacacccctcccccgaactcccatacaagttttcccccaactttcttctctgccctctgatctctgggtaggctgtagggaactgcagggactgccattctttttcaagcatttgcttgttctttggcctttgttttgggtaaacattgagaaagctttcaactggatatcttatccgcattccttacccatcactctgctaatcttttcatgctactgtgcctacctaccttgtagaaccaactttgccaagaatgacaaacttagtagaaaaactcatttggtagaactgaaatcagtttttgccattttccatccactctagctttttttatattgttttttcagaatgcaggtttctcactggttgtaaatttgtaacctcttgggtagtgtcggggtcccctccccttggtcacagagtaagtgaaagatataaaattaattgagggaaaaaaggctgtgtacatgggcaaaaacatatcttaatgacaaagttgccagtataatggctgatttgtcttcttggcttgaagcagactatctgtattttcatttttttgtgcctaaattcaatgagggtgaaggaagctgtgattccttcctttgtaaatcatttaacaagcttatatttattatatatttttatattaaaattggtggctggtgataatctgcttctggtcttagaaagcacagttttaattttattaaagatttggttgtaatagtaatgtggtgaaattttgggttgtggttgtctgggtgtgatgcattggcatagtttcagccttgggctaaaaaggtgtaagtgattgggtgatttaatttttttttcttttaagttgatactgtaaaacctgaaagttgcagaccaaaacacttttcaggttgaaaaatttctagtagtatcttgtggtaaatgtaccatccagaaaagggacacgataaatgcttttattttactaaaagtattttacacgtacatggcttgtcattaaattttttaactgcaaatgaaaagatgataatctttagccaaaccatgaaatacttttctttgtgccttacattaaaaagcatgctgtttgcaaaataattgatattatcagtactctgaaaaatagagtatttgttctgttcataatcccttatcgtatgtagccagttagttcattttggctttgttttagggcaaaataaggaaagtgctacaaaaggagttacttaattgctattgggagtataacagtgacaaataatattagataatttctcttgctttttctttatatatcattcaaaatcctaccatctaattcttgtgtgttgtttagctcctttaacattcaccagaggagggtgccactgtttgattttagtatagatgatgttagctcctgtcacagaagaggaagctttttctgaactttctattatttatgtatattctagctctagaatggtgcagacgataaatgaggagtttaattttatttctaataactcacactagtaagatagaccatcaaaaactagggcccgtctgtaattgtagtactctttagatgcagaggagacattaccttgtatatccttgtacatccatttcatctgtgtatatcaatttcatccctcaccctttttttttcttttaagctgagatgctgatagctggagaagttgtgaccttcctaaggctatgtggctagttcaaggccttcagtttgttgatctctatatgaaaccactggacaaattggcttgaatatttacctagatagatggtgccctggggatacaagggtgaatgaaatataacccctatcctcaaaaagtttcagtctagtgagagagatagacctctacaccaaaaattatagtcatggtgcgcttagagtgttacggtgacacagaggagggacatttaaatcagactggtaggtaggaaggcccaggaaaaaacgccttgaaggtattgtttacttcaagattagcagcataggttttgacttgagatctggctttgaatctgtgctctgctttattctagctgcgacattggacaagttgctgaaacagctttatctgggagtttattatctaaaaaatagggataataatgcctgtaaggtgcaccttcatcagttgtattataccctgtctagagaagtacctaaaggagagaaggatatggaagaggaaaggccaagaagaccaagaagtctgcagtgctggggcagcactattcaagggagagagactcttcctgtgtgagccacaacttttatctctatgaagatgtatgtagtgcagggataatttattagctatcccccaaactctctatatctcaaggttctaactttcagtggactcctgattactaattcaggatttcagttatccagatatttgagaaaagtgtgtcatggctttaggtgtaaattttcttactagtcaaaaggaatattctctatgattaattaagaaattggtattctgatttgtacttcagcctcttatgatttgggttaccatgagttagttctcttgagcatatttaactgtgaattcttcggcaaagatatgtctctggactttttatgctgaggaccagactctctagggctgtggcttcttctagatggatgagattttaaagagccttatctcagtggtcctacaggccagcttcctcccttgattctaaccatgatactgtgtgtggatggttcacagtgtgtgtatgtgtctaaaggtatggcagtgattgtcttcttatataacaagattaaaacaacaaaaaggtaaaaaggagctcgttatataaattgatgtagaaagattattttaagataaaaatgatttttgtctaggaaaatcattgtttttgtgcttacttgtaatttttatctacaggcaaaaggtggttttttttttgttttttttttttaataccatctagaagaaatatcaccaaatcctttggcacctctatcaatgttcatggctgaagcctagctagaagaatagattgttatgtgctccatatgttcatgagcactactctattaaaggtcttatgtatcttgataattgacacacagcttggccagtggttaaagcccagagttccacattttgcatgagggagaagccatacttcaagcgcttgccagggactgcagtcttgaggctcagcacttctcagaagctcagaaaataaactccttatggagggttgcctgaagaatatatatatagtcttattctttagatcagtggttcttaacttttcttgagtcatgctgctctttgagaatgttatgaaactacagacatattccccagaaaaaaggacatgcatatcaaattttctttgtagtttcagagacaagtggatgcatgaagcctctgaatttcagattagtctagatagaataaaatctgtttttgatgcatctagctctgcaaggaactgtgtatctgaaccccttgcttggccctcctgctttcctctccatcatttgcttttattgaattgtttgctgtcatttgcctgtgagggttgtttggaggaatagtctccttagctctgagaaataactgcaagaatgttgttgaggaaatcatttattatattatatagtgtcattttaatgaggaccaagggagaaatagtactctattacctatttatcttaaggatgctgaattatgtaactgattgggccatcctgggtttgttggctgctacaagtattaagagccaaacgcctgacctacctctagcaaatgtgcagacttttatggaatacattcatctggtacatgaacctcactcctaggacagtttatctttcctacactcaattttcctttatcccatttgtattagcccgttttcatgctgctgataaagacatacccaaggctgggaaatttacaaaagaaagaggtttaatggacttatagttccacgtggctggggaagcctcacagtcatggctgaaggtgaaaggtgcatctcacatggtggcagaccggagaagaagagagcttgtggagggaaacttccccttatataattatcagatcttgtgagacttattcactatcatgagaacagtatgagaatgacctgccccaatgtttcaaattacctctcactgggtccctcccacaatatttgtgaattcaagatgagatttgggtggggacacagccaaaccatatcaccatttttctcttctcttagatatgtcattttagcttgtattatatgtatttatgtaagtttcattgactccttctgaaataagatacacttctgaataaataaattatgactggcacagtgaatgatctgcttttcagacattatagctactgttagtaaatgttcggctttcacattatgatgtataagaggcctagggatttagtatggacaaatgccttatggtttaagagaagattctgattattttggtttaaaatggcacattaaagtttctgcaaaaaatttttttttcaatgaaaccctccttcctatgcctgtgcttaaagacctttttgtatgggaatgtaggaacctgactgctgaccttgctgcgtcttctgaacaggttgttaagaaattcagttcaattaagccaacattttctgtatagtttggcacctgtgaaaagcagtgttatgttctatgtgatgtctaaagatgatttggtgcattctgtgtcctcagggagcattctgtctacttggagagatgagctttttttaaaaaaaatagcagagttacaagatgcctgccacctacaagtgtgtgatggcttgactgaaggagcttgggaaattttggataattttgaagaggaactgacatttaattgtatcctagcatttctgtagacagcgattgggtggagaaaggaggggaagatgatattagagattgaagaaaaaatatggaaatggtacagaggaaataaaatgcaggcaccgttggaagaaggcaggtagtcttatttgtcaggagtaggctttccccaacggtaatcattctagaagctcattcattatttttttccatattcaagtaccctctgtgttttgatatactaaacttatttttaaattaactgtttttttaatgttaagtatatttatttgaaaaagaaacttcatatcagcaccgggagtggaaaaatccatgaaatgaaattcttggcctttaacctgctgagatgctgtctccatcttgatggagcagaatgattctaaaaagatttatctcctagtctctggttgtctctagagttcctctatcctcctccccttgcttttttatgaggagaaaaggtggcttttaaaatttaattgccagccataatttgaagcaaggcagcctgcttgctccctttgcaggtggagagcacttccagtgatgccactttgtgaggagctcaggtttggagtatccctttccgctgtgactcatgtggcagagaagattttatttgtatcatgcctccatgggaaacacagagttatgggcagtgtttcagcatagattccatcctcatttttaatgcaggtaaatgggaagagattataggaataaaactgatatttttctagctagtttaaaaaaataaataattcacaactaaggtacttgaaccattatggataacacattgcttgtgacataacttacaatgacaaaaatataccagcatgctaggtccccctgttgagccatggcctggggtttgggatacacacaggtgaggagagtgggagatgctgctggaactattagcactattattgaagctgtgctgaggagcctgggccatgttctgtatatattggagaactactgtataggaatggcataaattccatgctttagtaatcctgttcctccaaactatgtggaggattgatttgaactaacaagatagaagtatggggggagagggtcaattgggaagcttgagacagagcagtgaagatgaaactcaggagcgtgggccattgttgaaagagagggagaggatgtgatgggagtggataactcttgaggtggtaagactgatgtcagggtttgcataacttttgttaccattttagtaattctacttaatgaatgtcaaaataaatctacagcaaagccaaatatattttaaagtaaactaattttaatattataaaaataatatgactccatgatagatattacagaaaagaagaaacattcctccaaatctcattaccctgtcacatctactgttacatttttggtgtattgcttgctggtcattttgtttgtttgtttgtttcttttttagggggtggggtgggcaggatctggctttgttgctgaggctggattgcaatagcaccatcatagcttactacagccacaaactcctgggctcagatgatcttcctgcctcagcctcatgaatagctgggactataggcatgtgccactgtgcccagcttcaccttttttaaaacaatatgcattttaaatataattttacataattataaaaatatacatatgtagatttaaatcttgtttttctttgtataattctataaacatactgtcattttgctctataatgctttatatttgatttgttatttattttaattctccctctctctctctctctttttttttttaagacggtgtcttgttctgtcccaggctggagtgcaatggcacgatctaggctcgctgcaaactctgtctcctgggttcaagcaattctcctgtctcagcctcctgagtagctgggattacaggcacccgccactatgcccagctaattttcatattttttaatagagatggggtttcaccatgttggccaggctggtcatgaactcctgacctcaggcaatctgcccccctcggcctcccaaagtgctgggattacaggcatgtgccaccacgcctggcctattttaattctttatatttatattttgagtgtattttttagtgatagagcaatattttattgagtagatatttgagaaattactcaactgcttccttatttgtatacacttaggctcctctaacttcttaccattgtaaataccattgtaataaatatttttgtgtttctactgtactttggattatttctctagggtgggtttccagaagtgggatttctggatcaaaggaataaaggagaagccaccattattgatggtaataacaattgctaacatttattgagtatgtataatatgccaggcagtatttataaagtactttacatatgttatctaattttaattctgataagagtttatgaggtaggtactatattatcccccattttgtaggtgtagaaattaaggcactgagaggttaagtaatttgcccatggtctctcacagcttgtgggtggtgaaactagggtatgaaactgccattcagacttagagctccctgtctccaaagcctgttccatcagtttttggttgaagccctacagatctcctaatttggtcaatgaagtgctgataacattgttatgtggacactgcctagtcttctcgatttgcttagtgggactttggttttctcatatgactgtgacagttgtgtctctgtgacaggtggtggtgtttttgaaaaccctatgctgctaaccttggtaggttgatcttgtaattacctagaaaagtcctgtagttaaaaaagattggggttagaagtcagagcaggtgatgcttcacattcaaacatctgttctaatctaccctgcttctttgctggcagaatctctatcccactacagaaaatctgcaatatttttgcctgttggctcatgaaaggctttcatagaaattatagtggtattagcataaccagtcacaataaacaaaaatgacttatattttattttacttcagagtaccaaaggcttgactttaggataaatatgtaggagtgtggatgtgtttgcataacttttctttatattcaagcttcgactttttttttctttttcaggatcaaaacagtttcctattgcatatattgttaattttaagcagcaaatatcattttctcatttgtttataatactgagttggtatgtttagtttgagtggatgctaatcctgcgttttcattctagaaggctacttaatacattattttcttagccaaacttaagtcaagccaagctttggttatggctagttataatctgtttttaataggaatcctcaaagtcaaagtttaaacaaacaaaagaagccatccttttcaaaatagttattgtaatgataatcccttttatagctttgttttatagttttaggccctcctctgaaaagtacagagcatttttattaatatttatataggcaaaaatcatgcatattgataaactaatatattttcaataaagttgaagtctatgctatgaaaagctgcttaaaaagtgaagatatatgatatggtctgggtctgggtccccaccgaaatctcatcttgtattgtaatttccatgtgttgagggaaggacctcgtggaaggtgattagatcatggggggactagatcattagatctggggattagatcattagatcattagaccttcttgctgttctcatgatactgagtgagttctcatgagatctgatggttttataaggggcttttcccctctttccacttctcattctctctcctgccactctgtgaagagatgatttccactatgattgtaagtttcctgaggcctccccagccatgtggaactgtgagtcaattaagtctcttttctttgtaaattacccaatctcaggtatttcttcatagcagcgttaaaatggactaatacaatataatattgtacttctgaaaaaaaaaagaagctacaagtcttgatcacttgatctctctggaggtttttttttttttcccttctctttctctgtttcttgataatagggcccaattgaatggaaccttagctgcttccaacttttctggaattaaggagggccttgatactcgagtctgttaagattgagacttaacctactttcttccattcctagaagacaagagagttcctgtctgccactgggcgtgaggctcctgaaggcaagtttggggccattgcataccatagtgcaagatgtacaccgtacagtgttactaggtggagagacattattttctaatgtgtgcagagctgtctgctccccaagctaggcatctatgggtctacaataacttggaaacttttctagtttgtacagaagctaaaggcgccgtagcagtaggctgtatttctgagactcacagactttttaccataccatccaccattagtgccctccatgtcctgctcttgtatgagcagctgacagatgatgatctttgtgtcttagtttcttttttttttttttgatataggatattactctgccatccaggctggagtgcagtggcaccatctcggttcactgcaaactccacctcccaggctcaagtgatcctcccacctcagcctcccaagtagctgggactacaggcgtgtgccaccatgcctggctaattttttgtatttttggtagagatggggttttgccatgttacccaggctgatcttgaactcctgagctcagatgatccacccgcctcggcctcccaaagcgctgcaattacaggtgtgagccactgcacccagcctgtgtgtcttagtttctaaatcaaagaccagttgtctattgcatgtcaataaaccttgtgacttctctggagtagtaaacacttatttgcatttgcttttcaacattattgttgcaaattttggtcattataaatgtgagtggtgatttaatgccctgtagcagtaaatcttaaatatttcaaattgtatttttaagaagagggtctatattcagcactactcttggacagcaaagtttttaatctaaaatatggtataaaatttattctcttagttatgagattgcaatagggcagaaactgttttattctgataagtgtataccatttctttttaatctagtaagtgctttcatttatcgttttaattaaatgaattaattttcagttaaattagtcactggatattttctggccaaataagtctcttaatgacaccgtcaggattttacagaaattgagacatggtgggatctttgatcgtagtgtttatctttttgctccatagataatgaagtgaattttctataacagctggtttacatagttatatgatagatatgttccagagtttgagattaagaagtttttacttctggtttatttgagcacttagatgtttttctaaatttgtctttctgagttttctctctagataggtctggcagggatttttgaattgtcatgtaatccaaatatagtgcctaaggcttcacagctacatgaaatatctatttttaaggactttcatcaaggagattccacattttccctggagaatttttttcactataatcctttctctcaagaaattcatctctgtatgtgaactaggtccctctggtttaagactatttcttctagtctggcttcatcagagagagataaagattagattgttaccattttaaaactggtaaaactatgatattaataattttttctcttcccccaaaattaaatattaacattaaatttatgtgagaagtactcatctcaagaagggaaattcaatgtaatttctactaaagacagaatagtttctagataatcagtagtggctcctgtttgtaaagagctagtctggcaataaggaaatgtcctcttacagatcggttggttttgtctgttataagtctctgttgtcagagacttatgctacaggtggagtgggttctagctggccacctagatggtacattattgggaagtttttggttgcaagtgacagaaaactcaagtggaagcggattaaacactggagacagttattatctcacataacaaaaggcccaaaagaggcttttgatctaacagctcaataacttcaaggctctggttcagtgtctcagaaattctcttcagttttccctcatggttccaagatgtgatactctgaactgctgcagccatctttgtataactacatccagagacatgagcaggaaattatatctgtcccgttcttttttaagcttcaggaaacctctctagaaagtactcttcacatcttatagtccatagctgtatcacatgctcatgcctaaaccaataacttggtcatgggaatgtgatcagcatgattagccttgactcatcataattcattctgggtctgaggaggagcccagcctctggaggacatgacaacttagaaaggtgaacaaaactagaattgtattagctaggaagaaggagaagtggaaatggttgttgagtgagccacatagttgggaagggggtttagagaatgttgcttgttctgcacgttagtaacctcattggagaatgttgctgtaaagtgtataacactgatatgggggaaaatagactttagaggacttcagaaaagagtaaaccttcttatttttggattgtcttagggatggttttatttgggagctgagacataaatttggtattttagggccccatcaagtcttaagaaactactagtaggtgttaggttggtgcaaaagtaattgcagtttttgccattagttttctaactcaggtttttttctccgctgtgtgaactagtgatcaggaggggtctgagtgtttggagaacaacaaggtgggttttttttttctctaatatatatctgtattcactatagttaatgctgctgatgaatgtggaaatattatagtagttcttctgttggctatccatttttactttactatctcctgttttagatgatgaatttgttggtcaaattcagtaggatttttgttctttaattattagatattgtaagtgttattttgttttaaaatattcgaatctactccaggccaaagaggggattactgggagggtaggaatttttgtacccatttcggagggggacaacctcgcaatggtctaggctacagtgagaagagagtgtaaaagacttttcggtaggtcaaatgagtgtacttggagtaaattctgtgtatgaggatgaagtacttatccttctgctgctactataaactgattacaatgagaccatcttttcattatgttttctcatctgattattgtcaatttataaaaatgcttactgactcaacttcctatttagctttagtagcatttctggtgattcattctctctctactttcttttcttttcttttttaaaaagatatgccattatattgactacagataatgtaattttgtctcctactttctagatagttgtattttttgtttttgttttctgcctcatttcattaactagaactaacagaacaatattttttaatactgatgatagtggatgttatcatgttcctgtgtttgagattatttaaaaagtttgagataaagggaatgtaaaaatgccttcagtttatggataatggagtaaattttctttactgatatagtgaaagatgaaaacctgtagaaagtaagagccaaagaagaaaggatatttaaagtatagtaatatagagaattgataatcacagaatagactagaacttatatagatgtaatggtaaaaaccagcatgcatcgattacataacaggaagaacaaatactgtagttttttctttggagaaaagtatcatcactagatccatctgaaggaaatgacctagaaagcattagtctaaacaataggcagaatatctgactgcacaggataacgattctgcacgttgaaagacctaaccagatatgctcaggaatcctgccctctggtttcagaaaagtgggagctctggagccattttgccctggcacttctgctggttttggtgaaggtcatccttattttttctaggatttcctgtgcataagatccttgccctagtttctactatctgtcctgtaaagaaatagtggctgcttgcggaggagtctcatactgagtgaggttaggtcctgagttggtataagagacaaagtcatgtctagtcaaaatctctcttgaaagatccctcaaattgcccataaagagcagtgtacatgattttgcacatcttactgtgtagagtaatatgtaattataaatgtgtaatatccaaagttaaaatttattccaaagaataaagtatatgtatgtaaaatatatttttatagtgttttaaatgatatagaagagtattttgaatttgtataaatttgtaaatggtaccatttcactacaccttctataaagtaatagaataagtaattaaataatattttgagattttcaggcaactttccggaacttttcttttctttttttttgagacaggtctcactctgccacccaggctggagtgcagtggtgagatctcggctcactgcaatctctgcctcctgggctcaggtgatcctcccaccacagcctcctgacacacaaccacaccaggctaattttttattttatttttttgtagaaatggggtttcaccatgttgcctaggctggtcttgaacttctgagctcaagcaatctgccctccttggcctctcaaagtgtggggattatagtcacgagccaccaaggctggctctttttttttttttttttttttttttttaaaaagagcatattaaatatttctgtgtgtgatcagttggaggaaatttagtctcttaaagttttaaagatacgaagcagaataaacatgtgactttggagttgggagtaagattaattcattccgattatatttttgtagtcagttttaggaagataattgtaatgccatattgaaagctttatgtttaatctaagtgccagccatagctttgacaccagatgggaatatagagatgggcactcagcctgttaatttatattctaaatacatggaaaaagtttatatttgctgtttgttttttttttcttatctatggcttgaaaccttggaggattttattctctaatgatttcagaagagagaccaactggggattctgaccttttccctacttttctggaactcttctgagcatctgatatggtaccttcaggcctgacctgtttttataaatgcctgggcctggatttgtctaggagtgagactcacaaagcagcaaataatttttggaaaggaagctcatatttttaacatgtagggggacctgagtgtctgctgctgaagaagtcatggggtaaagaactgggatcccgacagtggtcagagaagctctctataccttcatattagagccacaggccctgatctgattcatgaaactacacagagacagaaattgtttatccccaaaggattatgtaatgcaaacagatttagacatgaaacagtacaggcaggagcatacttgggaaatattgcttaaaagggaattcttcagtgaaaaagacagctagtttttactttcctctcaaaaataggatggcaacaggagtgcttggctggtgttcctcctttagcaaaaacaggtcctcattccttagcctccatggtggctttatgataaagggagaaggtcatctaatacatacttcatattcaaattttgccaatttctctggctattcttttaaaaatatctttactgaagtatgatgcatacaataaactgtacatgcttaatatatgcaatttgatcagttttgttatatacccacgaaaccattgttacaattaaggtagtgaacatctccatcaccctcaaaagtttcttgatgcttcttggtaattcctttctttttccattctcctacccttctccttcatctctaggcaaccattaatctactttctgtcactatagactagtttgcattttgtaaaactttatataaatagaaatatgcagtatgtagtctttttttctggccttttttttctcagcacaattattttgagattcatccatgttgttccacttatcaatatttcattcatttttattgctgaatagtatcccattgtatggatatatatcaaaatttgtttgttcatcacttactggacatttgagttgtttgagtttttggctatgaaccttcatgtacaagcctttgtatggacatatgctttcatttctcttgggtaaatatctagcagaagaatggctggattgtgtggtaggtgtatgttaacttcttaagaaactgctcaactgttttccaaaatggttttccagttgttccacatcctcactaatctttttaattttagccattgtagtaggtgtgaagcagtatctcaatgtagttttagtttgcattttcctcataactaatgatattgagcatattttcatgtatattttagaagatgtccctcttttgaagacgcagagagaaacagttatcaaattatgattatctcgtaaaatctgacttttgtccttgcccctataatgagtgaaaagagagaaaaaaaggcaaaagggaaaggggtgattggcctgactctctcttactgcgaggaaagaggctgagaagtacagcctagaaataagtatggagagaggttgtgcggggtaaccagggaatcagatggaaacaaggagggtagaaaagaaagattagggcctgtgccagtaccgtcagtgtgtattatcagattcttctgttttttaaagccttgtttccttatattccatgttaaaaatctgaatgagacttcttttagaaaagtgcagagggtagcatggactatttacagtgtctgctttcttcctacttacctcatttcctttttccatctgacactttttcagacttgagtttttgaagatctctaggagcctcatacttgtcatatgtgagcctgttttcagctctcatctttgattttttgttggatcttactttcttgaccacctctcttccagagactcacccccttggttttaatgacaccacctatgtttctctgctccttctgtgacttctctgtgggcttcacttccttcatgagtctgggtttcaagaagggctgtgctcagtgtgctggtctcatttttgcatcagaatctttggagcttctatggattcagccatcctttctgagcacagggctccccttcctgtttatagcccacatctttacatgctgactttactattttctttctggatgtcacattgataacaacctgcctgaaaccaaatttacctcttttgtccctagattaatttcctctccagagttgtcttttcttctcatggtcgtgcctttattctctcagtccgccactcctgaagctgctgtgtcatgttttccttcttccttcttcatgcaagtctgtgagaatttctgtaatgcctgtcactcctgtctccatctttatggagacatgccataaagatggtactgccaccatgctaattcaggctttcaacactttacactaggattgtgacagtggcctcctcatggtcactttgtctctggcatctctcttcttcaatccgctcagtgatgtctctgatggataaatcttctattaataaaccaactggattatatattgtttctttttttaaaaaaacctctgattttcagcaaccatgatttatttctctgaaattttgggttctcataatagtatccctggctcctttatcttattcaatcttaccttctgttgtttgcctatgcaaaagtccgcactacagcaaaaatagtctctactgttcactgaatacctgatggatacacatgcttgctgccgctttgttaacacatagccatggggaagaggatgtcttgtccttatttcaaggttcccctcgatttccagctcttccataaaatgttgcttggtcatgtcagctctctcctttgaatttatggtctgttataggcaatcaaacatttttgtgttattgtttgtttttaacttaattttcctctccaaccagggttcacctttcttgagtttcacatctctattgtgttccagtgataatgataccttgcaataattctaaaaataatgatgtctaacaaatgaaaaggggataccaagctgtctgattgcatttgctatcacttatgtctgttggaaatcaaagggctttgctcattttgactgttaagtgtctgcaatgtgccaggtacttttagtggtgttctctcacaaaatcctaatggtgtttgaggcaacggttgttatccccattttacagttggggaaactgaagctcagactactatgtgcccagggttatacaacggctaaatggaagagctgagattaaaatatttcccatgtctgtctgattccaaaagctatcctgttccagtcccatgctctcctttgctgtgtgccaataggcctggtttgttaaggcattcatataggggttacaccattagcactcagtttctagcattgtagatgatctgtgggaaatatttcaaggttatgggaatggaaataaattgaggagataatttatttataccattcactcatgtttattctctttgcttttcttattacccctcacagctcctgcagtgtaaggtctatccaaaagtcctttaaataatgaccaggaaaatgtagattaaatatgtatataggattctgaaagttatcctaggcaagtggttttcatcagtttgacaggtaactctatttctggtgtgaggcaagaagtttgagaattgggggctggctcctcagaggaagctaggcaatactctcagatttaactcagcctgccattgagaaggtggttcaattatttggttaggagtgttatggattacagtacattagacgtgcctgagttttcaaacgtaagtgcaagaacacgtcctcaaaagttcaatctatagtttcccttccccaaacgatcatgcaaaataaaattaaacatagtatttagtgaatatcaaaaagtggggaaatgtaaatgaaccatatcagctgcctggggggcagaaacagtgatttatagacttgagatttagaactcaaacattcttggtttgtactcaaggaagagcgtcattaggtaagttgcatggcagaacagaaaagagcttactgatagtgtgggaataccttagaaaggaataaaaatcatcacctttatctaatatctctctcactttatatatgtgtatatatttgtttcttctacattaactattaagttgaaggaattacattttagaaaatgttgattatgaggaattggtagaattctcatgtacaaaatggacattttctactttggggagctttatgaatcatattgaaaattagagtaactgagttcttaacaagtaacagcaacagctacttcttaactccttcatccatgggaaacagaagttgctttgtgtgtgtgtttgtgtgtgtgtgtatgtgtgtttactcatgcaattattactgatcaccatactagagaaagatggtctcataggatgaaaatatgatgttcccttaatgattagattaaacttcccttggcagtgttgaatctaaactgaaaaacatttttgccttccttaaattgagtaggagttatggctatgaatatttagacttatatcatgcctatgatattatggtttacttactgtatgtctactttcagatatactgcactaccttggtactaccttggtgccttttttttttttttttggagacagagtctcactcagtcgcccaggttatagtgcagtggcaagatctcagctcactgcagcctctacctctgggttctaacgattctcctgcctcagcctcctgtaactgggactacagacacatgctaccacacctgactaatttttgtatttttagtagagacagggtttcaccatgttggtcaggctggtctcgaattcctgactttgtgatccacctgtcttggcctcccaaagtgctgggattacaggcgtgagccaccatgcccggcccttggtggcttttatagaatgggtgccctataaaggtttgtcagattaatctcatcatggaatcagagaagattaatactatggagggtctttgttaacctttccatttcttctagtatgaaagtttaagctaaataatttctgctgggcatggtggctcatgcctgtaaccttagcactttgggaggccaaagtgggaggattgcttgaagccaggagttcaagaccagcctgggcaacagagtgagacctcatctctacaaaaattaaaaatattagtcaggcatggtggtgcacacctgtagtcccagctacttgtgaggatgatgcggaggttgcttgagcccaggagtttgacgttgcagtgagccatgataataccactgcactccagcctgggtgacagagcaagaccttatctatataaaaaaattaagtacataatttttgatatgtgctctttttaaattgtaaaaatcatgtaacaaaatttatcattataaccatttttaagtgtacagttcagtagtgttatatgtgttcacattgttatgcaatagctatctagaagttttttatctgggagaactgcaactctatacctattaaacaactccctattttttcctccctgtagccccctgataatcactattctactttctgatttctgtgaatttgactactactgcatataagtggaatcattcagtatgtgtcttttttgtgactggattatttcacttggtataatgtcctaaagattcatctatcttgtaacatgtgacaggatttctttcgtttttaaggtcaaataatattccattgtgtgtatataccacattttgtttatccattcattcattcattgatagatatttgagttgcttatacctcttggctattgtgactagtactaggaacataggtgtgcaaatatgtctttgagatactactttcaattcttttggatatatttatacctagaagtaggattgctggatcatgtggtagttctatttttaatttttgagaaactgccatactgttttccatagtagttgtaccattttacactcctgccaacagtgcacaaaggttcagtttctcaacatccttggcaatacttgatattttataatatttggggagtagccatttttaatggctgtgatatctcattgtggttttgatttgcattttctctaatgatttgtgtaactgagcattttttatctgcttattggccatcattttatatgcttgttggctttctgtatgtcatctttggagaaatattatttaagttttttgcctattttaaaattagtttttttttgtcattgttgagtggtagttctttatgtagtccagatattaatctcttatcaggtagataatttgctaatactttctcctatatttctaatatatttttataactttttatattgatataatttcaaacttacaagaaagttgcaaggctagtacaaggaactcctgtgtaccctttgttcaaagtcctcactgtttttttaaggagcatctgggtacttgaaattatgttgagccaatctaaacacactgaattacttgcggctgtgggagagataaaaatacaaaagtggtccctgtctgaatatgcaaaacaaataggaatgttcatgaagcagcaagtacagatgagactaagatagaataacttgaattattagaactgagagacctgtcccagtggttctcagcatgggttcatttgccctcacaaggggatttttgataatgcttgaagacatatgagttgtcacagctgtggggagcatgggggaaagttgtccaatgtgtagaggccagagatgctactaagtatcctacagaacacaggacagccctgtgcaacccaggaataggactatttcacagaaaacctgtcttgagaactttaaaggctttgagcccagaagctctctcaaactcattctaagtgcttggtgaaaactgtggttggtaaagaatatggtatgaaaaactatttcttttttacctttttgtgcataatccacaataagagggctcagttggtctgtttactgtaggttttctacagtaaacagtctaaaaatgctttgttttccctggttttattttgtgttatagtcctgtttcctgttattacatttttttttttttgctactttctgctgtaaaaaaaaaactgtgtaaacgctgaaaaaagcaaatgtcattagacaaagatcttgaagcatagagaaagaaagaggtggtgttgggagaatgtgacttaaatggcttcctttcaattctcagtttactgtggagaagctaggtgtcagttctgctttatcactgactccagaaggcagagaaggggatagaaatagtatgggcatttaaatcctgtagatctggatttgaatcaaggcccatccattactagctgtctgaatttgagcaaataacttctacaccctgaacttagtgtcttcttctttgctagggggataatatctgcttcactgagtggtgaggggcagtggagtgcagtggttaatgatgtggactcccacacctaattgcctggcttctaaccttcactctgctacttttttttcttttttgagacagggtctcattctgttgcccaggctggagtgcagtggcaccatctcggcccactgcaacctctgcctcctgggttcaagcgattctcctgcctccgcctccctagtagctgggattacaggtgcccaccattatgccctgataatttttgtattttttttttttttagtagagacggagtttcaccatgttggccaggttggtcttgaactcctgacctcaggtgatctgcctgcctgggcctcccaaagtgctgggattacaggcatgatccactgcgtccggcctctgctaccttttagttacctgccctttggtaagttttactagttttctaggcctgagtttcttcatctgaaaaaatgcgaatgattttttttttagtatgtacctcataggactgttaagacattaaatgaattcatacatgtaaagtacttaaagtggtgcatggcacatagtaggcactcataaatgctagcttttttttttttgatactgggtctcattcctccattgcccaggctgtgataacagtggcatgatcactgcccattgcagcctcaaactcctgggcaagtgatcctcccacctcagcttcctgagtagctgggaccataggcacatgccaccatgcctggctaaagctattttttaggattaatttgggacaaaggatataaagagcccttcagcatctagcaaatagaaagtgcttgataaatgatctctagatatttaaattttagtagcagatagtttgttataatataatgccattataacaaaatttcatcagcccctgaaaaattagtgggaaccagtcttaagaagtctttagaatgcaaaaagggaagtggtcattctttcacttcctacttgtacctggcaaaggctccattggatccttattcagaaatgtgcttaaggaattgcaggcctagccagacttctgtggaattataaaaggctaataaacagctgcttgagtgcatggagtggtgaggaagggaaatagctattactctagttcagctttcatgacagtacccttgttggtgagaaagtggagcagaagtaaagaaatagcatggagtttgattcctttcgaactctatattcgtcctcaggatgtgggtgtgtgtcaaggtggaagaatgggcctttctttcctacttgatagcacaggagatttagactcaatagtttatggtggggccaaccatcaggttgtagcagttcctgtcaggcagatattgggttgtagacagacatatttttagggcacacatggttcagttcttttttgaaatacaagaatatattatcttgttttaagataaaatgtatgtaaagggtttagtatagtgcctggcattgtggtattttatgaagagttagctgtcatcatcattgttctctttaacttgatgttttattttagtgaagaaactaatgaagtctttactcttcatttagcaactctgtttccctcttatttattttttactttctatggaagtacacatattaacaggtatacgttgctattctctaacttaatgaattttcaccaacagaacattaccagtagtaccccagaagccccactcatgttctactgtggtcactatcccttattttttaggaaaagaatggtttttcttttagtgatagagcgactcatggctttttgtaaactcttaatagctatggctgacagatatagcttagggatggccttattatatgcttttattttctttggctttaaaagcatgtctgctggaaagggatttcagtcctgcagattgttacatttagacatgataggctgagtgatcttgtagatcttcctcgccaaataggtgaggtgttctttgcttttatttgtatatactatagaagtccatggaaaccaaaaagttgtccattgtattaaaagaaaaggaaaatggcctagctgcacagacctcttagatgtcccctctaaaagcatttcacattcaagagagctcagggcacatgaaagaaatcctgtggtggaggaaggctgcacaatgctgggtgcactcatttcctgcaataggagagatgattaggctgaaggaccggcaacttctagaagtaatggactacagtgtgtttaccctgcttttgtctgcgcatatttagaaaaccagtggtaatttttcagaaggcagcttctcagaggaagcctaacgatatgggggttgagcttaggccctttatatatcttctttttgaaatcaaagtgcagaacatgttcattctgaaacaccctggacatgagccgtacctatgtgtcttgtttaacttcctgtgcccagcagtggctctgctaaaatactgtatatgtatttcagaatgtcattacttatttttggccagtgttttgttccttaagatttatttggtttttaaagaaattgagatataatttacatgccataaaattcaccactttaaagtgtatgactcactggtttttaatatagttataaggctttatagccattaccactgtctacttctagagcattctcttcactccaagaagaaaccctgtgtctgttagcagtcactctccctattctgtttgttttttttttgccaaataaatgttgtcatgattatctctattacataggagcctgtcttccgcagagtgtcatgacagttgtttgacctttcgcgtataggtttatcacgttcaccttttgttctaaggttgatggaggttgcagttttcagcactaccaccaccaccaccatgttgactgaaattattataggacataaaatgacagtgtgttactcacaatcacttgtgaaagtttcagtgcttatgaacaacagacaactgagcactgtgcagatttctgactatgtgacaaagttggcctgtgctttaaaatttaatgaatagagaagtaaattcttctgggctatgtggaaaggtttagatttatttgtttcttacactaattagttttttgaaaaaaatgcataaaatgtgttcatacttacacttatttctgaaggactggaattggttgttcctaaactaacatgattgactttcttaaaaaacctcatttataatttaaaactattttgaatctgtgtttttattattccagaagtgatatatgctagttgaaaaattttaaaaaatacatagagcttagaaatgttgtaaagtaaaaaaagagttctttgtcatcctttcactttagagtttatgcttcaaatttttaaaaatgcctaattctataacctacttgattctttgctcagtttttaaatacttcagaaatgcttgtttattgaattgtgttattctttattttaatactgtttgaaattgatgaaaaactttaaaatttttgcctttcaaagtggtgattgctaagaaaaactcccagtgatttttcttaaaaattactttgccctcttcatgggccagtggaacttctgagcaactatagaaatgtacatacttcaagacctggaactgtttatcatcaaagaaggccacaatccttaaaaaggcttcctcctttagagcggcttttatagaaaggcttcaggacccaatgacttccaaagtcacatctgtgtcttttcaggcacaattgtttcatcatgatgatgctacatcctgcagttatattagcacattaaaaaaaatgattctcaggaaaagaatgacatttatcatgtcctgtctatagacattaaataatggaggctgggtgcggtggctcacgcctgtaatcccagcattttgggaagccaaggcgggcggatgacctgaggtcaggagtttgagaccagcctggccaatatggtgaaactccatatctactaaaaatacaaaaattagccgggcgtggtggcgggtgcctgtaatcccagttactcaggaggctgaggcaggagaattgcttgaaccctggagatggaggttgcagtgagccgagatctcaccattgcactccagcctgggcaacaagagcgaaactccatctcaaaaaaaaaaaaaagaaaaagaaagaaagaaagaaagaaattaaataatggaggtatcaaaattctgtggtttaaagaaaaaaaattctatggttgacttgattgactaacaaaagtaagtagttaccatgttccccctctggatgttaaatgtctctctatttctctgttgaatcccagctttctgcattgtgtcctgagtttcccaaagtctccttgtaattatgtagggatgcctaacttagaactatattctaaggaatcaggtattgaactgaagaaatatctgatagttagaagagatggctctagtagtaagatttttgaagataccaaaaaagtgattttgaagagaatcctacatttattttaggttacaagtatctaaaaagaatataatttatgtgaattgttatttaaacatgttggatttcactattgccagaacctaataatggctttaacatctttgaaagtgcaacgatgttttcattcttctaggttaacttgtagcaatttaataattttaatgtacttcataatgctatacttgcttttaaaaaaagcgtacctatctatattcacagatatatactgatacctatatgtgtatatattttcactgtttcactatatgtgtatatatttaaaccatttaaaatggtttaatactgttctaatctaccatactgtttcattcacatatagtatcatttactagagttgtgtggtttttggaatgtgacttgatattgataatggactggaaaagttgtaaagagccaagcaaatcatcttctaccatatgaatagttaatcaggaataagagtttcttgcagaaaactggagctttaatggatattagatagcactcactgttgaaagagaaaatggaaagaaaaaaagccacacaatgtaaaatgaggtcgggttacccatactgcttttgcaataaaacagagaagaatttgtaggctttaaagtttaccttgtgagtttaacaatctacaaaaggctggacttaatacttattaaatgtcttttaaaaaatggttttgtttttctctccctacatgctctctcactcaaagacaaacccatttcctatgtaatcactctatcaaacattaatttatctcaacattccttattatgctccataagcactgaattttgtatcaatcagtggtcagttggttagttgaaaggaaagtacttttatttgtcccagataaaccttatttaagggaaggttgaaggaggggaggttgaagaaaaaatgtgctgatcaacaagctaggattggaaagacaaaagtggtgattgtttgggaaagagtatgtcaggaaactactctgaccagtctatctggctctgtggttgttctgagggtgactggaaactttctaagcctttggcacacccagtaaattgttgctcatatttgaagactagcactggggagtgtgtttagttttatccagtccatttttttccttatctccttcaacaaggatttatacagtgtttgcttactctgctagccactgtgctaggtgttaaacactgtggttagactgttagaagtgtgcttcacagtctaagtatccacatttttatagaaaagaattttaaagttcatttcttagaatattttgagttttctatacatttttaagtgttgtataagaaataataaattattttatttagttaaaaagaaaatagtttattatttaaaaagaaagattgattttgttactaaagtaccataaatctgaaagcaaaatgaaggatgtattactttttataacttaaaatgctcaaactaaacatttcaaacagcataaaaatgctcaataaaaaacttaaattttcttctactctggatctctaaaacccctccccagaagtaactgtcattatctgttttctgttgcatcttttgagcaatattttaggcatgtgcaaatatatctatgtgattctagcttccttttcatataaatagaagcatgttatgtaaactcttctgcactgtggacttcttcacttcatgtatttaagagatgaacttagacacatctgcattccttttactggctgctcagtattccattgtgtgagtgaaccattcattatgtaaccatcccttgctgatggacatgtaagttgttccttcatttttgtttgttcccttcattttgttcttacaagacagcggtgcactgtttttttttttttttttacatatgtctttcccacatgtgtatatttttagaagtaaaattgctgggtgaaagagcatgtatagttctaattttaatagatattgccaaattccatttgatagatactgccaaactccatttggcaatatctataaaaaaaaatctaaagggggttgaccaatttatacttccattagtgctatgtgagagttcctaaatcccactttcatgccagagcactgtatctttaaactttttgatttttgcaagttggataaagatggaatctcatttttctctctctctctctctctctctctctctctgtgtgtgtgtgtgtgtgtgtgtgtgtgtgtatatatatatatatatatattttttttttttttttttttttttttttaagacagagtctcactctgttgcccaggctggagtgcagagacatgatcttggctcactgcaacctctgcctctcgagttcaagcgattcttgtgcctcagcctcccaagtagctgggattacaggtgtgagccaccatgttcagttaatttttgtatttttggtagagacaaggttttaccatgttggcccggctggtctcgaactcctgacctcgggttatccacctgcctctgcctcccaaagtgctgggattacaggtgtgagccactgcgcctggcctaattttgttttttaattacgagtaaagttgaacatcttcttatggaataaaagccatttgggtttttttttttttccttccaacttttattttaggttcagggggtacctgtataggtttgttacatgggtaaattgcatgtcatgggggttggtgtatggattattccatcacccaggtagtgagcatagtacctaataggtagtttttgaaatcctcaccctcatcccaccctccatcctcaaataggccctggtgtctatcgttatcttattagtgtccatgtgtactcaatgtttagctcctacttataagtaagaacatgcagtatttggttttctgtttctctgttaatttgattaggataatggcctctagctggattcatgttgccgcaaaggacatgattttgttgtgtttattttttatgactgtatagtagtccatgttatataggtaccacattttctttattctatccatcattgaggggcatctaagttgattccgtgtctttgctgttgtgaatagtgctgcagtcgacacacacatgcatgtgtttttatggtagaacaatttatattcctttgggtatataccaagtaatgggattactgggtcgaatgggagtactatgttaagctctttgagaaatctccaaactgctttccacagtggctgaactaatttacatttccaccagcagtatataagagttctcttttcttcacaacctcaccagcatctgttaatttttgactttttaataatcaccattctgactggtgtgagatagtatcttattgtggttttgatttgtatttctttaatgaatagtgatgttgagcactttttgtatgttttttggccacatgtatgtcttcttttgaagtgtctgttcatgtcctttgcccattttttgatggggttgttttttgcctaatttatttaagttcctcatagattctggatattagacctttattggatgtgtagtttgcaaatattttctcccatcccataggttgtctgtttgtttactctgttgatagtttcttttgctgtgcagaagctctttagtttaactaggtcccatttgtcaatttttgttttgttgcaattgcttttggagtctttatcatgaaatctttgccaggacctatgtccagaatggtatttcctaggttttattcaagggtttttatagttttaggttttacatttaagtccttaatctatcttaagttgatttttgtatatggtgaaaggaaggagtccagtttcaatcttctgcataaagctagccagttatctcagcaccatttattgaatagggattgaataggaaaattgaattttcctcattgcttatgattgttggtgttgtgaaacatgagatggttataggtgtgtggctttatttctgggttctctgttctgttccattggtctatgtgtctgtttttgaaccagtaccatgctgttttggttactgtagccttgtaatatagtttgaagtccagtagcatgatgcctctggttttgttctttttgctgaggattgctttggctattgtgggctcttttttttggttccatagaatttcaaaatagttttttctatgtctgaaaaacaactttggtagtttgatgggaatagcattgaatctgtaaattgctttgggcagtatgaccattttaatgatattggttctttctatccatgagcatggaatgtttttccatttgtttgtgtcatctctgatttctttcatcagtgttttgtaattctcgttgtagagatctttcacctccatggttagctgtattcctaggtattttattccttttgtaaaaccacttgttagtatttttattttgtgaacttctggttcatgtcttttgcccattttcctattgcattgttctttttctgatgaagtgtaagagttctttctgtagaaagaagatttgccctttatcatatgtgctaccaatatattttgtagtttgttatttgtattttgatttatggattttttttgtagatcaaaacaaatcttatgccatcacatttagcaattttattattttgggattttgaattttacttagaaataactttcacatttagaagtgataaagtttatctattgtttttgtctagtattttaatggattcattatttttacctttgatcaattagaaatgtgagaattgagttatataaaaatttagttttatttttccagcttgctataataatccatcttttctctgcttttttgaaatgcagttttatgtataccaaatttttacctgtagggtctatttctggacttttttctattttattacttttcatgaagccagtgtaaacaacctgttttaattactataactttacaatattttaacatttagaatgttctgggctattttaatatactttatttttgtaagtgacatttagaatcagcttatctggttgcaaacaataacagcaacaaaattctgttggtattattgagattacattacctttatcatttaatttagataaactgataattttacaatatccaggaataggatacttctttaatttattaaagatttctattatggatttattaaagtcttaaagttcttcatatagatattttacatttgttactagacttattctcaagactttttaattttagttacagtcttagaaatgagatcgtttatggcataatgttttctaattggttatttttacatacaggaaagccactatacagaattcccttatggtttataattgttcttccaatgatcctgatagattttcttgttgtctaatcatattgtaaatgctgataattttgcctctcactcttctatttgtatctctcttattatttctttcttctaattttattgacttgtgctttttgaataatgtaaaataataatggtgataaatgtgcatctttattttattcccaagcttactggttctgtttctagaatttcatcttcaatcatgacatagattttggacccataatatgtatataattatacatatgttaattatgttaaggaactatatgtacttttttgttttattaagaatttttcaaaatttgtagtttatattgaagtttatcaaatatgttttcaaatttatacatatgatcatagtttttttttctccttggacctgctaatggtataaattacattggtagatcttctgatatcgaaccatctttattctactagtatgaatctcacatgatcatgtgtgtatagtcttcccttggtatctgcaggagattggttccaggagacccctccccactgtggataccaaaatacatggatgctcaatttcctaatataaagtggcatagtatttgcgtataacctacacacattctcttgtatactttaaatcatctctagattacttataatacctaatacagtataaattatatgtaaatagttgttatactgtattctttagtgaataatgacaagaaaaacagtttttacaaagttcagtacatgaaaccatccattttttttccccaaatatttttgatccatgattggttgagtctaaggatgcagaacacacagatacagagggctgtgaggtaggactttgacatctttcttagttacatgaactgttattaactaattttgatgatattacgctgataaatgatttgtttatttgacattaattttgtttgtgagttcagatcatttttaacacttaaatgtttactaatattcttgttcctccatagcaccttagaaattaagcatgcttctttaattgtaatgtataaaagtattttatcagggtataaatgcagcacagtttttgcaaatatgttgtatgtaaatatataacaagagaaaataagctggggaaggcaaactggcctggcagagaagcagcaaattcagggagatgaacaccttttttatactgggggctctactaatagagagagtcatatttgggaacactgattttggaaagcagagggacaggagggagagcctgtgttgtagtggagatactctgagggtaggatgtattattgtcatgaaaacttgacttgctgaggttacattacttaggaatgctctgtgcaattgtatcttttttttggaggtagaacagagtgacagagtcaggcagcagagaagtcacagagggatggcagagattaccatgggaagaccagcaatatctgggtcatttaagagttggcatttagatttatatgtagaacaattttcatattttctcattcatgttaatctcaaagtatgtatgtttgacgtgggaaggaaattgttgaggattatgttagtcagatttaagctgatctgttaagagttattttcaggttgtatttgtacagtgttcatgggaggaggattctgaggggggttaagtcatcctttagtttaaagagagatccagaaggtcttttgacttgtaaacattctcactggctcccagtattttcattcattgtgccaaactcgattagcactactctgtcttctggtctctcactagttttataaggctaaggtcacaatgacagtcactgcactaggcatcccagttttcatgagaccatttaaagagagacataaaatgaacagtgggtttatatgtcaaagaaggagtggaaaaggcataggcttagagtcagtcagatgcaaaatcatgtcacttttgccattgaactccttattaaacctttcctagtctctgtttctcatctgaaaatagtaagtagggataataatatatcctttacagagttttgttaagctttaatgagatatgtacccaaagaactggagcagcataactaggtcttagtaagtttatttctctttctcttaatagcttatattttagtcttattgcataattttctttaaatctactttcattttatccattcattcaaccaaaaaccgttcactgagcacttgctgtgtgacaggtattgttccaggggctgacattagaacagtgatcaaggcaggcaagggccctgtgcttatgaaatttgctttccagtggataggaagagagaataaaaagcagattaaactagaaaataatcagataatgattagtaatgtgataaaaatataaacggagaaataatgagtgttaggaatgcttctttagattggatggatgaaaaaggcctcttggataaaatcacatttcactgagctctgaataacaagaaggagccagctgtattaagatctggaggaggaacagtctaggcagagggacgctactgcaaaggtgacatgagttttttttattttagaaagagaaggatggaactgtttagccaacaaccagatcttgagggatctcattggctagcacctggagtttggtgtaaggggagtttggagtttttcacatgcctaaggtagatgggtgtgtgttaacttatggctgaactactgtggtaatagtctaatgtcagcatgcacccaggtaatattcataatactatcctttgagggagaacaagaaagaaatccttacttttatatagtgaagtaggtagattaaaagtcaaagtgaggctaagacacgtaactaattttttgggttagctaatcagaggtgattaaagtaatatgctcttaaattaacttttagttatttttcttactatcatttagtttatgataattctttggaattgtggtataatatgaaaagttatgaccacttaagtaacaacttagtaccaaagatcacttatttctgatggtgatttggtagcttagaattcagataaaggtgtattttttaaaataagcttttaattttagaatggttttaggtttgcagagaagttgcaaagatagtacagagttcccatatgctttacacccagtttattattaacatcttagaatggtatatttgtcacaattgatgagccaatattgatacactattattaactaaagtccatacttgcaatgcaatcctgaagctaaccacaatgagtaggtgcagacttcagaggctgaggtcacagtcgtccctaaggctcttctcatttcagataccagctgcaaactctggggttcccagactatccagactatctatgtttctgaccaactagctacaaattcagtaatttgctagaatgattcacagaacttagggaagtaccatacttatgattacagttttattatacaggatacagccagtgaagggttacatagggtgaggtcaggaagggtcacaaatgaggagtttccttgtcttcaggacacaatcactctcccagcacattgatatatgattaccaacgagcacagctcattgaggaatgttcctcaatttggggttgtgtgatgtttttctcattattagactggggttatggttttttgaaggaaggtcacagaggtaaagtgcctatcatatcaagaatatgtaactgacatgacttatgacttttgatgttaaccttgatcatctggctgaggtagtgtttgtcaggtttctcacctgtgagattaccctcgcccacctctttttcatacctcactatttggaaggaagtcactacatgctgcccacacttaggtctttccctccttgagaatgtagtaagataaagagattttgataggtagaaagagaaatgatttaaaacttatatattattaaaaatctattaaccttttcaaatactagaaaaatagaatcatggagttggatgggacctttcttcagatgagcaagtttgaaagagccatacagagacagagttcactgttggtgagagggactttgataattgaagtgctgcatctacacatttctgtcaagtcgttatgatctgtggcatgtgagagatgacctatggttaccctgttgaataataagttacccctatgtcaggccttcaaatgtgttttgggataagaaatatgttgagagctgcacctttctttgtagaggatttaaaataagctcagtaaagtgtgcgtgttgatttccatgaaatataattcttccatggcttgacttttagaaggtgaactttggggatatgaacaaaagttctctgaaaaggaatttgaatgaaagagactttatttcaatagacagtttgcaaactgaggagaggcagccttaggtgtaaaacaaaggtgcattccagagaacaatggcagggttccagcaaaagttctcctctaggttatcaatcaggtttgtttatgcaaatgaaggattaaaacttgctcagttctgattgtcaagacaactgaatcctgattggttgatacagctgagcctaattggctggggcagttgagctctgattggttggtttccaagccagaaaccagaagtctctgttagatgtttattttataaataagactgaaaggggaggtcctgtgatatttttacatctctctgagaatagagtacatgactgctccctcaccgagctatgtctgcctggttctgttttaactttgagcacctcagccacaggaaatccattttatctagggcctctttaacagaggttttgttgttgttcttatctgttttatcatagccaacttttggcttatggaaggattattttagtgtatcatatatattcaggttctgtgttctggaatgtcaaattacttgtcgacctacttaaagatgatcactatattaaatctgatagttgatgagtggggaaaagggcattctgagttggttgaaggaattgagaaccctactgtgactagtgtctctgtgtccaatagctctcctcatgataaaactctagcttccagtcatacgcaaataacatgaaattttaggcaagaatattcaccgaaaagcatttggtatgagaggaaaagatgttcactttgtagtttgatttgcatatttttattattactcctttaacggctccaagcagcaaggaagtatcatttgtaacttctaaaacacttagcctcttttgtcttcattgtaaagcacgaagttcttaatggactgattaatccaaacaacgccctctgagagcaagattgttatcttcactttataacagggtgtccaatcttttggcttccctgggccacattggatgaagaagaattgtcttgggccacacataaaatacgctaacatgatagctggtgagcttaaaaaaaatcgcaagaaaatctcagaatgttctaagaaagtttacaaatttgtgcttaggcctcattcaaagctgtcctgggctgcatgtggcccacgggtagagggttggacaagcttgctttagagaaagaggaaacgcagggggtaatggtgaaatgatctgatttgaggcagtggctgaacctgggagaagataaacctagtatggcatgactgagcccatatttgcctgaggaagataaaagctgctgctttaacttcaggtgagcctcacccccatacagggaataagatttccaggaaggaagaaatgttacttaaggactgggaaagatgaaaatgggaaagtgccacatacatagcagattgtataatatattggtatgtcttttcttcaaaattccgatccaccaataagcatttttttcaaaataatttttcaaagtttgtcatttttaaaaaagacagtccccccttttctaagtaactctagaccagggtttagatctggtcttaacacggttagcatttggggctggatatttgtttattgtcgtggaggctgtcttgtgtactgtaggacatccctggcttctgtcctttagatgatagtggcaaccaagcttcccacccccacaaacaaaactgactgcagacattgccaagtaccctgctgggggcaaaattgcccctgggtgagaaccgctgccctagggttagcaaaacaaccctcagaccccagttgtgactgtgatccgtaagttgggtgcagtgcctcatcaccaacctcattttctctagctgtaaaatgggagactttatgggtgcctttttatcatgtttctagaaccggtttagaagataaaacattaatagtaactttatatggcaaatttatcttgatacaatatcgaacaatttaaaagtaatacagatcatatttacacgttaagtacatttccccaggtgagtaaattgtcttcaatcactgcttaattttattcttgtttaccttttcacttttaggaagactgcaaacttacccccacttacctcttcgtgaagcctcacagggctcccccaggttttctctgtagctctttgatctcatagtggctttgcaaaccagtgctcagtgctactgatttcaactagttattttcccagagaaagccctaataaggttgatcttagggaaatcccttaactgatttcccctaaatctgaatcatggaaccaaccagcaaccagagagttcctgatctcaacttccttctcctgattcaaacctgggagcctaggaaaaccctggtctgggaatgcttaaaataataaatctctactcttttctttgaacattttatgtacgtatatgatgtctggtcaaatgccctcatgtaaaattggagtaaagcaaaggaaagcatgcgagcatgtcttgcctccatcatcacctccttttggatttgcatatttatagctctcttttttgggaggttgcttctgcagagggctggaggttaggtggggtctggggcagggtagaatgagctgcctagtctctgtgacaggtatttctgtgctgcatctctgctaccttttttcctgccctaaccattacccttaatttttgaaagtatctcttacatcagatagcacattaaatgtcttcctttgggtgatctgaaaagaaataagaatccctgagaagaatgtacacatagaagaatcataaggatgtcagtggtgcaacttcactttgctctttgtgggaccttaattagtttgagtattctgcctgttatctttggctatctcagctgttatctttggctatctctgggaagcagaggagcatgacgaagggcttgaactttggagtaagaaggatctgcatttaaatttgattctcccctttactagctttctcctggcttctctgagtctcatctgtgaaacagatgtataaattggtgtgaaacgcctaatttatagggtaagagtatggaataaaagagataatgtgctttatcaggcacttagtaggaattcaaggaaatgtagctcctgttctttcactctcccttcctgcctgtctttccctcactgaagccagttatttccaaataccctggataatctagggtaaacacaatgacctcatgtcacaccactctcccatgctcactctgtcacttttactaatcctcagcactccaagtacaggtacaccttgttttattgcacttgattgcatttcacagatgctgcagggtttttgttttgttttgttttgtttttaaacaaattgaaggttcgtggcaaccccatgttgagcaagattattggcaccatttttccaacagcttgtgcttacttcttgtctctgtcatattttggtaatttttgcaatatatcagactttttcattattattattatatctgtcctggtgttttctggtcagtgatacttgatgttactattgttattgttttggggcaccatgaatcacacccatagaagacaatgaacttagtaaatgctgtgtgtgttctgactactccattgacccaccattcttcagtctctctccctctcctaggcctccctattccctgagacacaacaatattgaaattaggccaattagtaactcttcagtagcctctaagtgttcaagtgaaaggaagaatcccacgtctctcactttaaatcaaaagctagaaatgattaagcttagtgaggaaggcatgttgaaagctgagacaggtcagaagctaaggctcttgcaacagacagccaagttgtgaatgcaaaagaaaagttcttgaaggaaatcaaaagtgctactccagtgaacacaagaaagacaagaaagtaagacagccttcttgccaatacgggaaaagttttagtggcctgcatagaagattaaaccagccacaacgttctcttcagctaaagcctaatccagagcaaggccctaactctcttgaattgtatgaaacctgagagaggtgaggaagctgcagaaaaaagttgaaagttagcagagattggttcatgagttgtaagtaaagaagtcatctctacaacgtgaaagtgcaaggtgggccgggcacagtggctcacgcctgtaatcccagcactttgggaggccaaggcgggcggatcatgaggtcaagagatgaagaccgtcctggccaacatggtgaaaccccgtctctactaacaatacaaaaattagctgggcgtggtagtgcgtgcctgtagtcctagctacttgggaggctgaggcaggagaatctcttgaaccagggaggtggaggttgcagtgagccgagatcacgccattgcactccagcctggacgacagagcaagactccactaaaaaaacaaaaacaaacaaacaaacaaaaatgccaggtgaagcagcaaataatgcagaagatattgctaaaataattgatgaaggtggctacactaaataacagattttcattgtaggcaaaacagccttcctggaggaagatgccatctaagaatttcgtaggtagagagaagtagtcagtgcctggcttcaaaacttcaaaggacaagctgactctcttgttaagagataatgtagctggtgactttaggttgtagccaatgcttatttgccatttcaaaaaaacctatggcccttaaaaattttgctagatctagtctgcttatgctctcgaaatggaacaacaaagcttggatgatagcacatctgttcacagcatggtttactgcatattttaagctcactattgagatctattgctcagaaaaaaagatttctttcaaaatattactgctcattgacaatacacctagtcacccaagagctctaatggagatgtacaaggaaattaatgttgtattcatgcctgctaacacaacatccattctgcagcccatggatccaggagtagttttgactttcaggtcttattatttaggaaatacattttgtaaggctgtagctgccatagatagtgattcctctgatggatctgggcaaagcacattgaaaaacttctggaaaggattcaccattctaaatgccattaggaacatttgtgattcatgggaggaggtcaaaatatcaacattaacaggagtttggaagaagttgattccaaccttcatggatgaccttgagaggttcaatagcaagagaattagaattagaagtggagcctgaatttctgtagctgaatttctgtaatattatgatcaaactttagtagatgaggaggagttgcttcttatacatgagcaaagaaagtggtttcttgaaatgggatctatcctggtgaagatgctgtgaacattgttgaaatgacaacaaaggatttagaatgttacataaacttcgttgataaagcagcggcaggctgagagaggactgactccaatttttaaagaagttctactctggggaaaatgctatcaaacagcatcatatgctacagagaaatctttcatgaaagatgacagatttcattgcaacctcattttaagaattgccacacctaccccagctttcagcaatcaccaccttcatcagtcattgaggcaaaaccctccaccagcaaaattgctgaaggctcagttgattatcagcattttaaaagcaataaactagttttaattaagatatgtacattgtttttattagacataatgctattgtacacttaatagactacaatatagtgtaaacataacttttatttgcactgggaaaccaagtttgtgtgactctctttattgtgatactgctttattgtgttggtctgtaaccaaaacctcagtatctttgagacatgcctgcatgttcgtatcctgtacctttacacttgctattcattttgcctggaacatgttcccctgcttatccacgtggcttgccccttttctttctttgggtctctacctgtatgtcacctatcagagaggccttctgttaccactatatataaaataggacttgccctctattttctgatacttcccaacaccttactgtgctgggtttttctcaatgcttctcagtatctattgacctattatttatttgtttgtgtattgtacgtctcccctccctagtatgtaagtctcacaaggatagggactttttgttaattgctgtaccctcagtgcctaggacactacttggtctgcatttggtagtcaataaacatttgttaaatgcatgaataaaggaatagtattttttattcatgccacattttccttcagtttttcaagaaaaaaagtgcatactgattttaaaaacagctaaattgtttaaattgtctattattgttatctcaggatattattcaatttagaggtgaccatttttagcctttagtgtttcatattaaaacatgatttcttctgaggcttttttcctttagacagttttaattttagagaacttttaattgtatcattaacattcctgtctgtaggtcactgttgtgtggtggattgggaaaacagggagagacctatgttctacttatatcaattcttcgtgaccttcagctattgtcaaaatctttaatacttttttccccaaatcccctattctgagaagcattaatactttttttaatggagaaattgaaaatacatgatatattgaggtagattttcttagtaacctaaaatgatatcaagaatgttttggatccataagccagttggcttatgtagggagaaatcttctgagtttttttcttttttcttttaatttctttgtttgaatagcatgtaatattttaacagccaaagttgtggtcatttttattttaacaattccaatgataattacacttgcaagccaggtgatttgtcatatatctttaaaactctcaactaagatgctgttttatttctgctccatttggttcttcacctctgattctgcacctaggctctcttggattaataatgtactctaagatttggaaggtctggcatccttataattctgtacttttcatgtattttctgtattgttttaggtagaaaacaatgattaacaatttaggcaacatttaaacacccttggatgagacagatttttgaaatacaagccagttcacatgttctgtggtttttaaaaataagactgcataaagtttttattttttatatattactgcatatgaagcctgttcagtgagtgttatgctttgccataggtaagcttacagaatttatttgagaaaacgtagatatataaataggtctatttttcaacaggggaatggtaaggtttactaaatgtttagtgatacacacacacacacacacacacacacacacacacacacgggaattttttgccctttaatattgatgaaggaaaaagcaaagatatttttcatgttttttgctgtatttacctagactattccaaacattggtgatttttatctaggaggtttatccatttaagggccagagtcagcctttcctgaatacgaacataaaacctttgctttgaaggacattttgcacttggggcaaagcgaaatttgttaagtaaatggattttatgtgttggaggactagagaagtagtaacctgggacagagaaactgtccaatttaagactaccagtccatggccagtcacaggacgaagaacatttagagctgaatcatctatattttctaagttttgcgcacaccagcaaatgattcagactatgtttgttcccatgtgccagggagctcttgtgctgatgtgatgaaacttggcatagcacagtcctccagcagagcagtgcctgcctgtttatgctgagataacttgcactctcttgattttactcaggggacttctgcagttttttgttttgttttgtttttaaaactgtgtccctgcctctagtgcatttcccttttagtatttttcctctcccacagtgtctcagcctgaggtaatttgactgtcatatatgggaggtttggggtttatattatctacagattatatatgttgtataggttcccatggcttcgtttcatacatagtttgaacttatatagtcatttccagcattccttcctgtttcttcttacttttagccaccgcctaatctgccgcagagctatttgtgtcgattgccttggttgtgaaagcaacagctccccacacccaagcccttagcttcagaagtgctttccttatgactttacagagtcatcttggtggctacgtcgggttctgcccaacatcctctacttagacatcttgtcctaggaattaactctataatactcctcctttctcaactgcctccttgcatgggaaaggctcatcttagtctttttggtttcacagtgtttcagaaagctgtagttttctttcaactctgccctcatggttttaccttcctttctctcaccctgggtccctgggtccctaaccctggtcagtgatctgtgacagtacctggtcatgtaattaggagagagggatctggtcattatataactaggttgtggaatgccagctgaacaagtggctagaaacctacaatccggcttggaactgaggtttcatggtgttgatgtgactccatgcaagtgagcaatttactctgtgttagaacgtttttattttgaaaaggtagacaacagggtctcatttgatcgttaggaagaacactaatgtttattgagcgccgggctgggtacttcattctcacgttctttttcagccctcagagcattcttgtggtagggcaagtgagtggcagatgcattgaggaagacatgcatgtggatacacacatattcgtagtttatttatactgtaaattttaaatatgcctaataaagttatactaggagacagtgtggtatagtagaaagagcatgggctttgaaaattcatgaagacctgagtttaaatttcacttttatcttggcaaaagcaataaaactcctggggcagagtactttttaaaaggtactttttttaaagaggcaaatacagtgttttggtgaaaaaaccaggcacaattaaatatttttttgaattaaaaatctcactactcatgtcactggtgtggctgtacagagtcttgggagatagaccatggactctattaagatagagattggcgaaattcccttcatggattaacttcaagatacctggatactccagaaagctcaaagaggtgaaaatggaagaaacagtgctggccagctggtctggctgcagcattaaggcgaatcctaaggttaactcaccatctcagtgtaaaatatgcataagggacatttagggtgctaactcaaaagataaaccaggagcagtagaaagagatgttctcccctcccccgaaagtaggcagtcatatgctcataccattcactttccttcttttctatgtggtgtcattagtctaatcttctctctttgacaggaccatccttattccagcatctgatgatttgcttaatcaaaattattttctctgaataataacctcagaaattaagaaatgtcatattttagagagatcactggtaatttttgcacaaataatttctgaatcaagaaaaaattaaaatggtatgtcagacaagtttagataaaacaatgaaaagtgttcatactaatatatgtagacatgccttatggctccacttagaaatgtcatattttagagagatcactggtaatttttgcacaaataatttctgaatcaagaaaaaattaaaatggtatgtcagacaagtttagataaaacaatgaaaagtgttcatactaatatatgtagacatgccttatggctccacttagatgactttgtttatttattttttgctaataaacaatctcttctaataatttttactgctgttatttctttatttagctatttaattatgcatgacagttgatggatagagagcagtttttcaagttaagctttgagccttcacattcaaaggtatttttcctcctgtgtttagacatcttttttgagtttacgtagtatttaatctttaaaaactgagactgagagacacttagcatagagattattaaatgtaatttatttatttatttattcattttttgagacggagtctcgctctgtcgcccaggatggagtacagtggcgcaatctccgctcactgcaagctgcgcctcccagattcacaccattctcctgcctcagcctcctgagtatctgggactacaggcgcccgccaccacgcccagctaattttttttcttttttttttttctatttttagtagagacggggtttcaccgtgttagccaggatggtctcgatctcctgatctcgtgatccgcccacctcagcctctcaaagtgctgggattacaggcgtgagccaccatgcccggctgagattgttaactataatttaacttttaaaaaacctcctccctgtcaaagaaaggatcattgtttttgttgaattatgaatgttattgtttaagcttccagagatttaatatttcaaagttcagtaacccatctttgaaagtcagaatgcctcagagaatcccatttccatatctaaaattagaaatgacatgcagaggctacaggccttttaccagacatggtaattatatgttttctctttttgagaaaacctgaagaaaaaaatcaagcattagttctttactgaataaatagtctttctttggacagtacctctgcccatttattttgtttgagaattagttgtagccatgtgtctgtgatgtattccttaccattgctcattttcttatttagaattttatttttccctaaacaaatctattaggtcactcaaatgttataatttcctaattttgtttatagataactatgtttgtgaaatgttttgccaaatttacacaaataaatacctttctttctgtgctctaattgccatacatgggggctaatgtacactctagctttgccttgtgactttaaatggatcccagtttcttagagtgtgtggaggatgcacatttgtggttagcccctatagtactgatgactgatcatcacatgtaagggatctgcctccttcctcacgtttgggaaattgaccttggggaggagtttgaggtgggactcaaatggaggaagggaaatactctctggagacagtgtgaccttctcctggcatctgggttctccacctcctgctgtcaggctgccctgcttgggaagctggctatgttcccagcctacagaggattgctgctcagggcctagagccctagcccagctaggcagatcatctgtgattttttattactacctctgtattccactggcgtatgtaattcagtactgagtgtaatttatatcactttgaagtctaataagtgtgctttttatctgcatcttaatatttgccaaattgtttttttcttctattattgaaagtaataattcctgtattaaatttgagaagtgaaaaagtaggggacgaacttcagaacagtggtacctccactaggattactggggaaaactttgtactattatgcttattacactgctgtctgccacactgctgttcaactttacatttaaaaatgtacttgaggccgggtgcagtggctcatgcctgtaatcccaggactttgggaagccgaggcaggtggatcacttgaggtcaggagttcaagaccagcttggtcaatatggtgatatcctgtctctgctaaaaatacaaaaattagtcaggtgtggtggcaggtgcctgtaatcccagctactcgggaggctgaggcagcagattcgcttgaacccaggagacggaggttgcagtgagccgagatcatgccgttgcactccagcctgggcgacagagtgagactccacctcaaaaataaaataaaataaaaatgaacttgaatctaaattggattctacctcccccacctttaaatctgtcagtagttaaaggtgtagcccatacctgtagcccataggcagaatctggcctgcagacttatttgttctgctcagcatttaaaaacctgtaagtttcacataaggaccagattctcagcatctcttgaaaatctgcaaaatatgtcaatattgagcccatattcttgccatggctggaaaaaagcaacaacaagaaccaccccctgccccctgtgacatcctcggtttgacagtttgccataccaactgatgtctcacactcagcctgcttggcccatttgcattactagtctgagccctctaggtaccctggaaaactactccagccttatttctttcttgtgtttatatccactgtctgccttatctgtagaacaactttcagagatccaaggtaggggctgtgctctctagcctctggacctttgcacattctaaaccttcttcttgaaatgcctttccccacttccttctcctggttgactcatacttagcttacaagacccagcctgatcatagtgcttgggaagccatccctgactttctctgccaggttgtgtaaagatgcccccctgcagagcacccttcattgctctgtacatctcagacatgtaataactgttctattacatgtctttcttccccttagatctagggtctggagggcagagtctgtgctacacttttctgtttattcaactattcacaattgttggtacacagtaagcttgcaatacatacttttattgatatgtcataatattgtctaaggcaatgaatccccaccttagctgcatgttagaatcacccggacagcttttaaaaatcgaagtaacatcttggcacagtggcgggctgtagacccagcttcttgagaggctgagcggggaggattgcctgagctcagaattcgaatgtagcctgagcaacatagtaagacctcttggtctctgaaaaagaaagaaagaaagaaagaaagagagagagagaggaggggagagaggacagaaagagagcaaagagaaagaaaaagaaaagaaagaaagaaggaaagaaggaagggagggaaggaaaggaaggaaagggaggaaggaagaaagaaagagagagagaaagaaagagaaggaaagaaagagagggaaagaaagaaagaaagaaaagagagaaaggaaagaaagagaaagaaagaaaaagaaatcctaatatccaggccacgtctagaccagttacatcagaatctctgaagatggggccgaggcatcaagtttttaaaactcctctggtgattccagtgtgcagccaaagttgagagccactggtctaggacatgtaggattatgtaaagaaaagcaatttcccctgatttggtttgagattaaaacatttggtgatgattttaggaaaatcactctggatgaacatttttttacttaactttggtagcatatgggcatttaaacaagtaggcacccaccttcaatgaatcagttcctcccataacaattctgcaagctatattgctgacaagttattaatcatcaatgtcatatgcaattattgacagatttttataattttggtagtttatattgtatagccatgcaccatttcctaccttgctacattttgatttaaatttcaagtggattatttttcaggcgccctacaaattaacttagacatttattgagtttccaatgccaattgcttttctttcttccatattcttctttgttttatattgggaccactatttggaataaagacagacaaaaacagaacattaactggtatctgatgtggataacgcacctggaagaaaagccactatcacttagtgaaagctgtcagcagctgcattgtccaataaatgatcagtcctgagctcatggttagtttggagggagtttcaggaaaaaaaatgaaaatagtgaaagagttgaggaaacatttatgaattgggattgcttttattttggagaataatagattgaggtaaaagaattcctgcttgggcacttttttttttttttgtgaatgatgacttgactttgtttctactgagaataagggtagtagacatttggtttagaattaagggagttttagaaattaatgtctaaagaattttttttgtttataaagactatgagatgataatatcaatcatgtgatctgttttctgggagagtgttatgacgaggattgactactgtctgatcagaaaacttctttggatttatttttaactcttctattggaaaatctcttttagttaatcttttgtatctgaaacaattgatctttttcacattgcctgtttatcttactgagaaagctgatttatctacactgaattggcagcagtgccttgttggtgtagtaatttagattttctaagattttctgcttaatcaactctgttttcccctttgagctaactgaggctaagagggaagaatctggttgttccaactgccctttgccaggattttcctctgtgtgtgtgtgtgtgtgtgtgtgtgtgtgtgcgtgcatgtgtggtgggtgagggaagctgggcttcataagagctgcagtgccaggattttcctgtgtgtgtgtgtgtgtgtgtgtgtgtgtgtgtgtgtgtggtgggtgagggaagctgggcttcataagagctgcagtgcaggtaacatggtagagtcctgatagtggcagcctgaggagccctggcctatagctggggggcctccctttccaaccctgctctttgaccccagctggctcattttcagactgggagcagtggcatcacttgacctgggaggagaagcagccagccccaaagagccagactcaaagctctgcccagcctggctgtcaccttcaggcacctgaggacactcagcatgtaattatgtgcctcgagacagtggcttccctcacagagcagagaagggaactgattaatcagttagtctagtgcactcagctggatctctcttcacagcctagtgaatcaggggttgaattatgtgatctcttccctcctcccatctttgtagagcagcccctttctgaagaggagaggagggtcactgtggggcattctaccttcctggtcacctgtccctctcctcattgctctgatgccagctttcttcccctacccccatatgatctgggaactgattagatgacttgagtagagaagtgctggcagttgccacagaagggtgcgtgcactgccaggcagggaagggctgccaggtgctaatgtcactgtgcctggcaccagcaagcgtcccagaatctgctcccgaggtccagctctgccagcatgaggctgctgtttggaaatgtaaagttctgatctaattctggcaaaatatatttttttttcttgaattgcttagattattatcctgatttcctcttcctttgattggcctgaagtgaaggccattaacagtgccatgatggcaattttatagatgaagaaatgccaaggaaattgattatatttggcatggctctgaagtaaaaaaaattcccatccctacctcataagtcctgcctttacctccctcttcctccctacatggagtttcttaactgaaggctcaactttagttttcaggccaatttggagccaagacaatgtctggctccaaatggtatttaaatagcttcaacccctccgttgtgggagttcagagtatatttccagacagatgacctcctggactctcatggtgcccacggagcctcagctctccccactctctactttgtgccctgacttctagcttcactttgatagcagtgggccttgggagctgactttgtgaaggttattggtaccaagtatgacatcattactagatatagcacttgtgtccttgcttgctcttaccatctctccagtgggacagtagagtcctggcttgagcttagagccctgctgcttaccaatgccacctgcttatctgacttctgaatgttatttactccatcctgtgttttggtacttttttgaggggcatgaagcctggtggaatgaaaaaggcaaatttgatccctgacagacctagctgtaatgctaggcctggcacatcttacttctaatcttaggtatgtttctctccaatcctcagttcttcagaggtaaaaagagggtactgtttcttatcttacaagtttgtaatggttatatgatatactgtatgtaaaatatctagcgtgcttctgagcccttaggaggaattcacatcttaattcctttcctttatctgccatccctgcttggtgtcttgcatcatgactgatattactatgcccttcatatacaggaaagcatttccttgcttgactgcacctctataattggcttttgcagttggtcacttttctcccagtctctgcttaatgtgtgttagtaggtcttgggccaggtcttcatcctgactgtcctgtccctcaagaggtgattatacaaatccaagaagggagctgcttttattgctctcactcctgtttcaatttgctagctgttcctgtgattaaaatcagcctgtatgtatttgcccctaagatgggcaatgtggttccacatgtagccttatgaaataagttaccatcctttggaatctggagtcttctggtttccaactggtttagctcagcaatgggaataacatttgttgatattaaattggtccctggtggccaccttctttttccactctgtagttaccaagcagctgggcatgaatcagcagagttgaaaatattttaaccagaaacatttggacttggcaccaaagttgtattgcccagaccaaggcaatacagaggtcagccagccaactgacagggcacatagctactagcatttgcttacggatgacctgccagcaaatcctggatgagagttcagtatctaaaaagaaaattaaggaggtcataaattgtatattattttgccttgcatagcaaaatctgaatgtcgtttaaaatgctcctcattatgctctctcatgttgatgacctggatccagtttgcaacatctgttaggttgacttgatggtggttgcagatttcagggatattcaaaagcctgttttacaagtgtcataaaatgaacggaaaatattttctgtaatttcaaataatagagccccagaggcctttgatcatactgaaagagcccatggtcagcttaaatctccctcagtttctattcattatgttatggccctgtgaagcagtcaattctaattacactgaagaaagcatttgattttcagtgacagattaatgcctaagctggaatatgcaaaggcatggaaatagtggaaacaaatgaaataaatgcctgatagcttgtcagactactctaatgaaggggtctaagtacggggccactttaagaatggaatgtatatgaagtgactagactgaatactgattctcttctatccccctcttttctccccgtcttgaaatgaaagacactgtagtgaatcaagatgtctgtgagtaatcagcactacagtcctcatccatcagaatcattgagccttgcttggattgtgttttctaacatagggcttgacaaactatggcctgtggccagtttttgtatagcctcatgagctaagaatggtttttatgtttttagagagtaagagaaaacaaaaatgaatattcaacagaaaacctatgtgactcaaaaagcctaaaatattctctatctggctctttacagaaaaagtttcccaactcctgttttaatatattaatgagatcagtctctctatgagcttaaattgaatattcttaattgtgctctctgtgaggttagcacagtggaagtgtggaaaaggtatgggcttgagagctagatagatatggttctgaatcttggctctgtgacgttctacctagagaacctcaggaaagtaacttaagctctctaagccccagagtcctcagagtagactcagtgccttcccttccacttaataggatcatagcaaatgataattcttcagtcaaaaaatagtagaccacctataaagcctgtgggcagctgtaaaaacgttgcaacaggcttgtgtgcaaatgggcaaagggagaagcaagacttggtgaacacccagggcttgccaggcacttggtgtggcactgagtgggcatcattttattacttcaatcccaaagcaggttcctctggactatggcattgctattctctagagctggcttctgcttcagattttgatgagggtgcttttttctcagctcacgatgttagcgccttccatgctctttagctgcctaaagatgttcatgtctttgggcctctgcactggatacttatccaagtgtatgtgaggctttggccctttggtggtaatctgctgccaagaacggttctttctccccttttcccaccttcctcttttctttcttaaatataattgtgcattaattgggtcaaagagaatttgatccttcctaactgttcctttcctaagttgtcactgtgatttccaagtaactttagacaagggatttaaaccattgttcctttttctttcttcataaaatgaaattggcagtattgctgctttataccaggaggactcagaagcattgcattctgggctgagaacgtctaggtacttttcataggaggctgaaattgcgggtgtgatttcagaaatagtcttctttgtgcttgctgttttgaaatgactgatcctagaaaggtctctggctgtgtagttacacactgcttgattttaatagaaaacgtttaataggagcatttttttttggagccttgcattcagtctatgagagtctgcaaggctttaaccaagagagtatgcaaagacagggtgttctccctttccctggaaaggtgggattgcttggcaagtagccttagaggaagtgtttagtgtgtgacatcagggaggggggcagctggccaggatttctaacaccgtgattacaggtagcacatgctaaattagggttctacaccgctagtacatggctgcatttagcaggaaagtgaagaagcctgaatgtgagaaagtccttgccaaccttataataaagtaggtgatgtttataatgtctattatgtatatagcacttgtccttccagaacagaatttcttgttaatatgttacttaaatattctacagggatattccttttgtcctctttggtacttttttgttgttgtctagcaggtattatttttttgaactggctagagaaaaccctgttttctggatgtcaaatatttatttcatgtacttaaagccactgaacacttagaaatggttaagatggcaaattttatgttatttctattttattacaattagaaaattcaattttacatcccccaaattatggagaggcaattagcttttaatattaaagaaattatttaaataacagctatctctagttaagttttaattttttttctttggttcttttacattttcaagtttaaaaaaatatgcattactttattttattttattttttttgagacagagcctcactctgtcatccaggccggagtgcagtggcacagtcttggctcactgcaacctcttcctcctgggttgaagtgattcttgttcctcagcctcctgagtagctgggactacaggtgcgtgccaccatgcccagctaagttttgtatttttagtagagacagggtttcaccattttggccaggttggtctcaaactcctgaactcagatgatccacctgcctcagccacccaaagtgctgggattacaggtgtgggccattgtgcctggcctgcattacttctataaccagataaaatttaaaaaaattagcgatgttctgtgaacactaataaataatcctctcatacttctataacaaagtttagcccattgatttggtttcatgcatgcatttaagccaaagtttttatttctgaattcaaaaatattactctctgataacccttgcctcagagattcagaagtgaagttggtacatttgattcaatggaacattctgcatacgttttacatctactttattctagaaaataagttttgacaacttgacagtacagatcactacatctgaaacaagtaaaatgcaccaatggtatagtctacatatttggtaaattttgtttatagagacatagaaaagtaaagatcttttactattaggcgttttatcttttaaaaactgcaactgacgggatatattaacttgcttagatcaaaagaatgttgagttaagaaaatatttggaaggggcttacaaccttttatggcctagaaactgcctttcttttcccacctaacatctcatttcattgccttcccctcatctacagagctatgtcttcatgcctatctggacagctgggtcctgatgggatctgaacagtagatactgccccggatcaggttaaatctggagcataggccagagtgaactagcttcagcataagtgaaataggtggatgattcaaagtgacggacttgtcgttatatgaaaaagacactcgcacatgcatgtttatggcagcacaattcacaattgcaaaaatatggaaccagcccaaatgcctatctatcaacgagtggatgaagatgatgtggtgtatatacacacacacacacacacacatatatgtatgtgtatatatatacacacacatatgtatgtatgtgtatatatacacacacacatatgtatgtatgtgtatatatatacacacacatatgtatgtatgtgtatatatatacacacacatatgtatgtatgtgtatatatatgtatatatacacacacggtatataccatatatatggtatataccatacgtatatgtgtatatatatgtgtatgtatacgtgtatatatgtatatatgtgtatatatatatgtatataccatatatatacaccacataatggtatataaacacataccatggaatactactcagccatgaaaaggaatgaaataatggcattcacagcaacttggatggagttggagaccattattctaagtgaagtaactcaggaatggagaaccaaacatcgtatgctctcacttataaatgggagctaagctatgaggatgcaaaggcataagaatgatacaatggactttcgggattcagggggtagggtagaaggagggtgagggataaaagactacacattgggtgcagtgtacactgctcagttgcaccacaatgggtgcaccagaatctcagaaatcaccactaaggaacttatctatataatgaaataccacctgttccccaaaaactattgaaattaaaaaagagagagagagagaaaaaagtgagggacttgagacacatttggcatcctttttgcctttcttcttatttctgcacagttaaattttacctatccttcagtacctggctcaaatactcttttacgaggctatatttaattcttccactccagcataaatgctgtctacctgctctgaattctccaagcacaactgttctcagattattttgtggagtactaaatagatgttcattgaaagtagtgctggtcaagtaagtttgggaattcctgtatgtcagggctgctttttagggagcaggtacaggggagggggagggtggtggtacttattagcatattaaaggtgctgaggagcctgcttcatccagtgttaaaaaacttttgattacagaatttttttctccaggaacaatgattagcatttcaaggaaggttcaaattgtctataatggtgcttaataaacattatttcaagaaataactccttattccatcataatatagtatctatcattctaccattagaaattattcccaaggactgtgcagagtgccagatttctgcgacatataatcaaagagaaggggaagggtgaagaacataaagagaaaatagatttttgccaacataaaccaaacattttacattttgcttagggcagggctctgaataagggcacacatccagttctctggactggtactgaacagtgaaaggttataaatgttttgagttctttttccctaggaaggattggtatgtttaagttagatgccagaaactgaaaggaagaggaatctaaatggaaacacagttgatttacctgaaagtcaccttatactccttttctattttttgcattcttgcacaaatataccatcagcatacaaatgagcttcccttttccatagatctcttaatttttccttcattgagagaagagacaaaggaagggagaagttttaaaatatctagatttcaattaaactgattcttctctcctccttaagagtaaaaagtattggggacaatggagaaaggagtggattgtgtctatgtgtgtgtacatttgcaatcaagagcagtttcatttgtgtgtgtgtgtgtgtgtgtgtgtgtgtgtgaaacccatagatctcaggttaaagctttaaatatttgtgagtatagtgagaattgttggtttgtttcttttctgtgaaaaacaacattttacgaaatgggaaagaacatttattttcctttgaagatgcaaatatggcctaaggaaatgcagttaaaatgtgagatttaagaaagacagagtctgttttttttttttttaacccagctaagcacagcctgtataaagacaagatagccttagtttgatgttgaaaaatttcccaggttccttaattttatattgaagacattagccaacagagttcttttctgtagatatgtatcttcagtggaggaaaacccaaggccctgtgtagcttctgatgaaatataggggaaaaaatctagaaaactataactggaagaagttatgtttatgctacttctatattcctgaataaatggacagcaaggcatcttcaccactcagtgaggcccccatcataagatttgagaacttgtttggcctcacttctaaccttattttagaattgcactgagaaccttggacaatggttattctacaaccaacgtctccttccttctactttccattctgttatgtctgagtcttttttgttggtaattattgattagaatagtgatcaataatctctttagttcttggcgttactagtgattataaattcttgctggtaacattggcataaagaagaatgtggaaaagacaatgagtataagaaagtggtagaaaagaagaaaagttacaaggaggaaaacatgtggagagaaagagaacaaaaaggaagctgtagataagtttggatctaccagtggtcttcttgatctcatacttgcacgggtgctttcagtttgtaaagtgtgaggatgtatctgaagtgggagggctttccaaaaccaggagtggaatataagattatatgtcagaccaagtagtttgaggaatccctgaaggtttttggctaagtgaatgacataataaatgatatgctttagcatgattgatgtcagaggcggaaggacaaaatggactggaagagaggcaagatttgttgagatgtgaggtaatgaaagtgtgaactagagcagtggtattggtgagtagagaggaagggatgtctgtaaaggcaaaaatggctaaagataattggatgtatatgattaccaacatctgaatttttacacggcgcctacttcagatattctgttttcaaattctagcaacgtgggaaatcccaatattttaatcttcaaactatttttctttaattgcttttctattgtgttggcatttttctgttttcttatttttgcaggtcatgtcctaattttgggtgcctaagtaaagatttcagtgccttaatggactgaaggagacagaatgggcaaaggtgactgaagatctatgctttagttgctgagagagctgtggtgccattgatagaagacagagaagttgagaaagggaattggtttgattgaagggatggtttgaaggaggcaagttcagctttgggcatatttagattgaggtgacaattggccagataagtattctcttttgatgatagcctggaatggataatagagacagggattggaaccagagatttaagagtcagctatgtggagctgttggttaaaaccatggaatacagtctattcatcagggactgtgttttgtagaataatcacagttaacagatggaaggaaaaggagtatttaaagaaaaataaaatcatagcatgggaaaacccaaaaagtactagtcagggaagctcaaaaagaaaggaatttgaagaagtttaatattaccagatgctgaaaagatatcaaagtgagctaagcacaatggctttgttgagaagtttgaagatcttcaagagcagtatcgaacacaaaagaaaggttatgaagcacagaccaaactacagcttgagaaaggttagtggtgaagttgaaaccagcgtaaacttaacaaaaagaatagtgtcggacatggtttctatgaaattagcaccttactcagattgctgggacacagtatttgtttgaaagcctttgtttagtatttgtggcatagtcctagtaaactggaatgccttggatctgatgtccaactgagtttttaagctcactgccctacatttctttcagttctttacccaacttagtagcacttctagtacatcaaaatattggctaaaataaccagacgatagggtttaaaactttggaaagtaagatagctcacagaaaaaagtagcagttgtgctattaaaaatctgattccacttgatagagtcattttcactgtccttgtttcccactttcattggtcttgttagactactttccttctattgtcatttttaattttattcatttatttagtttttattaacacataataattatacttatgtatggggtatactgtgatgttttgatacatgtatatattgtgtgaaaatcaaaccatggtatttagcatatccattacctcatacatttatcatttctttttgatatgttttgggacaagcaaaaacaagcttgactttttaaaaaatttatttatttatttatttttttacttgtgcatggttctaacttctgttgccctgtctcctcttttggtgagctgccagaagtcttgccttgatatttactatttggtatttggtcaaaagtgattaatatattgctggttaacttggtggtaaagttgagcagtagatgaaaggacatggaatggtataaaccataatgatggtagacagtaagcattgagcctaaaatgatattctgagtctaagaattctgaactaggctttaatgcatctaacttcagacaggtcacttgatttcacttggcctaaatttcttttaaattataggaaaaaatgtttaaaaattgcactttgtaagacaccctgaaatgtgtggaatgacattgcctagcctcatttaatataacataagaaactgagtagtccaagttataaaaatcacttgatggaggtctagactctagacctaagtttttgttttaattccagcattgttgaaggcaaggtattttcgcctttccaaaactcattttcctgtggacaaatgaagcctgcactacagatacaatgataatgtcagtaacagtttccatttattgagcactattttgtcatgtattgttcattcactcattctcagcaaatagttatcaattacctactatgtgtcagattgtcttctaggtgttttctaagtggtgttatagggtatcctacagcaatgaaaaaattcttgccctcatggaacttacattccagaggggacaattagtcagtaaacaaaataagttttcactgtgtaacatactgtatattttatgtatttattttgttaattgtccttctctatctgctagcatggatagagggaatggatccatgggggaagggagagtagcctggagaagtaggttggtaccattattgttgttatttttaaaaaaatagatcttaggtatacagaattatattaatcatattttttgctccatgacatcctttgtcattttattgttatttatatactaataatgcaaggaaatcctatgaacctatcactgactatgacatctagaacactggcaagaattttgatcttttaagttctcccattcatgccttattttgacatcatattttaagccagtaagtggggacaatgtagagtccagatcggaggtgggaagagaccaaaggtgaggagaccagttggaggtggtagatgaggagaggatgatgaggcataaccttagcagtgatagtggaatgaagagctggatgagattggctttatgagagaatgcagtattgcattgtcatcatggcatggagttattattcatcaactctttatgtttagataaagtacatgatgatgaaatcatccttggtttatttgctttcatgctttcaacatgtagtgctacaaagctagagaatctcaaaatttttatttcagatttaaaattttgctgtagattaattaaaacataaaagtacatgcaaaaggatgtaaaatttaatgtgctagaaccccatattcacagtacctagcataaaaagttaagtatattagtcctcatattacccctattgatttcatttctttgtcttcagccccagtagtaactctgctgtttaaatatgctgcttctcactttcttacttaacaacttttactacatttgcatgttgcgctaagatagatatttatagtattgtatggtcttaaacttcatgtaaatgatattatactgtatgtattccttggcagctctgtttagctcaaaattgtttgtgagattaattcatgttgatgcatgtagcattcactcattttcactgctgtccattatgtgaatataccatcatctgtttatctctttttctgttaatggatatttcattgtttttaatgttttggcaatatgttgttcctatatgccaatgttcctatgaatgtttctgtaaatatttccttgtgtacatatgcaagagtttttttaaggatatatttttaagagtggaatttctgagtaataagatatacataccttaaaccttactagctattactaaattgttctccaaattgtttgaaccagtttatacccccatttgtagtgcaagatagagagcatccctgaattttacagctgggaagacagcctgtattttgtagactagtacttctcaacaggaacaaagcggtgtgtgctgtatgagaatcaccggtcatggcccttgaaagcacacatcttttccttcccctattcctctctaggttttcaccccttggtgtgtacatgttttggtgctgggaactggaacatataattataaaaaacatataattatatgtttatatgttataaaacatataattataaaaatcttacttgttgagcctaatttgctctttgatgactgtcagtttagtggttaattgatttaatagtctatcctgaaagcctttgtaaccccatattttgttttgttggttatgctgcctaaccctagtcatattttttaatttctgcagtttaaaaaattgaaatatattagaatcattttctctaacgtcgtcaaaatatttgaagcaatggattacagttttcatatgtaatccttaagaaatcttttttgcttagctgacgttttaaagacagggatgctttaatgtaataaaaccacaaaaaataattcaattttttgggagtaaattttggtttaaaatggtacagctaagagtcctgcagtggacgtaggattcagctttctccactagttatgacatatctatctgttttccacctgctagaattttgtttttactgatttttttccttttttccattatatttgtggacttctttatctttaatcccattattttctagtagaactttgggagggagcaagactaaatagatattcaatgtgccttcttttaattccttttttaaaaaaaattagtaatggtattattaatcactgagttcttactgtgtgtcaggcactgcactaaatatattatctatataatttcgtttaattatcttgatagtctaaggagtaaagaggcaaaggtgggatcagaactaaggtcttctggttgcaaagcctgtattcacgctataccatataccctctaggcctaaaaagaaaattaaaaaagatttataatgtgtgtacatgtttagtttttgtacttttttgtagtaccatttattaatttataaagtatttaagattaaggataaattacccaacataattgtcattcttttgaaatattttccttttagcttttttttctaaaagcggacttcttggcaaatcaccaaatgaaatattctttgtatgaagaaattagtgtttttaaaaagacaatatgagatcatcccatgatccagaactccatcatttgaataaacaagatatcttgtcttctcttatctttgctcctttagttattactgtaccttataggacacctctcatgattacggtccttgaagaaaaagttcctaaggatattttatgttttatatgtattaaaataaaaaatatgtataacaagagtgtttctgggtccaaaattttgatatgtgtatttgttatttaatattatgtcattgtctttaggttctttaaaagtctgtgtcttttaaaaaacattgcatatttattttttgtagataaacttctttcctaactctgttgagcattatgatagtaagtatacatgagcgatatagattagaaggcatatttcaattctgaaatatggtcaatagaaatggtgaaaatatattagtagcaatgacaactagcatgcatccatttgtaagaatgttgcaaatggctgggctgaccacaggtgctttgttacatttatttaacaaatagtggagtatctattatgttcaaggcagtgtcctaggccctgatgcataaaattggatgtgaaattaagaaaagttgaataagaatatctaaaaggaagagctagttaaacgaccatctgtaagaaaaataaaatgagatcaaaaggggaaaacatataaacaaaaaccatgaaagaaaaaagcaatatgaaaagtgaatcttagaagacaaagtaaaaaataaaaggtccctgctcacaaagagatagaactatcttctgttatctcaagaggaaaaaaaagaagcctgctttacataaattattatgcataatttgtacaggcactggactcctggaaggttgccagggtagcttttgttgagatgaaattcaggggacttcttatttataggaaactggttaatgttgtttcctattctttatttactttctttgatttttcttaatgttcttcttgatcactgatgactagagtagtgagagaattttcaaaaatagttgatatatgatatattagtacaaaataatgttaagtttcttaatatattgtgcaaatgtataaatgattttttttttttttttgtatttttagtagagatcgggtttcgccatgttggccaggctggtctcaaattcctgacctcaagtgatctgcccactttggcctcccaaagtgctggcattacaggcatgaaccactatgcccggcctaaatgattatgtttatacttttaatttatcttcatatatgatgattctttataaatttcatttttcattttccatatttatcattattggtatagaaatggccagaaataattactataataatgctaattgttaccatttcttaaacatttgccatatgccaaatacgctatgctttttatatattagctcatttaattctcacaagaatcctatgaagcaagcgtattggtatcccccatttatggatgatgaaagtgaggcacagaaagataatgtaatttgtttaagaatcctatagctaccaaggccaggatttaaattcaggcagtcttgactccagagcccttgacaagaatgctgttcagtattgatgactaggtctgatttattctgtaaattggcttatttgaatcattgtggacataatatcaagagacgggaaggactcctgcttttattgtacatttcatatcgagacaaagttctcactgaatttcaaaaagagatataaatgtatgagtgtgcaatagattgaatatttgtatccccaaaattcacatgttgaactccaacccccaaggtcacggtatttggaggcgggacccttgggacaaaattagatgcggagtgtggaactgtcatgaatgggattagtgtgcccttccttaaaagaagagggtggagagttagtttgctttctgccatgagaggatagaatgaggaataggcagtctgcaacctggaaaagagtcctaaccgaaacctgaccatattggctccccagatcttggacttccagccactagaactatgagaaatcaatttctgttgtgtgttagctacctgcctatggtactttgttatagcagcctgaactaagtgtgcttattaaagtactgaaccataagggtgatggtattttgaatacatgttttagcaccattagtgtatgattagggcagggaattccctaatgagggaaaggtcataggctggaatcctgtgcgtgtctgtttgctcattccgtggcctaagtctgatcttttaacgtggctcctcacctgacagttgcaggcccttgggcatgaggggtgccatatgagagaatacggatggatcaccatacctccatcactaggatcatggccacaaatcagagctctgtcactgataacctctttggaaactaatagttttgcatctgtacatactatatgtatagatttatgtttttcagaacacgagcaggagatggttctattttagtattatgagactaattttttttaaaactgtatcttctaagattcatgccttatatatgtatgtacttttttaaagtctcatatttttatactctctttcctgccttgggcctcattttatttccttcagcttagtgtttttgcaattcttcctttagggatttctaaatattcatattttaatttgactttccttaatttggaattccattttatgctccagagcctcagacagtgtcataaatatgatgatggctcaaatggttaaactatgtgccaaaaaaatctgtggtcagctcagccacgtgtaacatccttatatcctgatgtatgctggctttctttattcctgacacatctttttagaaaggtagacagataaatagatagatggataaacagatagccatttgcaatggagtaatttctatttgtctacattttgcaattgaaatttgagtatttgggatcctaaaatagaaccgtaaggtgtcaaaaatctgtcaataacaatattattaataatattaacaaattgatcatgatgattgataaaaattttagatcaaaccatatgaaattgccaatattagaccattttgacctaaaaaagtgtcattttcttatggtctcacttaaaatactgttaacaatagcagctcacttgcattgattgcttactatatctgaggacaatgccaagtgctcccatgcattgctgcatcctctgatctcatgagacaagcattgttacctcccgcatgttaaagacagtggaacaggttacagatgttaagtaacttttccaaagtcactaagggcaacactattaactaatgtttaactttgttattattttgcctggcggtgctgattaaatcaatagaatatgacaagataagaagaaagataagaatgactttaccgttaaaacagtgtcagatttgacaatttttttgagccagtggtatttgtagtaattttagcaacaagagataaatgcacaaaggctcttagctccttttggctctggctgatattcgcgaaccctccacactcatatctagtaactgatataaaatagggcagaatgcagccagcttcaattatatgaacagggatcattgtcccttctcattctggttgcttttgccaatctttgaattttctaggcgagagtttgccttcctgctcagacttttgaatcatggatgctcctcattgcctagctgatccacatggatctgatcactttctgccttgacttgttctgcctgccagaccctgtgctgcaaggggatgctagttttgtatctcttggttggcctgactacccaggccttggcatcacagtcaggattccattattttcagacacgacttctctgtaggtaaaagtaatagtcttacctctgagatgagtaccatgggaaggctttcatgatagacattgcactgatgtttgggtattcaaaccttaattgttaacaaagaacatgatgagttgtagtttgggctctaatatggaatttggcccatggctcagaatgtggtttggggtctttgttagaccctggcttaaagatgctatttgttttaactttttctttaattatgctttctaacatacttagaggccattagagcaattgataaattgagtgtagtaaatgaaataagatgtttagtaaaattaatgaatatggagatatattaatagcaacaaaaatgtcactgttaagcagatgaattccattcctgatagaatctttattcaaagtccatttagatttattctattattttgtctgttaaagttcattttttaaggtaatgtgattttggagtagggagtgaaacaaattgtggaagtgttatctgctgttaccactgtctggtttttcttatttaaaagtactatctttaaaagaaaatgtacatttacaacactcattgaaacaaatttattggatagtggcagcagtccctggatgaaaaacagcattgcaaaatttgacttagttttatcactactaagaatttttattagaactgtacagaattatcagctataaatagagatcagctaatttgatgaagaggctgtaggtctgcaggtaattgaacaaatatatcatggtttaaaaaaacacacatgaaatgacagtaatagtgaatagggccaaggaaagaaaagcagggggaaagaaaggagaaaataaaatacaaaagaacaattatggatttgtgtgcgacaaaatgtggttccaatactggcctacttaacacactttctcactaggacactgttgttctttctcaaactctttgtgcttggctgctttccttccccatttagaagcaggatagcccactctctcccactctggtcctttgaccagagactaatgttgctgaggtcgatagggaagtaatggaattttgcatctgcaaatgtgatcagcctctgcaagcctggcttccagcagaaatcctcctgttgtcctctgagatacttttttactggctgattttttaaaaaaattaaagagccttctttaaattgaccaataatatttcttgttaccttctcttttccccctcttgtaggggtggcatgcgttgatttacaaaatgaacattgggaaagtgttttgatataagtttgtgtgtgtgtgtgtgtgtgtgtgtgtgtgtgtgtgtatgtatgtgtgtgttttaagctccaagggtaagagttacagaactggggaaaacgtgtgcatactctaatatccagaaagactgctacttttaaagatgacacttggagagttaagatagaaagtataaaaacatgtggccaaatcataatgcctgacaaagtgatagctattagactgtgtttttatgcaggcctctgcatactctatctaattgactaatgactgaaacagattcatgtgtgtagaaaccagatgggtcagtgggtatattaggccattcttgcattgtgataaaggaatactggaggctaggtaatttataaagaaagaggtttaattggcttacagttctacaggctgtataagcatggcactgcatctgcttggcttctagggaggcctcatggaacttttactcaaggcagaaggtgaggcgggagcaggcatgtcacaaagtgagagaaagagcaagagaggtaggggagaggcaccacacacttttaaacaaccagatctcacaagaattcacttgctattttgaggagagtacccagcctccctcatgagggatccaccctcatgacgcaaacacctcccaccaggccgcacctccagcattggtgattacatttcagcatgagatttgaggggtggggagtggggagtcatccaagctctcagtaggttaatgcttcttggtgctatctgtgtaaggatagtgcttaagcatctttacaaatagcaggtattaagctactttacctgccactttaccatgtatgtattccatgccttgcttgaccatatttaccaaaccttaaagtcatgacagctgatctaagaatagggctatggtgtttatatggacagtgtgacagtgtttagaattggtactatcctatggaattcatacactgagtaggcattcaacaagtccatattgaatgcttacaatataccaggcattaggtgggtgctaaggatgcagtggtgacaaaataggaaaaatcccttattctgtaaaacagagagatagacaataagtaagtaaaaagcagtggaggttgataatgttaggtactagggagtaaggcataaaaaggggctagcaagtattgctgggggtgggtagagactgcaggttttggtaggaagtgagcgtcattcacacctgggacacatggtcatggtaccacccatatgttctgcccaggcacagctcttgcgtctcctgcattatttccttagactccataacctgctcagacctcaagaaaagagaacctttcagcatatagacataggtagagccactaaaagctaaaccagagcaaaacaccccaaacaccctttatttataataggttgccaaaaatcagccaaaactaagtagcaaatatccaaatattctgagaaaatgcataatttttaaaataaaaactcctaattcaaacatttccacctggatctctgtacctccaacaggacagccattcttagttaaggagaccaatgattacaagtaagcaataatttcagggcaaggaaatcacacagtgagaacatgatacatgtcgtcattggcacaaggaagaacaagcagtggaaggctttggtctcggtattccagaacgtgccctgtacttgctgcttgcctctgcctgttgtttcccctaccccctccttgggtttcctttacctggaatgccctcctccttgtttttgtttagcaaaactccacccttgataaaaaaaaaaaaaacctagccttttatgtctgtttctgtggtatatggcaccaatgaatactcaataaatgtgtaatatgtcaatgagagaatcggatgaaacaagggagcacaactggcatatacctacttcatttctctgtccacaaatagctgtcagaagtgacatttccaggctttgtcccatttctgacttaaacactccctcttttcacactcttctgattaaaacaaagcaaaactgtggttaaggaggctgctagacaactcactcaactgccagagagggaggctcttttgcgttcatgtttttgagtggacatcagatacaatttactcttttctcatccacctttgaaacgtggctgattttcccttatcagggctttctgtttccttcttgcctcactaactcccttctcatcctgcaggtagacaggctggaacaggatttcatttgtagcctgtcagctcttcttgtcagctggcagagatatggttgagcattaagaggggttgggaggtaaagttattaagggagcagcagctttggtttatcaggaggtgggaggtgggggatgaatacacagatattttccaggtcattaaagagagcaaaaatcctgagcttttgtcccattggcatgcctttcctggcctgttctctaacacattagggtgtccttcacacatgctgcacctcaacttgcaaaggtacagcctggcagctgcgtctcagccatgggaaacaaagtggattggtctgtcacataaacagggctgaaatctttagggcagttgagaaaacaagaagaaatcccaaagccttggtatgatgaatcttggccttgtgagctggctttgttctctgcttagacatttctttgggtgtagtggttgtaaaaacaaaacctaaggattttctattgttaccatccttcttatcatccttatagtcattgttgtagctactattatggaatgccaaccctgaaccaactgtggaccctgtgctttacatggattagctcatttaatccactaataatcttaccaaggaagggttgaccctgagcttttaaccataatctagtactacatcagaaagaaaaagcatgtatatagttccatcatggtgaaaatgtattagtagcagtgacaactagcatgcatcctagtggagtcatttgtttgaggtaggttaaagccgtgaagggaagccatttgtaaaccggagtattttacgttattcccaccgtaccctgaaaatttaggattaatttttctaaatggattatggaagtttggattaatggaagagaaacaagttaaatcatagttatgctttgttgctctaaaatctgaggattttcaattttttggcaaattttatggtttcaagattcctgtgagatgataggtcagagtctatcctcagtctaccattgcacgtgctgcagtggagaaaactatgacctaaaaattgtactcaaagctttcatttttctgttgaatattggtgttatgttttctcttgcaattttaagactactttaaatagtttaaaaatagtttcatatgctacttattcatacttcgcatgaataagattacagcagtagtagacttaagagtatttaaaaactatttaaagcagctttctaattgtccactttagcacagattgtaaatcagcaaaaacattttctgaattccatgccaggaactctgttaggtgttggggatggaattcagctgaacagtaccaactgcaatctgcccataccttggacagcacccaagggggtttaatattggatgcattggaatgctcttgtttatacatgtttcatagttgctagggagaacccaggtttttcactggtggacacatatttaaaagtcaatttatatatggtctgacttaattttttaactaaaaatcagtgatgagttggatgttcccaacatgaagaaatgataaatgtttgagatgatggatatgctaattaccctgatctgatcattatacatgatatgtatcaaaatatcaaaaagaaattagtgatgagttgggacaagggaatatgaagtgtgatttgaatatgagctgatggcagtagaggctttgttcatatatattttatttttgtcagtaaccctttttaatgccccagtatcatgatctaatttgagtggaattaagcttaaacagttcaaaattatatagttaagacattctgtttcaaatattattccaagttaatctaagtcaactagcatgacctctgctacacaaaggctggtacaaaaaagatttcgaggagcaggtggccagggccctcatgggagctaattagatgtctcttcctgttcagccctgactactgggtccccctaagcctccccaccgaataatctgttaggccgtcttctagagtctgaaaggctgtttgtgaggagttcaggatttgtgtgaaactgtgagcagagttgtaagaaatttagatttgagtttcaaccatgtcctatttagcacctgtgttatcttaaggaatcttcagctctctgagatttggttttctcattagtaaaatgtatatgatatgcctgacatgttccaggcattgctggctatctctcttcagtccctagtaatccccagctgaggaatggtgctagagcaggtaccctgtattgttctacaagtagtattaatgaagttaatgatagtcactggtttttgtattgactgcagtttggaatatagtattttcattacaagtcaggtgtaaattcaatctacatttacttattgaataccatctacgtggtaggcttagtagaagagattagagatgtaaagatgagtatgtgttcattttattcagggagctcacagtttattaaggaaaggggatgttgagttaactaactagagtatggtgaaatgttttactccctgagtggatacactgctatgtacaatggcagtggaggagaagaaacaggactctgcttggtgggatggggaactcaggccaggcaaggcttctcagagatgtcatttagctgggccttgggatatgatggagttcagagaaagaaggtggaatggaaggggattctaggtggaggtgatagcctgaggacaggcatggagctgagagagtgcttggtatactcttggagttatggggaatctactgtggctggattttaaggtatttgggattgtacaggtgagactggaaatgtagtttgagacataccttgttcttgtttttaattttatgagtcccaaaaacaatgttagtgcatttttttaattttgaaatgattgtaaattcacaggaagttgcagaaatggcagatagagtctcttgaacccttcactaagcttcccccagtgataacgttctgaataatttcaataaaagattaaaactagatattagcattggtgcaataatgttaactacattgcagaatttacatttactttttaccagtattttattattaatttttatttttattttaagttccaagatacatgtgcaggatatgcaggtttgttacatatgtaaatgtgtgtcatgatggtttgctgcacctatcaacccatcccctagatattaagcccagcatgcattagctctttttcctaatgctctccctccctcgaccccaccccatgacaggccccagtgtgtgttgttcccctccctgtgtccatgtgttctcattgttcagctcccacttataagtgagaacatgcggtgtttggttttctgttcctgtgttagtttgctgaagataatgtcttccagcttcatccatgtccctgcaaaggacattatctcattcattttaatggctgcatagtattccatggtgtgtatgtaccacattttctttatccagtctatcattggtggacatttacgttgattgcatgtctttgctattgtgaatagtgctgcaatgaacataagtatgcatgtatctttgtaatagaatgatttaaattcctttgggtatatacccagtaatgggattgctgggtcaaatggtatttctaggtatttgaggttctaggtatttgaggaatcaccacaccatcttccacgatggttgaactaatttacattcccaccaacagtgtaaaagcgttcctatttctccacaatctcaccagcatctgttgttttttgactttttaataatcactattctgactggcgtgagatggtatctcattgtggttttgatttgcatttctctaatgatcagtgatgttgagctttttttcaaatgtgtattggctgcataaatgtcttcttttgagaaatgtctgttcatgtcccttgcccactttttaatggggtttttttttcttgtaaatttgtttaagttcctatatattctggatattagacctttgttaggtagatagattgcaaacattttctcccattctttaggtttcctgtttgctctgatgatagtttcttttgctgtgcagaagctatttagtttaattagatctcatttgtcaattttttttttgttgcaattgcttttggtgattttgtcttgaaatctttgcctatgcctatgtcctgaatggtattgcccagattttcttctagggtttttatagttttgggatttatacttaagtctttaacccatcttgaggtaatttttgtataaggtgtaaggaaggggtccagtgtccagttacaaatttctgcatatggctagcagttctcccaggaattttttttttttttttttttttgagacggagtcttgctgtgtagcctaggctggagtgcagtggcacaatctcggttcactgcaagctccgcctcctgggttcacgccattctcctgcctcagcctcccaagtagctgggactacaggcacccaccatcatgcccagataattttttgtatttttagtagagatggggtttcactgtgttagccagggtgatctcgatctcctgacctcgtgatctgcccgccttggcctcccaaagtgctgggattacaggtatgagccaccgtgcccggccttaaataaggaattctttccccattgcttgtttttgtcaggtttgtcaaagatcagatggttgtagaagtgccgtcttatttctgagttctcttttctgttccattggtctatgttttaccagtttttacatgcatttgtgtatgtgtatgtgtgtgtgtgtgtgtgtgtgtgtgtgtgtgtgtgtgtgtggttgtgtgtagttccatcaccacaaaggaacttccttgtactctccatttgtattcatatcccctatcttcctggaatccactaatcttttctccatctatatagttttgtcattttgagggtgttattaagtgcaatcatatagtatgcacttaatactcaatatgtaacttttgagattgactcttttgcctccactaaacagaatgtccttgagatccatgtaagttttctcatgtatcaatagcttgttccttttcatttccgtgtagtattccattgtatgaatgtgccatagtatgtttaaccattcacctattgagtgacatttgggatatttctagtgttgggttattatgaataatgctgtcatgaacattgatgtgcaggtttagtgtcgacataggttttttttcctctgggataaatgcacaaaagaacaattgtcaggtcataaggtaagtagcgtttagtcttaggagaaactgacaacctattactactactactactattactactactacttcttcttcttcttcttcttcttcttcttcttcttcttcttcttctttcttttttctttcttctttcttccttcttctttcttctttcttccttcttcctttttcttccttttttttttttttttttttcagaatggggttttgagtgtttgggaggagtaccaaatccatgatgtgaagctatttgtagtttgttttagacatggatttgcctcctgctctgaaaacgcattgtatagtggtcagttccttagctcttaagcaatgagtatccacatctcattgtgttttcagtattctctaaagtgactcttgcttccttactgaggctgtgatctgtaagagccagtcatagggttaagctataaagtatttttagaataactaaatttttttacttgtgtttctaaaataacatacatagctcaccccaatatttcatgtaaattcccttgtttcctccctattcagctgccctcacatctatagcttttattccccttctctaagatactccaccatcatccgtgcatttttatttctcctcatctgctgtaccttcttaccaaccgatctcttatcttgtccactcctctctaccacagacttctcctaagaatttcctcttctcatttttgcctttttattgtattgaccatgttgccatccctagccctaccacttggccgattctgcatcatagaaactagcttagcagcatattatcatggatgtgaatatatttttgagtagggaatatgatcaagagttctatagtatctttccaaaaacattttttagagacaaatcttttctcccaaatattcatttagtttggaacatctctgctcttactgtaaatcacagtgacattatccagggggtatctagggataccccctggatagtctgctttttgatcacatcccatgacttcttatccttctctgttctggccagaaatcaatgtgtccatttttttctaggccagctaatatttgaggattgaaatatcttttcaggtatcttattatttggaaatacatgataggctctaactatgacagataggaatctgttgctctcaagcagtcatcctaaggaaactaagctctgaaggcttctggaagtatttttaagaagtaggaagctgctcttgaatttattgcttttctttggaaggaaaggaagagagagtatttttaagaagtaggaagtatttttaagaagtaggaagctgctcttgaatttattacttttctttggaaggaaaggaagagagagagagagagagagagagagaaagagagagagagacagacaggttagcagtgtgaatagtgggcaggggacttcagagccttccgctctgttactgatcttgtggctctctagcaagaaggctcttgtgcttttgagcaagtcattttacctgatttccatcatctgtaaaatgtagcagctcaattgaatttttcagtctctaaaattttggtatcactgactcacagatacagagaaagtaaatgagttgcctaaagttacgtgatttactcatggcggagccagcactcatccccctcccccatctaggtccctgtagttcctgccttgtatattggtagtagattatctgagtgtagtttggacactttctgtgttttctgagtggactcctcattaatccatctttagtcaatcaagcactcttggttattacttaaagtgataacattaggttctttagttggtttcctgtttttgacctgttggtgaatttttaccaatctcatgtgacaaagatcgtggaagctttaaaaaatgttctctaaaatcttaatgcaaagtggcattctccttcccttcttagagacattagctccactggaggaaaaaggcacaaatgcctatttcatcttaaaaatcaattatcttgccttacaacataaagcagtattttacacattgaattatttgagttccaccttgacattttttcttctttgattgcccccctgctgttattttcttaacattttttctttaaatggacctactttattttacttaagtgtattttcaaaatttgataactgtgaactcacaggttgatttattatgttgtttccaattcactttaaagtaataaactatatataaaaaaagctttcttgtaccatctgaaaccttctcatgtgtatatacagtactttgggaaactttgcataagaccatctgggtctactggttgaatggtaagagaagggagtaataaaaaaataagaaacaaaaatgatactgttataagcttataagccatgtgggtaataaattagaatggaaacatgagtttgtaaagacagataaatgaatttccttgacttcaagccactgttattgtcaagataaagttgtgcatgtagagaaggaagtctaacaaaatgacattccattctggggcttaaatgcttgcccttccttcttttttatgactcttgctttattgaatagcactggggtcataaggccccagtagatgtaaatgctatgctgtacatcttgtcaggaaggccagcctttgtgtctgcgggaggaatgcttgtccttgttgcaagaaggtaaaacagtcagaagcaaatgagatcagatttagattgccaagcctcgggtgggacccttggaggtcagaacacagacaaaaggaaacaggaaagcatgtttaagagtaagagaagggtagggctagcttcgtggtcatgtaaccatgtgaacttgtggttgcacaagttcccatgcctagaagggccctgaacttggtttaatgctctgctgtcactgtcttgaaattcttattaatttttaaatgaggaagcttgtatttttattttgtactgggccctgcaaattatgtagccagcccttggtgtggggtagacaaatgcttatagaagactttgtggtttaggttcatggggtagaactggaagagtgagaactagatagtaagttgcaaaaaaggaaaaagtttcagctactaactggtggtgtctcttctgattgaccttagttcatagattaaataatttaacattggactccaggattctttttgccttaaactcctaggctggctgactaacttccttccatggttatgaagtagtagagggaatggcaaattatatctggagaacatggataatgaaatgaatagatctctgagaacttgaaaaaattatgtagtaagtttgttcctgatgagttaaagtgtaaaaccaactcatagtggattaagtaggggcttgcatgtaaatatccacaaagggtggctataagacaacagagagtgatgggcagtagaggtgatggtgggcacccaaggaaacatagcatgtttaaaggaaaatctgtattgaatttcagcctgttattgccaagttatgttcagtctgttattgttccttgtagctcaaatccttccaggttttttagaagtagctggaaatctggatttttgactgtaatatttttcaattaaagaaaaacaactatgtagactatgtctgagttgaattcattttaatccttaagtggactttttaaaaacctcttttctaaagattaatataagaagtgaccattcaaattactgttttagggagggagtcatagcaatgtgaggccatctctagtaaggagatggaattagagtaagagttgccagtggatactgaggattatgatacagaaggagctctaaattttctatattggagggtcttgggggttaaaaacaggcttgtctttgaggacttatgctatggcttgaatgtgtccccaaatatcatgtattggaaacttaatacccaaatttatatgttgatggcatttggaagtgagtcctttgggagataattaggattagataaggtcatcagggtaggcctcccatgatgggactggtagctttataagaagaggaagacagacctacacactacttgccttctcaccatgagatgccctctgctctgttatgacatggcaagaaggccctcaccagatgctggtgctatgctctttgacttcccagcctccagaaccattatctaaataaatctttattgtttataaattacccagtctgtggtaattggttatagtgacagaaaacagactaagacaacttatttgtaattatgtttgcgtagcaaactcactgtttttacttagattatatgacgtagtcataagaaatagccaacctttctagtacattttttcccacaccttagataagattgaaaaaccagcaatttcccatctctaggagtgggtggggaactcttagagctgctggattgtaaggggaagtaaaaaaaaagttctcacaccccagaccagtcttttacccaccactcttatggtttatttttaaaacaaggtcatcattattatggatacatcaggctttcttagcctgatatcattaaacatgcaattcattttgtgatttcccctgagtgtgtgctaaccttctgaatatgatttggcttcccaactggattggtcagagggagggaatgggtaggtcctgcagtttagaatataggtgtttctatgactatttattgttaattataacttaataaattgacattctagcattaaacagcagtcttgtgactgtggtcagtgaacctgccagtgaaatttcgaatctctttggtcagctgacacactcagttttgaacttgggcagctcagaaccagatcctagactatagcaaactggtcaaagtaatgaatgaaattttgggagccccgttggaaagcctttccctaggtgacataaaaaatatatctcgaatgtatgcatttttcctatttgaatttctttagtgatagagttgagacatacggtttataaaagtcatggagtagggagggatagccccatggaagtgttaataggatttcagataattttgggaaatgctggtttaagtgaaggtaactgatttctttatgaggacttttccagaacatttattcttctaatgagtgatccagtaggaacaaatggtaagtggtgtttctcaacctcatttgctaatggtacttttaaaatgtttccttggcagcacttttggaaagcatcgtgaaatatttaccaagtgcagccttaagaatacaatgaaattgagatatttctggaattttcctggtgtctagtcagttttgggaaatttgtgctgaaccccagtttgcattgggtttcataagacctaccagagagttctggaatccacaggaatgaccatttgctcactaggtatctgtattagtgagagttcttcagagaaacagaaccaataggatgtagatacagatgtacatatagatatacgagctgaaatttattagcgggattggctcacacaattatgaaggccgagaagtcctacagtggacggcatgcaagctgaagaacccaggaagccagtggcttggcttagttcaagtccaaaggcctgagaaccaaggcctggtgtaactctcaatctatggtcaaagacctgacaacctggggatgctgctggcacaagtctccaaaggctggagaacctggagttcttatgtccatgggtagaagaagatggtattctatctccaggggagagagagagagagagagagaaggagagagagaaagaaggagagagagagagaaagagagagagagaggagagagagagagaaagagagagaaggagagagagagagaaagagaaagaacatatttgcctttctttctatctgggctgtcagctgattggatggtgcccacccactttgggtgacggaggatcttccttattgagtcgactgattcaaatgtcaaatctcttctggaaacactttcacagacatgtgcagaaataatactttgccagctctctgggtatcccttaatctagtcaagttgacacctaaaagtaatcattacaatacatgaacctggaattgtcccagtgtggacccaaggcagaaatggaatttagtaatctggggttgggaatttggatgtacatattgtgagtcatcttggaattgccagagtccaagactttttttttttatctatatatattttctcctgatagcttacttcttaaaagggaacttcccaggttgaatatgcaatgcttattaagacccattccagaacccggctgtgttctcacagataggactcaatgagcacaatggttaaatctttatctttacagggatttttttttttttcagaggattggagattagattatagagtaatatggttttatagacattcatgttactttctttgtttctagaataaggaaaaggaatgcagagctacatttcttaatatgaaatggtgattgccagtacagcccaactgtatattttcagtttgtaatgacaacattaggaggaaaattgattagtacttttaaaacagtaggaaaattatttctgcccaaacattgattagcctttgaatggactttcttataattcttttcttccacagactgcagggtgcagcacagtcatattttaggcagagtcaagcagagaaacctacttgccgctattaaacttattactgccttttccagtgggtgcaaataactttgtctccagtagttacactctcctggcttgataacacataaggacttctttgtttattttgattaaagagactaaagatacttttgtcttatgtgaaatgtgaatacagtgaaatattgaaattttttgatgacatatattcctccttttggcttataaatgtcaacttgtttagcttccttgcatgagtgctttaaaatttattagctgaagctcaggtaatattaatttgttcctggttaaatgttatataaaatataggaataaagaaaactgaggtccttaccctcaggtaacttatatatttgaggagttaagacatagaaataagataaataggagagtttatgatgagccccagatgagtgggttggaatattacataaccaatacagggtttcagaaggagagagattttgtgtgcgtgcatcctgaaatagttggggaggactcatgcaggagctggaacttggagataggaagaattcatgcaggtggaagagggtaggagggatgctggtgccattagcagagagggctagaccagaacatgcctgctttttcaacagtgagtagatctgtttggctctaatagaggactcatgatggggggtaatgaataatgggaaataaaactagagaggtaggttgaattcaaattgggaggggctttgaatgccaggcaagggaatttggactttattctgtagaaaatggatgaacagtgaaggttcttagccaggaataagaagaaaattgaagaaattgctttgtagtttagttagagcagaagcagcgtacagctctgaacccaagtgccttagatggaagataagggcaaaaagaactgtatgcaagctctgtcttcacttctgatgagatgcaggaagaagttagctgcttaattctctttatttttccttctctcatttaaggcttgtattaaatctctttttcagtcttaaaatgcattaattcaaatttgaccttccttactgtctgatagttgaatatccaaagctattttcagttgttccagattgtcacagattttgatgtctaggtgccaactggaagggccaaacctggcctgcggaggattgtttttaaaatctgattctaaattaagcactttgagacagaagaaatgagatgtggcctagttctaactcaccatttagctaaatgtatatgtatttttttctctgcctaaatatttgtcttattcttttagacccaaaaatctcagagccaagaatatttagattccctttcactctttcactttttccaatagtttttggcttttactattcttaataagttacacttataaaggaatgtctccaaatctaattcttttttttaaaaaaaattgttttaaattcctggccctcctcctatcctgtatctcacaaattattaaaatggaattgaatttatttcttgaaggagaagctactgataggatttagacttttaaatatctaaaattaagttctaaacaatagtgttcctattagcaatagaaattgtggttatagagaaacatagtatagtgtaagctttagagcacgcctgtccaacccgcggtccatgtgccatatgcagcccaggacggctttgaatgaggcccaacaaaaattcgtaaactttcttaaaacattatgattttttttttgtgtgtgtatggcaattcttttatatatatatatatatatatatatatatatatatatatatatgttttttttaattgtactttaagttctagggtacatgtgcacaacgtgcaggtttgttacatatgtatacatgtgccatgttggtgtgctgcacccattaactcgtcatttacattaggtatatctcctaatgctatgcctcccctctccccccacaccacaacaggccccggtgtgtgatgttccccttcctgtgtccaagtgttctcattgttcagttcccctagttcaaccattgtggaagacagtgtggcgattcctcagggatctagaactagaaataccatttgacccagtcatcccattactgggtatatacccaaaggattataaatcatgctgctataaagacacatgcacacgtatgtttattgcggcactattcacaatagcaaagacttggaactaacccaaatgtccaacaatgatagactggattaagaaaatgtggtacatatacaccatggaatactatgcagccataaaaagtatttggcaattcttaagaaaagctcatcagctattgttaatgtagtttatgtgtaactcaagccaattattcttccatgtggcccagagaagccaaaagactggatacccctgcttttgagccagaaaaacctgttttaaaattctccctctgccactcaccacttaggtgatctgaatgtattactgtgactacacatccttatttggaattccatgggtagaacttaaagcaagttcttttctctttacataagtggactctggtctaatacttacagtgatagagtatgggtaaatacacaaatagacttttaagggtatcctttagccttcagactttctgagacccgctgagatacagaagagaagaagtggagagattccatgggcaaaaagggacttgagagttatggctcctcaagatctaggttcttattctcactgagcctcggcttcttcatctctaaaatggagaatatttaacttgtagagatattatgaaggtaaaaatagataatttagcacaatgctatatatatatgttttaaatacttgtcttttgccagataccggtttgcaaatcttttcttgccatctatggattatgtttccatcctcttcacatgtcttctgcagaggaaaagtttttaatcttaatgatttacaacttgttagtttttccttttcctggattatgctttcaatgtcatgtctgagaactgtttgtctagccctaggttatgaaaattttttctatgttttttaaagagccttattgaaatataattaacatactgtacaattcacccatataaagtgtacaattcaatagtttttagttaggttcacagagttgtgcaactgtcattctgataagttttagaacattttcatcaccccaagcagaagctttgtacccattagcaattatgctctatttctccccatcttccttgtccccccaacctaggcaaacactaatctactttctgtctctgtagatttgcctattctggacattttatataaatagaatctgtggtcttttgtcactggcttctttcacttgaacagtgttttcaaagttcatccatgttgtagcatgtatcagtatttcattccttttcattgcagaataatattccattgtattaatatgaatatataagattttgtttatctattcattagtttatggacatttgattgttcccactttttggctactatgaataatgctgctatgaacatttgtgtacaatatgtgtatggacatatgtttcttatatatccaatatgtacataaaaagaatatggtacatatattggtgtatggttggtagaaatgcctattcagagtctttgtccattttttgttttaatctttttatcattgaattgtaagagttttaaaagatattctggatataagtcgtttattagatatatgatttgcaaatgttttttccattctttgggttgtgttttcatcttcttgatgatatcatttgtagcacaaagttttagattccattgaagctcaatttctctatttatttattattattatttttggtctcttgtgtgctgttgtatctaagaatccattgcctaagccaaggtcacaaatttactccaatgttttcttttaaaagttgtatagtttttgctgatacatttaagccctattatacattttgacttttgtgtatgatgtaaaaatttcttatgcttccttctaaaaattatataggtttgtgtttttgtgttttacatttaaatctgcgatccatttaagttaatttttgtataatgtatgtcaattatgccagtatcatttgttgaatgtaagctaaatttttaggtaaaaatttaagtgccctatatacagtcagacttcaagctggtttttcttcagagaaggaaatacatttgagaagggatcttccactttatttagactttaaagaagaaaaataaatagaaagtagaaatattaagaaactacgaagtaggtgtaccacctccatttttccaattgcaaaaagaagatagtttttataaaggtgcttcataataccacttaaaagatttgcaaatagaatagtatttaatgagattatcttccaataaagaaaatggaaaggtttctcactgaaggtgaaaacacatatattattttaaaagttctgaagtcttcaaactaaaataatgtactataacaaaaaaacttggtttttcatatttcaagtctttttgtctggatctttgttcattcatggcttttattaggtttgcaaacagttggtggacatgtggtgaagtcacacctcattaacagaatataaattttccatgtggttttgttgcctctttgcagttattttgctctaagacaaacttctgtttcataaaagttgggcctttctgtcttgggaaatctctgcagatacttcatatttgttttaaattacacatcgtctcttaagttttccagtcatgctttatacttcattgtgtgccttaaaaatgttgtattattaggatcctcaccttgaaagattgtttcaaaaaattgttattacattgaaataagtcttttaaagtacaacagtgtcctgttatctagattagatggataactgaggattagaatatgtatggaagatcagtcaccagttaaattggttggttagttataaagtatatgttgacagtgtgcatagtgctttgtgatactcttgaaaaaaattttaattgacatataattttataattagcataccataaacttcaccttttaaagtgtacaagttagtgcttctttttaatatgttcacaaagttgtgcaactgttacccctatctaattctacattgttatttgttaattgcttattatttatttattttttactagttttttatgtgtagcttacttcaaaatatatttgaggtaatttacagtaagagactcattataacagggccactatgatataagaggtcaaaaacagtagtagaaaggaaagaataccaaaaactcaaactgaaattaatgtagtattgctattaggcaaagcatataaatccagaactctgaatctggtagcatttttttcttctatcatggtgcaaaatttatttctcctaagaacttgcttttcttaaacaagtcaaatcacactgtttcttccctctttaaagttccctcttgattctcacagccaaaagtcatgtttcatattaatgtttgagacttattcaaggtcacatatatttggggggcaaacatggcatatcttcttgtagtatcaatttttcctaaaaaatttagagaagaaccaatattttatattaattttaaaacattgcttaatgtaaaaaatagatatagagtggaatgaagaatttgcctgaaatcaatgcaagatttcaaatagatatgctcaattgtgatctcagctgagaaaaaatgaagtgaaaatagagtagaataacgaatttgcctgaaaggaatgcaagacttcaaataaatgttgtgctcaattgtgatctcaactggtaagtgtgatctcaggaacccttctgcccttcctagtacatattttctctttgccagtagtgatgctgccttggaaatacctgcaaaaactgcaaagttctggcttaccaaaccaaacacacacacccagggacataccaaaaacaaaacaaaacaaaacaaagcaaaaacctcagaaacaaaacaacccaacaaatgcccaagccttatttccaaatcctaagattggtataaaaccactcacaatatgctaaacttctctcagattgggaccaatattgggccttttccagattcttcttgcctggaacaccaccatgcttcctgcccagactatcagatcaccactccttcctcgggtctcagctgtgaaatttctgtacaagttgctatgttccctaggcattgtgtttctgactctgtcctctgttgctggaattaccacagtgaattattatggaatggagggcagtctgattaggcatagagtacgatggtaatggatgtatattccttcttaactgcagactcctcaaaagcagggttcatcttttactcatctttatattcttggtgcttcctattgctcccgacacatagtacatatttaataaatgtattctggaattaatgaataaattctgaatgataataatttgtggagtatagtaatgcagataattttatttgggcttagtagtttgttgttgttttgtattttagaataaatggttttctcatatatcttattcccttcttagtacatcccagtaagacttctagcacccatcagtgtactgaaactgctcttgctgggtcaacaacaacccagggtccaaatctagtggacttttttttcccgttgctttcttaatggagctttccattgcatttgacactattgtaacttcttcatttttgaagctccttactctcctacttctgaaacagtgccctctcccacatcttcttatatcaactattacatgtcaacaggctattcttctggctgcttcttaagtgtttgttagtgtccgcaggttctatcttccactcttgtccttctctaccttgcactggggcatctccctctgtagtctccctgtgtctgttctgtgaccataatccttagattggggtccttagttcagttcttgtgtgaatattcttctcatctctgcagctgcctccttggcattgccaccagaatagtccaaagcttcacaaatgttttatgtctaaaatgaaattccccttctttcctgctaaactagttcttctattaacatattctttctctcattttatgaaagtataccatctactcaattactgaagctggaaatctggcagtcctctaggatccttcttctttactttccccttcaaattaaccatgaaaacctctcatttttttcccctgtgtatttcacaaattaattttattatccaaagcgatggccttctctctccagtactaccgcagggtggagagtgcatatggggagtggagaaactgacactatctagcccagtgacctcattttgaacctagtaatccaggacttgtcagttatatgggcatatattaaacattaaataattggtgttttctggtcctggcatttccagaagcactctgtctttttttcacagctacacatgcactatttcttggttcgtgcctcatagttcccctgctggcctgtcctgccctaggattctttggattaccctagacctagaatgacttgggtcttttccagagccacattagggaatgttctccagaacttctttcacattcagcattccctgcatccaagtagcagtcagaggactctggcatggccaggagacctgcattctctttctttctttctttctttctttcttttttttttttaagatggagtctcgctctgtcgcccaggctggagtgcagtgacacaatcttggctcatggctcactgcaagctccacctcccgggttcatgccattctcctgcctcagcctcccgagtagctgggactacaggtgcccaccaccacgcccggctaattttttttttgtatttttagtagagacgcagtttcactgtgtgagccaggatggtctcgatctcctgaccttgtgatccgcccgcctcagcctcccgagtatctgggactacaggcgcccgccaccacgcccggctaattttttgtttttgtatttttagtagagatggaatttcactgtgtgagccaggatggtctcgatctcctgacctcgtgatccgcctgcctcagcctcccaaagtgctgggaacttgggctggaatccggggatgattaggaaaaacaagccatgccttgtcttccatacactcacacccaacactgatacttcgcttctggccactaaaatatgtggaggtttttcctacacagccaattctctgacaccagctgagtgtcttacaattcaacgcagttctgacactatctacccacaggttaagggctcagtcccacaagactgcccttatttcagacactgatcacaagtccagattgtcacttacactcctcacctacggctatcaatcagaggttcccatgagtgtgtccttaggtttgatcatttgctagaatggtgcacagaacacagggaaacactttacttatgtttacctgtttaatacaaaggatacaacccaagaacagccagatgaaagagattcatagagcaaggtccaggggaagcactagatttggacagtgggttgttgttgacccagcaagagcagtttcagtacactgatgggtgctaaaagtcttactgggatgcactaagaaggtagcattcctagcacctccatgtgttagggaagctctccaaaccctgtctttttgggtttttatagaggtttcattaaatagtcattgttgattaaatcattggccattagtgatttagtcaacctccagtcctgcccctctccctggactttgggggttgaggctgaaatcccaaccctctaatcacatggctggtccctctggcaaccagcccccatcctgaggctatccaggagcctccagccaccagccatccaataagtatacaaaaagaaacatcattttggagatttccaagggttttagaagctgtgcacatggatactgggcagagaccaaatatatatttcttattatgtcatgggcaattaccattttctcctgggctggcagggaataggtctgcttagccagctctcaatctgcagctccatgtcatgactctaccattgattccatagagggagaatcttatttcactttaaggatattgcttcttactctttttttttggtggggggggggtcattattgtttttctctcttacagttttttggtcattactgttttcccatacttgtcagagagtaatccccccaccccacctccctgttttctctctcctgtcagtcccagcactctctaaaagacatgcttgtaaatacggtcatttttatacctttttaattttcttccctctgtcacaaaagatttgaaatattataccactgtacgaccagatagatgttaaatttcacttaccttataggcaagagtttcttttttaaacaggattgtggggtgataggatctcattgtttagaaaaccagaggggtagctcctgttgtcagcgatgattaaaaattaaaggtagtgtctgcttctgatttatctgtatttacttaagcagatgtgtttttgattgtctatcacctagggctgaaaaaagggcaccaaatcagtgattctattattttctttgaaaagttgagggctatgtccaaacttgaggccaaactatgttgaaaataggtaatttaaatgcctggtttgttaggagtaaattaccgctgccagtggattccgtggctgcttggcaggggtaatttgcttcattgcagtgttttctagttgaggtaaattattccttttagaaagttaaatcttcgtagagaaagtaaacatttcatctttgagaaggaagaatagcttgttaaaatattgaaaacatttattgaacatctaacatgaagctttgacgggaagaaaagagatacattttagagaacaagactttttaccgagagtatgccttgagtaaagcacttagtaggggcattagttatctagagggaaagatccgatacttggggaatgaagagagaggcaagccaggaaatgggaaggaaggaggaaggtggaaaggtacccaagacacattctgctgttactccgtagtgaccctttccgaagcctgtatttcctgagccaagaccttccattgtctttcaaatatcaggcctggttttgctcttcataggaaatgagttcattgtttttgacgtcctgtcgattttttcccctcaaagagtagataattagaactttgatgaagaaaaggtcctatgttctgttttatacataatcattttctgaaccatcaagtgtaattcagcttcaatcttcagggcgaatgaagattacttaggatgtattaaactgtgtgaatttaatgttcatgacaagtgtttcataaaggaagatgctggctattatctctcctcagaaggaaattgttgataagaaaccattctgagaagtaagatttatggcaacatcagaggctagagaagctggggcagctgagcacccaggacgatcaggacaactaggacaattcagtttttcttgtgctgtcttttgtgttacaaaaacaaaaaaaaataaatttttatatagcctcactccaaaagcaattaaggaaaatatttattcattaaaagcaatgctgtattttaatgaagcatgttaatgtttgacagagatagtttattaaaaagggatagcagtgagagagctttccccctttttattgtttttcccctcaaataaaatccttacatttgaataatttattgattcaggacagagtgggttggtaattttatcttgacctcattcatccaaagaaccatataacccaaatacaaaaagtcagactcttatgcttcaaaaaccaatgctatttaagtaaatgaagttaatttaactcattctctttaaacaaactggctggaagggtcaacttttcaatgactgtacaatcagcaactatgcttttaatatcgtacttttccaattgtattctgtggatggttggtcatctctaaaggtacttcaggtcatttactgtagaatttatgtttataacactgtattttatttcttctagagttcaccaaaagcagtgtcatttcatcttttaactgaaaacagatattctttaagatgttagtttcctgtggttgctgatataaattatcgtaaacttggtggcttaaaacagtggaaatttgttttctcacagctctggaggccaaatttcaaaaatcaaggtgtcgacagggtcccactccatatgaaagctctaaggaagcatccatttcctgcctctccagctggaggtagcttctggcattccttggcttgtggttgcatgatgccagtctctgcctctgtggtcacattgcttcctcctcttttgtctgaaaacaccctctgattgcatttagggccaaacttctcaaggcccttaatttaatcactttttctttttggcagtgggagggagcatataaagtaataatcacaggttctggagattaggacatatacgtaattgttttgggggccaccattcagcctactacaaatactttattcttttttattgctccatagatttagaatgttcactctacctatcctacctgtattaagaatatatcatcataatctttctaaaatcccatgtagatctagatagagcagaaaatacaaacttttccctttcccagtaatcaacctacatttaattattcatgctatgatggactgcataaattaaagaaaaaatagaaaatctgaaagggaagataatgatctcattgttatttgtagttgaccatggtcaactataaaagtataaaaatactaaaattattaaatgtcatatttatgatcatttgttcacctgaagagtattgaataataaggggtacatttgggttatactgaatgagtgttgaaaatgattgaaaatcatgaaaataatttatttggggttgaaattttatcaaataaataatctataaggtgtatacattatgagcaagttagcaagagtgtcttgatacaaagtattggtaaaagaaaagatagttcacactgagtttgttttcaatttaattcatttttgcagatgtcaacaaaatctttcacctttttatagtatttaggaagaagagagcatgtaaggtcaaactttaattaacttttctttgcctatactggactttccctacacaagtaggtacttatattctgatcacaagtccccacacgtcggttgtagatagcaatgtcaagttagtgcatacccagctactaaagtttactggactttcaggtgttcttggcatgccaggcaggtggtacccagttatttagagagatctttctttcagaccttagacatgtcttttacatataaattacttaggtactttgaccgcatcatgtggttcagtttgttttacaatgaagactagagcttggggaagggtggtttttgttgcccatgcttacctgaaattcagaaaacttatcttgaaggagccagagccagttggtatatctctgagaactgtccttagactcttagctgggtggtgttttcctagtccttgtgtaaaaggataaagatggtggaatgtataaggtaaagtgtttttaggatatacgtatctgggtgccacaaagggcatgagtagggaacagtgaaggataagggtgaaaccattcattgatcctaatcatggaaagccttgaataccaggcttagaagtttggattttctcaatgtgcaaaaatcggtagcatttctatataccaacaatatccaagctgagtgccaaatcaagaacacaattcaattcacagtagagacacatacacacacacacacatacacacacatacacccctaggaatacggcagatcagggaggtaaaagatttcaatgagaattacaaaacactgttgaaagaaatcagagataacaaacaaatgaaaaaaacattccatgctcatggataggaagtaccagtattgttaaaatggccatattgcccaaagcaatttacagattcaatgctatttctatcaaactaccaatgacattgttcaaagaattagaaaaaaactattctaaaattcatgtggaaccaaaaaaaaaaaaaaaaaagagtccgaatagccaaaacaatcctaagcaaaaaaaaaacaaagtcacaggcatcacattactcaatttcaaactatactacaaggctatagtagcaaaaacagcatggtgctggtttaaaaacagacacatagactaatgaaacagaatagagaacccagaaaaaaaagctgcatacctacaaccatatgatcttcgacaaagtcaacaaaaacaagcaatggagaaaggacttcctattcaataaatgatgctgggataactggctagccctatgcagaagactgaaactggaccccttcctttcactatagatagaaatcaactcaatatcaattaaagacttaaatataaaacctaaagctataaaaacccttgaagaaaacctaggaaatactattctggacataggctctggcaaagatttcttaatgaagacaccaaaagtaattgcaacaaaaagaaagattgacaaatgggacctaattaaattaaagaactctgcacagtgaaagaaactatccatagagtaaaccaacagcccacagaatgggagaaaatatttgcaaactatgcatctagcaaaggctaatatccgtaatctgtaaggaacttaaattaacaagcaaaaagcaaacaaccccattaaaaagtggacaaagagcatgaatagacacgtttcaaaagacaccaatgcacggccaacaagcacataaaaaatgctcaacatcactaatcagatacaaatcaaaaccacagtgcgataccatttcacacaagtcagaatggtgattattgaaaagtcaaaaaacaacagatgctggcgaggttgtggagaaaaaggaacacttatacactgctggagggaacgtaagtgtttcagctactgtggaaaacaatttggtgatttctcaaagaatttaaaacagaactcccattcgacccagcaattccattattaggttgtattagggttctctagagggacagaactaacaggatagatgtatatataaaggggagtttattaaggagtattggctcacacgatcacaaagtgaggtcccacaataggctgtctgcaagctgaggagtaaggaagctagtctgagtcccaaagctgaagaacctggagtctgatgtgtgagggcaggaagcatccagcatgagagaaagatgtaggccagaagactaaaccagcttagtctttccatgttcctctgccggcttttattctggctgtactggcagctgattagattgtgcccaccgagattgagagtgggtctgcttttcccagtccacttacacaaatgttgatctcctttggcaacaccctcacaggcacacccaggaacaatactttatatccttcagtccaatcaagttgactcttaatattaaccatcacattggtaaacccaaaggaatataaaccgttcgaagatacatgcattcatatgttaatcacagcactattcacaatagcaaggatgtggaatcaacttagatgcccatcaaccatggactggataaaaaaattgtggtatatatacagcatagaacacgacacaggcataaaaaaagaatgagatcatgtcctttgtagcagcatggatggtgctggaggccattatcctaagcaaactaatgcagaaacagaaaaccaaataccacatgttctcacttataagtgggagctaaacactgagtacacatgaacactgagaaaggagcagacactggggcatacttgggggtggagagtgggaggagggtgaggattgaaaaactgcctatcagataccatgcttattacctggtgatgaaataatctgtacatcaaaccttcgtgacatgtaatttacctgtataacaaacctgcatgtgtaccctgaactacaataaaagctaaaaaaaaaaaagaaattcagattttcttctttctttgattctgtccctctcatttaattcttctccctatttatttcaccttagatggcagtggatttattcagtttttgtagttgattgtttaatagtattttagtctctatagttttaaccaaatttctgaaacttctttccagaagtatattttgatgtttgattctaactttcctatcctttacttgccaaaagcaacaaacaaaaaacccagattttaaattgtaagtttctaccactttaaaagaaagaagttaatattcttgatgttacacttctttttaaaaaaatgccttttgtttccaggaaaaatacggaaattttttttgcttccaaaaggtcatggtttcttccttctaattacattctttaaaattctgacagtgtgggctttgcaaattataccatcataactcttgaatgtgcttttcataaaattcaacacattttatctttagcctccgaagtccttatgacttataccattattcatacaaactacaggtttagaatcaagtaaacaaaattcctgctttaatatacaactacagttgttttttggttgtgtttctggttggataatccagatcagactttgtgactaggagctgtaagtaaggtggctgccttaaaatgtaatgcaaaaacagtcctttttagtctttttgtcttgtggctgggaccatatggttttctgaagttcatatgtataatagtccttttttgtgtgggctccattcatttatattctactgtttattgtttattcattctttcattttgagtatctattctatattagtcttgtgaatatagaaatgcaaggcatggtgcctgctcttaaagaggttaaaggcttatgggagaggcaggcatataaacaaataattacagcctaaaataataaatgctattgtagcggtaagacaaagtccttcttgtggcttaaactctctagcccacattccccagctaattattttcttctgtggattttcatccttgtctctcaatctctttttcagatatatgcatatccatattgcttacttaatcttttctgcttccaggttcccattttgggtgtggaagccttttgcagtgactgtgtcctgtcatgactcttttggtagccctctccagtattccagctttgcctttaaattttaacggagagaaaaataatgtatctcattcttggtgaaacatttaggctgtttagttgacatttgaaatggcagagtctattgttctaaaaggaaaattatccatactgtgtaatgtggactattgatagaatatggaatcaggcatatctttttatgtatttatgaaagtaaagcagtgcttccattttagcacaaataactttcaaagcaaagttatttaaaatttctcttttcttttcttttttttcttttttctttcttctcgctctgtcatccaggctggagtgcaatagcatggtcttggctcactgcaagaaccgcctcccagattcaattgattctcctgcctcagcctcctgagtagctaggattgcaggagcctgccaccacgcccagctaatttttgtatttttagtagacacagggtttcactgtgttggtcaggctggtcctgaactcctgacctcaggtgatccacccgccttggcctcccaaagcaaaagttattcacttcaagtgcagtgaatcacaataaatcttatttccttatttttatatttgtttttataatgaatgggactacattaccctcaataaaaggtggacagtttcaccctttacttattagttatattttgagtaaaaaatacaagagtgtttatagagtgtttactaaaacaatgaagcacaggtaaataaaattcaagagtatctacatgggtggtattaatttacctgtttaaattctgaatgaattactaaaagcttgagatatagtcctaactctctgacttcagtttcctcatctataataagatgttattatggtagacacttgttttttctgctcagcttccatttctccctgtacttgaaaaagttcctactttcaagtactgggtccaacccagtctgttcccttttatccaggagtgagcatgtgacccagcctaggtcaatgaatctatacttcccgtggccactggggtagttagggtgggtaggcaacccagaatggatggatcagaagtcaacttctgggatttgtctggaactattaaagaagatgcttttttccctataatattcctaagtaagtagaatggaaaggtggaattgtgggcaatctgcacatggaggtaactagagatggagcctatatggaggaaagcagaccctatctatgcatgaatctaacactcccttttcaggtgtttctccagtaaaggcttttttgattgttgttgttttcttatgccagtttgagttgtcctttattatgtcacatgcaaatgataggatccaggctaattcagtttggtcagttaacctttaaggtctttccagtttctacattgcatgattccttgccttcttttatttcatgcaagttagattactatgattgaatgaggttaggcaaataataactggatattctcaagaggaatagcttctctatctgggaaatatcagtgtatttctcataggagttgtcaagagtaattgttctacattttgatcttacttgtgtttattttatggcataacttcacctttgacttttgcccacccctggtctagctgtattcactcctactagggcatataaagttaaagaaaagaatgaaatgcaaacattgcttgatattaaaatgataagcaaaatttatttccttctgaattgtgtacacaaatgacccctttctgagccaccctcacccctgggtcaatatgtgcattttgtgaggataacttttcagaacactacatgaaaattgaaacaagaaaatacctgggagctgcctgataaaagtgtatttgtgagaaggtttatgaggtggtgatgtcaaataagaacttggatgcggaagcctctggtgagtcctggctccaccctttatttagctgtaacctcgatcaagttctgtaaatttgccttgtctttccaatggttgggttgctgtgagggtgatgtgatatgaaatgtgaaggcagtttacatgtcaaacctgatgaagggctgaaattatttaggaatgaatgagcctaactaatttagtgagtgtcattggtgatttgtagaagaagcaacagactgggaaacattgggagataagattacacatgtggatagtttcagattttaaaatctggactgaggagtttaaacttgtttaaaaataaagaagcaagttttagtcaccacgtccagatgccttcctccaaatcatttttaaaactttgttcttttcttttcattcccacaaccagtacaaactcctgactcaccttgtagattctaatatattcctcagctaacgtcctgttgccacatttattgtcctaaaaataatagaccctaattacatgaagaaggcaactgaatgtggtgcctgacagactctagagaatgaaacatagggatgtgtaaaaatgtatcacaaagactgggaaaatggtggtattattaacaaaaggaagcagatggtaagggacccacgatgaagtaataaggcatccagctggcatcattgcacaggaaattgcagatttaggattagcacttagacagtggaatccctgtatggatttggaagttacaaagccaggactttatatctcaaagcatcctgccttaggttgggctgctataatgaaagaccatagatgagtggcttaaacaacagacatttatttctcacagttttggaggctgggaagtccaagatcaaggtgctggcagatctggtgtctgatgaggttcctcttcctactttgcaggtggctgccttcctgcggtattgtacaaggtggaaagagatcatttatctcttgtctcttcctataagggctctaatcccattcatgagggtttcatcatcatgacctaaatacctctaaaaagccccacctccaaatatcatcacattagggattagggcttcaatatatgaattttgggggaacacaagcatttagttcataacagatccttaagacattgtctggctttgactttttcagataagagcttcaaagtagaaagaggtttttcatataagaggttgaaaggttcaaagtggaaggtcacgtagtgtatcatcagtggcgcagctgggaataaaacctttatttgctgactccaaggccagtattctttcgttgccactgtgcagcacctctgtggcattaacccaaagagtacaatggaagttgtatagagtaaggattataatgagaagcaactatgtgctgggcagaatatagtgtaatgtcctactgttgcctagatacaactctgaagatactgatagctttaacatgagaaagccgagatgttagatcatttagacaggatggataacagggaaaagctagattatcaagtgcttggcagctgatataaataaatactaaataattcttatgccaattgctcttaaaggcattatagtgtaattatttatttagaacatgaatttttatgccaaacagtactgtgttcgatttctggctctgttacttgctctctgagatgcctttgagattcagtttcctaatctgtatagcgggggacaataacaaccacctaatagggttgttgtatgtattgatgatggtattaatttcctactgctgctataaattacaaaaaaaaatctagtggtttaaaacaacacaagtttgttattatggctctgaaggtcagatatctgaaaatgggtgttatggcactaaccaaggtgtcagcagacatgtgttccttttgaaggctctaggggagaatttgctcgtgttttccagcttctagagactggccagtctttggtggtgtagccaccttctagcaatggcatcagttcaacttttgcttccattgctagatttcctctggctgatattcctgcttctttctcataaagacctctgtgcccacctaatacattgggaccacctaagtaatgcaggaaaatattcccatctcaagactcttacctttatcacatctgcagagtcccgtttgccatgtaaggtaatgtattcacaggtgttagggactagggcgtggacatatttgagggggggccatgattctgcctaccacactgatgatgatgatgctaatgaagatgatgaggaaaattagctgctgttagtatttcactcactcccaaaattacttttagtattttgtcaaagaaaataagttctatcccaaaacatgtaacaagagcaagcctggcctgatcaggggattgagcttctgatttgataaaagcttcctcaccccttcagttgaaagtggtttccttcagatagcttcctggaaacttctgggctgtgcacattagtccctttcaattcaggcactgaaatgctagcaaaatgaaggtatgttttctggaaaccagctatcaatctagcacaagcgactattaggaaaatcaaggaggtgctgcggggatgtggaataggacacctgggttttgatttaaagtaacttaaaggaattgcttatagcagagagttaacattcatatgggaaattttgagcaacctgtttgactcaggtcccggtgagagggcagtcttacataggagatgtacagaaagttttagtctccattcctaatcctaggcacacgcacacacacacacacacacacacacacacacacacacacacaaaattctgaaaccctaatactgtcaaatccccagtgagtttcaattttcaatgacaactatggataaaaatggtcatatttaggagagtaggggggaaaaaagctttaataaagtggcagcagaataaaatgattatcagttttttaaaagcactagtgtaaagaatacctctcagtttaattttccttttaatttattataaattataggtttgcttaggagaaaaataaaaaatcaaactgccattttctttgaaaacacaaatcagacaaattgttacacagcaggatcctttgctaattttgacagccacttattcatttactagcctttgtccgacacaatacctgtgtggcttttatttttccagactttccactgacacattttcacaatttgggtgtttttgtccaaaacgtgtcatgtattttgtcatatatatgacaaatataaattggaatttttaaacttcaaataaaataccacattaaactagtgattttaaactgaagatgatagaatttttaaaatacagacttggagaccacattcaaaacacttcatagcaaatgagaggccctcagttatctggtcttacctcagctttctagtcgtctttgtcactttttcagcccctggggtactactcagtgctgtctgccagcctgctaagttcactttttcctgcttagcacttgttattcctctttttccactaaatgcctttagttattaaattattgtttcctacagaaatttaacttcatcatttttgttgtctggagaaagctttgttgtcatcactcagtggtgagaaggttgactttctcatgaaagctccaaccctaggtcttaggtttgatgtaagtcatgtgctgctgtggaaactgtctagtgcctgtacagtgtgatccgaagttactggactgtgagggggcagtctatcaagtatggacagctatcaagtatgttgtacagtttgatctttaacaatttaaaatcaatattgggttccttggtcacacaaatagcctagttcttcaagtaagcagttctttctgcctgaaacctcatgtcccactgttctacttgagcacccttccaggtatcaagggcttaattatagggtatacatagtcccctgcaagccccttatgcatctgaaaatgcaggtatgaaccttcattctgagagtaagttagctagtctaaatgaatatttgagatggaaaaaaacatctagatggatataggtagatgaagtaaccctgggtaggtaaagaagctgattttagcagtgcctgaaagactcttgacaaaacacctcagaatctacttccattactcagaacattttattagatttgttaccactccgtattgaattgctggggtctcactgagtccttttgaaaaatcttgtcccaaaaaggtcttagaacctcattctcccttgtctgtctgtttttcttttattttttctttcatttctttttgagacagggtatcactctgtcacccaggttggattgcagtggtgtgatcacagctcactgtagcctccacttcctgggctcaggtgatcccccgctgacctcagcctcctgagtagctgggacttataggcacttgactaatttttgtatgttttttgtaatgacaggattttgccatgttgcccaggctggtctcaaacacctgggcccaagcagtctgcccacctcagcttccccaaatgctgggattacaggggtgagccaccacgcccagtcacccttgtcttccttgactaccatctgcttctatcctagaaggaacatgtgaaaggatatataaatgaaaattggagttccagagtaatttatttgtctccatttagtcatgttggcttcaaatctttatcagttctttcacagatatgtttttgagcatctgtcattcaccaggtgccagatataaatggatgaataagacataagtcttgtggtcatggatagctaccactactgacatggcaccatttccccaagagattctttctgtttccagaaaggagcccaaggcccagtcctcatctgggtattagatagagtgctttattttcaacagtaaataaagggaagatggttgtagacatttctgggtgaagtgttagccaagattttctaggaagtttatatcctataagtgggtagaaaaattgggtatctaaacttcagataaaagtccaacactttaatctaccatgtgttgtctgcagatgaattcaaaccactgaggaagtttatacaggttagtaaaaactagcaaaacaagaaatggtttttgaaaaaacaaaatttaaaaattctattatttttgtcctgactgttaattcgtttctaatgtatccagttttgatgccaaatatcagaaaacagagagctcaggcattctgggaaagtcaataattgaggctaaatggcttcagtataatgactaaccaggaagactgactttctagaaagataaagtctcagagaagacatgatccagatttatgaaatcatgaaatatgcaaataaggcaaatataaacatgttcatcaaatcctagaaacattttaaagctttgaaaaagtaattttagggtagatggaaggtcccaggaattgtattttattgttgaccttaaggtctactctataggattgctgaatataaactactttaaaaaatatcttttgctattatagtaattagcccctttgggttaatttcaaaattgttctgcttaaaaaaaaattagttggccgtgcgtggtggctcacacctgtaatcccagcaattttgggaggccaaggtgggcagatcacgaggtcaagagatcgagaccatcctggccaacatggtgaaaccctgtctctactaaaaatacaaaaattagctggacgtggtggcgtgcgcctgtagtcccagctacttgggaggctgaggcaagagaattgcttgaacctgggaggcagaggttgcagtgagccgagatcatgccactgcactctaaccaggacgacagagtgagactccgtctcataaataaataactaggttataagacaaattggtcttttagcagaattttcagatataagcaggaaattctttatttcagtgagtgacatagatttatccagttaatactcattaagtagtgggggtagatttatagtaggttattaaaaaacaagtaatattaaatatgtatctcttagcatcagaagttgtcagggagaacaattgtatttttgccttagaatgtagttttgtgtatctgtcaaagatcaaataaccaagttgacaactgaccttactcagtaaggcctcttaggttatcctggaccattgaagctgctgcagtttgtttttctccccctgttagacatagggagtttttctcctgtcagtgctcagaaaggtacttggctaatgctcttctgaatttcaggagaggaaagcctcctacttaaaaaatatctgctgtatttagtactatacaaaatagtcatacagacacactttcaacttttaatattaatggggtggtttcactttattcattttataaattatgaaggttattgcagctgtttgctagattttaccaggctcatggtagtaaagccatacatagtccatgaaaacataacaaaactttacaatttcattctgctttgttgcaaagatccatgtcccttgtacattttatgacttattcacatttcctttagaaatactcaacatttaggaacttaattcttactattttagataataatgtgctcatgatgagaataataatactaaaataatgatatatatcatcacataagcatcaaatgtctttgaatttggagattttcagcttagaaccactttaatggagctcttaaaagtcaaatgtgattttcatgggactgtactaaggtgtgataatggtaaaccatctctcctaagacaattaactcattcccccatatattttagatgctttatttatgaaatattttgagcaatgaatatgacatctgattacctctctttgtaattcataatctcttggactaatctttggactcagtagatttctttcattaccattttatgtatttattatttttttgagacagaatcttgttctgtcgcctaggctggagtgcagtggtgcaatcacagctcactccagccttgacctcctggtctcaagcaattctacctcagcctcttgagtagttgggaccataggcatgtgccaccacacccagctaatttttattttttgtagggacagggtctcactatcttgcccagtctggttttgaactccttggctcaagtggtatacctactttggcctcccaaagtgctgggagcctgtatatattcttagaatcaatttatcttacaacttttaaaagaactgagaggtaagatgatcagcaaataatatggagttactggaaattatttgattgttttttgaatttttaatgaactcttaaaatgacctgtagccttagttgatttaacaggaatcttaaaatcagattcacatttactattttggcctgaaatgagttccatgttctttttttttttttttttgcattagagaaaacaggcttgtgaagttgtttgtattactatccttttttcagattttaaggacatgtatctaagtgttcatctgggttctctaaccccctcctctatactgttatggtgttactaaaattttattagttataagtaactttacttgacactttcttcacatttccttcctggcttccttcctttccctcctttttccttatatgcttaaatctggaggaaaattttgttctgaattatatattttttaatcaatattgcaaacagacaactgtaaacctcaagtttttgttaatgaagtacttgaaaatatgattttttatttttttgctattatggttagaaaatagcgataattttttaatgaatggctggtgaaatgcagcagacacagtgcaagttggtggcatggtatcattgtaaaggttaaacagctgtgctggaaagagtcattttggtttagtccttttaatttggaacttttttggcagctgaattccaggacagactgtctatgacactttaatatatttaacatattttcaaaaactatcagaactcaggctaaataacctaaaccactttgacttcatactgggttacattttgcttgttgaaaaaaacttaagttggtttttaaaagaacaggctggtctgcaaaaaggtgatgaagaaatattagcctttgttggaagttgagaagtattatataaaccttagactgatattgtagaatggcttctaagactgaaaaattgtaggcatcctgttttaatcctctgtaacccagccatatgcgtcaaactgagcactcctaatacctgatacttagaaaaaagagtaagagagctgtttttctgtgtacaaatacacaagtgacacctagtatctatccctctattcccccagctctggtcttagggaaggggggtccaggcattttccacctggagaagtaggtgcctgacagcagatgcaacattggtgacttcctggactgtggcttgtcttcaaggcaccctgccaagacttcggtgtcgggggaactagagaattagggtaaaatttcagggcctcacctgtacaacatggtcataacattaacaccagctactctgacatctgtcagatcatttatttaattaacatcccttttctctgggccaccaaagcagggctgcttttcactggcccatcttctttgcatgtatttcaataaaagtttgggggctattgtttcattgtcatgtttccacctaaaacctagtctgaggaatagggatctacttatttttgatgcacatgatttattttagtaaagtggacagattttaatgacacttaggaactgaggcttttttttttttcagtcatggttttacttgtagaaagcgatctgtattttaaacaaaaaaacacttaatctttgaattgaaacacatttaatatgacagttaatttcttcttttccaaaggagaaaatcacaacagaactttaagaagtctcctatgcaactggatacaaatattgttgattcatggaacgtgatgcctctgacattaagggtaatagttattgttttgggtttaaaacttcaaggtctggctcctcattttcagggaagcctcttgtatctgaatagtgtttctggaattgtgctttgatcaggtgtataaggactctgaaccaggaatgcgggctttactatacctgctctgagaatttgtttaattactcagcttctctaatccttgctttcctcatctgcacgatgatattaaattcatgggattgttatgaggcttcagtgaattcacgtttgtgaaatctagaagtacaatgcctggaacagagaagattctttccttttccccttttctccagcctaaattaataactggacttttaggagcagcagcgtagaggtaggactatatgaatgtcattacaataataataacaaaactatttagatataaaatttcctgcctcctcttttgtaactttcctatgcacatcattatcccttttcactattgtttgctcagctttggtgtgatttgtaaaagctcctggttattaagggtataaaccttatgttaggcataaggctgtaaccttataaccttatgttaggcataaggttgtaaattttttaaagttttcctcttaacagtatatatggtattttttgtcatatagaaatttcaagttttgtttttatgttgtcaggtctattgtttttttccaaaaattgtatgacatatattgatttcagagatgttaaaatgtgaaaaaacaaagtcttagattcaatggaatagaataacaatcttttataggttctgcctttggtgcaatgtatgtgtgtgtgtgtgtgtgtgtgtgtacaaatatttgtaggtatgtaaattggtctcattttttgtacttaaaagatattattgcaaacatgactgggtatgggaatgttctctccagctaagaaaactctaggaagaatgtagttgcatagagcttagaagccctggcatttgcttcaggcattgctatgggatgctttagtcttggcttgtccgttgttgctagaatcacgtgctgccctcactgctgctcttgtccagctgccactgttactcaatccctcctgatagatatctctgtggtagcaacaattcaaaatttgccctgaggacaaggttagtatttcttgccagcacctgccactttcccttccagatcctgaccatgggagaagtgtgtgtgggtgtgggggtaggggaggaggagttaccaaaccctgtaaagcagacatcaaggtagaaggctagaatgccaggtaaaggctcataggacagagtgctataactacatcttcaccactatgacaaagttgtcccacccactctccggaaaagagttaatgttggttgaagatcacgaagcagttgtcctccaaaatgccccaagagtattagaatatgatagaagattgtttatttgctaatgaagacatcagaactagccgaatggttcaaaaataattttaaatactttatacattgaaacaaatcaagccactataataattaggagccccttgctctggtgcagggcataataatcgctagcaaatccttagttgatgacatcacagtaatctgagacagagaggtggggactgtagtggacacttaaagcaacattgctgtgtctccttggtaattcatgaatgacagttcccggcaattcatgaatgtgacacttctcggtcatttctgtgttttggcaggtactggtggctttaaagccagggaatcaaagtccttaaagttgtaattaattttcctgaagctgataatgagacctactgcgatcctttcacataagacaggtctttacacacaatttatgaaaacagaataattaatagaaaatgatttcaattgtcctctgtaatatttcattgaaataaatgttgtagagtggttttagctcttggcaaatcatgcaataataataataaaagagaagacggctgtgtgggaaagagtagttatttttaaatcttggtagacaaatgggacctgcccacttgtctattgagcacatctctgtaatttctcagaaattaaacagcatgaccctttgattgaatccaaagctggaagtttaaatagataacttcaaagtaattggcttgaaatccaaggatctattctgggatgctttagaaatttttattcccttttcacctcagctttaaaatatatataaatgtcaaggcttcagactttaaaactgttgctgttgtactccaaactattttcttataattggcactgttcaaatcctttttggaacaggatttgagcttgagtgagaagagaaggtagtttggaagaatcaagaagtatgtaacagtgggatctaaaaatctaaacaaaaagaggttaaagggacagatctgatgtatttcagaggagcaagagtagaaaggtgatacattatcaaaaaggtcttcatgcacatgaagtgttctattccagacttaggggattagctgttcttcatctctgctaagggcaaaataaaaggaaattattttgagacagaagcatgaagagattaagattagagaaggaatactttaaaaatacatgtttgttaaaccaagaacctcagccatctaaacaagagtaaatatgccaataattctaccatcttcgtctgattaggctatgaaatcttgaatcttccttggatagcttttaaactgatatggaatggttagtatgttttatggttatttccagttctaagattgagtgatccacttcatttcagcaggctctgtacgtattatggacttgtttccctctgttttttcctctgttgtctccttccttttttttttcttattttgtataatatttaagagtattttacatgtaggtgtcatttataattttttccttactaaagtattccttttttattatggttcacattgtaattcaagtagcataattataacatttttattgagcagaaaatgaccacttttgtattttaattaaagcatcttttttttaattatttatcttatccagcagtcattgaacactaaagctgtgttatgtgcaacacagatcttctctcattttacccagaacaatcttttcctgagaaataagtctttgcccaaagcaagacactcctgcagtgttgaaaggtgatatgggcttttagtgtgcactgtagctaacagctggcaatcactcaccggtttaagaagtacatgttggccattttctgtcagtttttgggggcaaagagaagaattatctaaattttggaggagaagggtttagggggttatttatagcatccagctagccagaagaaatgaatgaacaattcttaggtatcattgacccaaatatcttttctaaaataatccattactattttctttcttctttttgctacttttttctccctctttcatccctttaaaactttgacaataacaacaactgatgctctcaagcacctcccatatgccccatactaggaactggggatatagcagtcaacaagacaaacatgtcaggtcccctgctctcaggaagtttaaattttctccattattttgtgctcacttatataacagggaacaaaccagaattaaattttgattgcattttaatttattgttaaatgatacaagaaaaacactaaatacactactagttttagacattcaaaatttatataaagatattagggctgggcgcggtggcttacgtctgtaatcccagcactttgggaggctgaggcgggtggatcatgaggtcaggagttcaagaccagcctggccaacatagtgaaaccctgtctctactaaaaatataaaaagattagctgggcgtggtggcaggcgcctctagtcccagccacttgggaatctgggacaggagaatcgcttgaaccccggaggcagagcttgcagtgagccgagattgcgccactacactccagcctgggcggcacagcgggactctgtctgggaaaaaaaagaaaaaaagatattagttatactgtttatgatgtgaggaaaatcaaagtttgtcaagtaactttgtattcagaagtttgtgaagtatttagattgagtctttatcctagtatgtaggtaatgttaaagatgatttttaaaaaagtcactgtgcaaaatttccttgcatatgaacagttaccttggcatggactcttttcttcccactgttacagggtagctaacttcctattctcagtaaagctaaggcaaagagagtctttctgtcaccaaggtattctaggttctaacaagcatatgggcatctctcccttataaaagccatgatataaacacagtactgcttatattctgtaaacaatattaatggctagaatcagctgcataaatttctgggctaattagatgcttatgtgctaacctggaaatttaatcattgctgggaaaattttgttctgaattcaaaacggctgacttataggtagactatggaatattacctgtccttgccctgggtatatacaaacccattctctgtgaagagaacaaacacatttctattgtggcatgtccatagtgttagaattggaccttgctctagtagaattattattattattattattatttgaggcagattctcactctatcgcccaggttagagtgcagtggtgcagtcttggctcactccaacctctgtcccccgggttcaagcaattctcctgcctcagcctcctgagaagctgggactacaggcacatgccaccaagcctggctaatttttgtatttttgtagagagagggtttcaccatgttggctaggctggtcttgaactcctgacctcaagcaattcacccccctcagcctcccagagttctagtagaattgtgatcctaattaatttaatacacgtcactatgagaaaatggacttgcatcatggattgaggatttggcctttattccaaattaaaacctgattattaaccaggctctagtcttatcctttgctgacagaaaatggtatggtcttttatatcaaaattgtagagggctattaattttctgtctatatcagacatttcctaggtttttggctacccagagtctgaacctctgtttttatctggcatgaattctttgttatgtggggttttgtgggaggcggggttccttttccagaaggggtcagattttcttgtctttagaagctaggctgcagccatgtgaattaggttcagccaatcactattactcacccagaactttgaatcttgagtgcataactcaaagatgcagagacagtttattctttttagcagtggtggtgttgagagtccagcgacatcattgtctagttgcagcagtggtgatgagaaaggtgtgttaaccagactcttttgtggctgagtccctgtgtcctagcctcccttcagcctcccttgattctagctcacttccaggtcaggcttctagcttttccttcaagatatttctgtatccttcaaatatactttttccctttaagtctgccaaaatggatttctattgcttgtaaccaagaactctgactgatacactgcgtgaaaactaagctaactgtggcaggttatactttccaaaaattgtaccaccaatatatatcctatcctatatgctcttctaacagtgtgatttcacattcctccattgagaggtagagggctgtgttccccctgcttaaacctatgtggatgaatagaatgtgtagaattaataatgatgtgtgggttccaaggcaaggccctaaaaggtgatacaacctcctcctggtcctctttctttcctgtgacatgtgccttggaaactgagtccaggtaccctgaatatgccatattagagagagcacatggaaagactatatagaattagaggggtatgccagaggaaccccagctgttctagccctcagctgtttgagttttcccagtgtaggcaataggacagacatgtgatcaagcaagctgtcccatgacttctcagccccagccttccagctggcccaggtgacatagggtagagcagaaataaactctgagcccttctccaaactgcagattcatgaacaaaatgaacattgttattattttaagcccctttgcattcattttgcatatattatatggcatatatatatttccagaatgatggctattataaatattcaaactgtaacacctaaattctaatctctagcatagaattatgccttcagactcttacaaggcaggattattgatatggaatgtacttatttatttagtttcacatttttgcatcttacagtttaagagagtgtcatttgggctattgtaaaattacttggctggaataacattacagagctttattgctgttagaaacaaggctatcttccatatcaagatgtttaaaatactagttttctgaatatttatagttgtgtgacagctaaatccattaattctaagatgttgcttggtagtcccctgtgcaaataagtctctaaatgtaagttcattccttctattaggatcctaacacatcttttgggaagcaggatgaaaattctacttttcttttggatttgatattccacctaataaggggatttggagagagctttagaaattaaataaaatagctagaagttattgaggatttactatgtgcaaggcactatgctaagtgcctgcaggtcttctcatttaatcattataacaattgtatgaggtagatttttattactcttccttttttataggtgaagaaacacatttaggttaagtaaaactttcccaggtcacatagctggtagctgggatttgtatccagggctatatgtgaccctaaggtcagtgtgttcataaccgtcatgcagaatggctatgagtgatacttcagcattttatctcctaccttcctctgacttgtcctggattatccttaagactcttgacattcaatgtaatacacaaattctcgcccttttcacacatttttctttcagaatcaagcctgccttctcttatttgctgtaagtcctagtcttgaagagttttaagggactccaccaaatctattaggaagaatatgcaaacataagctttatgcgaatcttgatgaccttggtggaaccttctttcatcaattccttaaatctgctttttgtaggaagtgtacaggttgtacataaacgattcaaaataacctatccttcatgatgacaccaactgttgagtgtttaaagtagaagattcctacctctaatgcttcagatttgagtaacttatgacagtaaatcaagggtttgagaacttctgagggaaaaacttgaagaccattctggctttgtgtgtatgtttgtggttgtgcactctccctgccacacttgttagtgtggaatgatggcaaactgtgctgctgtagagttgaagaagaacaaagaaaactgtactgatgttgaatgagatcctgattacttcagtgttttatatgtatatcatgccttgcttcatcagcatagataatttatagtagaaaattggcaaacaagatgttagaagaaattcatctctgtgctcctcagcaaagcccaaatctctctgaaagtgctcctgttactgcagacactgtgctattactatgtgagtggcactactgaattctactttagaggaattgatttactagaaaacaatgggcctctggaaactcagcactcccatatactctgcattgagttactagaagtccttttaatacagagtctctgtgtgggcacaactacaatgctacaatggctggagcaccatattgtgggtggccacgtgggggtggtcattttccctaatgacacagaagggaatgaaaaaaggcttcatgttgttttagagtcttgcacacagcagcctgagcctagcatgtgacaaaaagcatttgctatttttatatcctttgggaatgacttctgcacctaggcaaccaatcataggctaagaatccccaacaacaaggaaaaggttagttttactaattagccacagagaaagggacattgccacgttctggagagtctaggtttgcaggaatccagccaaggacaaggctttgcattttttaaaaagtctaatatttgctttggtgtttcattgcagagacctagatttaatttgaatactcttcaaaggtctatttatcattagccttgtgtgtcatgggtataaatatatcttcaaactcagttctgtaagaaataataataatcaaaaatctttttgaatagcttgatttcctgcagagaaccaggctggagaaaaatttggcttttgccatttttggagttctcatctccaagttcgtggcaagctaagtttttcacatctccaatttcatggcaagatgtgtgcaatttatttcagctgagatgcttcttgcctcagtgtacacatcctcttcagatctgacagctttctgttgctttccagttatgcccagctcatagaaataattttgtttttgagggtaggtaccaggtgccatcgaagcagcatcattgtctggtgtaaatacctgaggtttgttgtctcatgccaaggaaatagagtatgcggacacatgagaagtgggtttaggagcataggtttaataggcaaaagaaagagaaaggagaacagctctctctcctacgagagagaggctcccaagtgggacttccggtccaaagtgaagtacactggattttacagactgacctgaggaggtgatgtctgatgtacgtagggtccaaagattggttggacaggtgtgatatttacataacacacgaaggagctggccaccccaccctaatcttcttattaagcaaatgggttttctacttggccagtgctctgttgtctgctccttactgtacatgtggttggcaaggaagagggaagatggagccaccatgttgaacatgcctaaggtagtcttttcctattggcacagctgcaggcattcacctgtgtaagctttcctatgtcagcagctcgattttacaggctgctctttgttagagaagaaatgatttgggggttgcttttcattaaaagggaaaccttatcgaggacttccttaacctcactatctgcctaaataatttctttttaactcctataatcaccatctccaccctgcaggccatcacacattggcccagttggagtgcatacagataattcagctcacacatgcactggcatatgcaaacaaaaggctgtcttagctttaataaggatttgggttcagagctctactgagaaggcatggaatagtagttcagggttggtatatcagtccacttgggatgctagaacaaaaaatcatagactgggtggcttacacaacagacatttatttctcatggttctggagactgggaagtctaaaatcaaagtgctggcttatttagttcctgctaagggcccttttcctagcttgcggatggttgttttatggctgtgtcctcacatggtggagagagaaatcacatgagagccagctctctggtggtgtcttcttataagggcactaaccttgtcatgagggccccacccttgtgacctcatctaaacctacttacttctcaaaggccccatctccagataccatcacactgagagttagggtttcatcatatgaattttggggcgacacaaacattcagtccataacagggcccctttcagattggcttgaagaacctacagatatattaattggagaagtgggagaagcaggtactgttaaatgtgtagcccctttttaaaaatatcaggtatagattatggaaggcaccagtgatcctttccatcatgatgtagaatatctttgcacattcagtttaataggatttctgctgggtgctaacagaacacatctgaacacatttcatttatttatgcctgattgaagaatgtccctgttgttaggtcctccctaggaaccatgactaagctccaaacatttattaaactcagaacctgaattattagcaactgagcaactagttctactttgcttgaggatagtgaggacaccttgtgtgcaaggagaaacatttgccttttatgctttgaatgtagcaaagaaagagaaggcaaacagaacattttcatattaaaagtttgaaggttatatcctgccacaggggtaactaagaaactttcccatgtatatggcccctactgggtgcttctgagaaagaaatgctacctttttttttccactctctgttcaaagtcaccaagcatttgggggaaatattttatagaacttttaatttgttttcaattggattactcaaattctgaagttgagcagttccatcccaggaatgaagagtcctctgtaaataggattaaggtctttttaccctagattataattaagggaatagatacctcaagtggagggaagtgtcattaaaaaaagactttctccaaggtccccctccccagttgctatcattataaatgctcattatgttttctttttagcgctgcatgaggtactggtgggtgatggacagcaaagaggacaagggaagagaaagaatttttgtcccaaaggatcctgtgaattagtgagaatatatacacatgaaaatttttagtaataatttgggtgacatatggttaaaagccagaataaattggcagataacaaattcctttaggacattggtcaatcaaatcagaatcccagggcatgcctgttaaaacacagatttctatgtcccacacctagagtttctgattttgtaagtctagggtgtgtgcagcttgataatttggatttctaataagttttcagctggtgcttatgctgctgatctgtccttttctccagtctctcacagtgatacaaattgagaactgctcctgtaggagaccagagactagagaggtctgcagtatgattgccgtgtgttgagatgatgcttcctttcatcattcacctgctgcagttacccatgtttctcttttctggccctcattttatgacaacagctggtagcactctttaaaatgtccacttctgtaaaaagtgctacctggtagcacttctgatgtcataagcagagagcatgcccttttctataattaggtaattctctacagagagaggaaattataccatcttcttggcagcagtaggaggagaggaacaatattcttgttttgctttgaccatttttttttatcttttaaccattaccttacagcattcacccctacattccctaatagacattaagaattttttctgtagccaaaagcaaataggaaacatgagttttcagattcacaaccaattaagttaaaattagggaaatggagaggagaaaaattgagaaatgatacagggtgaagagttcaaaaaacaagccttttgggaaggagttatttggtgcttttgagaagagcatttgctgattgagtatatatatatttctagagaagaaatgcaataacattttcccatgctgcaggtgaggctttgtcataatgttttactgcagtgaagtgggaggtttcatagctgttaaattagtagcagtccaaactatcatactcccaaatatgtgttcctaccaaatcatattactggtaaaatagcattctgtggttaaaaaaaaaaaaagtcaaggaatccttacttaaatttctgtttctatcaaataccaatacaggcagaataaaaacttttcctaaagtatctgtcctttgctgaaaccagcttctcacctgccgaaagtttaacactgacccaatcaaattgactttcagcatcttgagcagggacaagttagaatctcctatttccacccctctccacccagattttgccaccagttattctttttcccagtctctcacagtgatacacattcaaccctctttcaaatggtattaggatatatagtaggatataatgaaacttagtggagtttttgtgatataatgaaactctgtttatttcataggacagtagatctttgattttatggtaatgttttaaatggttgtatgtgtgattcttgatacagagaacagcttgtgacttttcccactttttcagcagcatttaaaaataaaactctctaaggtaatattcttctaacttaaagaatatcattgcatacctatatttaggcactaaggagtactgtactattatgctgcaaagattttaactacggggcttgggaaataatctcaatgtgaagatacatgttacatcatgtcagttattattgttctattgttacttccaagattcaggacttggttctaagggagggacatttcttttaaatgttttgtttcatttttttcatgatggagagatgactgaattactgtattgtcagtttctggaaacttgaattatcagttttttctaattcagcttgggaacagggctaggagagaggacagtgtgagaaagtatgtcaagcctgattggtatataatactgctcttggccaatatatttaaaaaataattttcaatacacctcccccatctttcttaagatggtggaatcctccagcatgactccagttttcgttattttagcactagacttttaatgatttcagaatttccgtctgcttttgactattctccctggtgttttaaaaatatttatttcttctattcagaattctcgatagggtttttatgacattgacctcactttctagtaatgtgtgtcttatctcccaagatgctcctcagagtggtcaagtaagaggtatgtattccggccgggcgcggtggctcacgcctgtaatcccagcactttgggaggcccaggcgggcagatcacaaggtcaggagattgagaccatcctggctaacacagtgaaaccccgtctctactaaaaatacaaaaaattagccgggcgtggtaacaggcgtctgtaatcccagctactagggaggctgaggcaggagaatggtgtgaactcgggaagcggagcttgcagtgagctgagattgcaccactgcactccagcctagggggcagagtgagactctgtctcaaaaaaaaaaaaaaagtatgtattccatatcattgatctttgaataaagtgaaggaggaagacctgcctcatatacgttgttgaatatcacttaaaatttgatcttaatattaatttcccaagattcatgaataacgctttcactactggttgatgtaatctatttcttctgcaattatttattagagcagacatcatcctagaggacaggaaatatctgatttctggattatctagaacctttcccaggccatctcatctggcgcagggtaagcacttagttgaagtttgaattaatgaaggaataaatgaaggaacatgtaaagctttgagaacaagtatgcatattttagttataggatcaagatagttattaaactgtaataaaaagcagaacttttactttattttagtttgattagtttttgagtaggttctacaatcatgttatgtaaaatcaaaaagatattggattagtttcctagggttcctaaaatcaggcccactctaatccactgtcatatgacctcatcttcacttaattacatctgcaaagactcaatttccaaataagttcacatttacagatatgagggttaggacttaaacagatctctttttgggaacacagatgtacccactgcagatataaaagtatataaatgaaaagtttcccactcaccgttgttcccaggtcacccagttgtcctcctcagaggtcaccaatgttattttactttattttaaacaactttaactagtctaaaaatgatgtaaaggtaagtgattctcactttatcctataagagacagtcttgttcttatctgtttcattcatcaaaactttttgggttttagtcttcaaatttatcccatgtcctcagctgggttcagggatggggagaaaaggcaaaatgttcaagtagacactaaatatagtaaacctgtattaatcattgagtgaaatatattctacatgcacgtaactccctcattaaatgtcaggcattatgtgggtagcacttaatcactcatttgctggcacaaagtagattgctctagttttaaatcctagtaacattaagtcttacagcattttgttgtcagttttttacttaaatacatgttattaaatagtttgggaataaatttgttgttatgcatgtattatattgctgttaatgatgctgttaaaataaaacttttttttacctgacagtgctatatggaattagatgaaatttatgaaatgtagttgcattccatgatacttaacaaaatatatgtgatatcctgtgtcttaaaaatgaaatatgtgtacaaaagctatgtataatgctgcatagtagcaaattaaatgatctgaaaagtcctgcagtaagcaaccagtttaggctacattttcccgtaaagtctttctttaaaaacaactacatcctgcattactattgtttcccagaatacactttgagaaatgaaggtctacaaaccgaagacagagttagaacagtgagtcagaagccaggcagtgaattagggcagaaaaatagaacttttatgctgcctacctccagtaggagatgacttaggtcctttttgtttccataggatgtggcacaggacatggggcgagggagaaagaagttaggggaaagagactgggtttgggggcctgggctttggggctaggcagattgggtgtaattcccagcactgccactgactagttatatgatcttagacaagttgctccatttttctaagcctaaatttctttatccaccaggagtttgagaccagcctgagcaacttagtgagaccttgtctctacaaaaaaaaaaaaaaaaaaattaaaaattaaaaaaaaaatctatccaggcatggtggtgggcacctgtggtcccagctactctggaggctgaggtaggaggatttcttgagcctgggagtttgagactgccacgagctgtgattgagccactgcactccagcctgggagacagagtgagaccctgtctcaaaaaccattttttttttcttcatctaaatagggggaagacacaattcctatccctaaagaatttaccatttaattgggacatgagattagaagacctacggttatgtaaagataatatgattattgctttaagagatatacaatgtgattgggagttttgaaggagggagaagccagttagttgtggacaatcaagaaaggctttgtggaggagctggcatttaggtgtgtaggtctccatgggttagtaaagcttcaacatttggagacttgttagtggagagtgcattccaggtattaatagatcaagaagcaagagcaaaggtatggagatgggaaaggaaagacattttaaagaatagcaagtggcctcatttctctggagacagtagaaatgaagcagccattaaactttgtgacctatgtgctgtaagggacccagtggcactgatagttttagcagtgctgatagtggcttttgagtagactaatgtatttaataatcgctttgacaccattacgaagtaaacaaccttgtacttgagtagaatttagcttctgctggatggtccctgtcctgaggtgctagtacacatattttaatctggcacagagcccacatacaatggaatggggccactttcataaatatttcaggatttctaaattatcttccctgaacaatgttgagggaaagcttagtagatgaataagattttaagaccactaaataaaataaaacagatttctttactcataaacttctaagaaagtttgctatgctaatgagtagtgttagtcccatggagggagatttagtgtgtgggattctctgaacttggacctcagaaccttctgttgttccctgatctcatactgacacctcctcaaaagatgttctcttcttatgtttgaagtcagtgttcttattacctgtggagctttttcaaaaggcaaattctatagttcttttctttacccttgtcaccttcaagcatattagactcttggcatgtaggggagggataggtactcagtaggatagtacctctcactccctatctccaccccttcactgacctgacctaaggtattagaaatcattctgtcaatcacatgaacaattaaggcccactctctaaatccctaattgcttacttttttttgggtaagaaaaccttttttaaaagctatgaagaaaaatataaatagatttatgtaagcaaaggcaaaggttatagatcaccctagaatagtagcagatcattggagaagagtataacatgcctagactattatgaatgcattaggtaggatgttcttgtgttgctataaagaaatacatgaggggggcaaggccaagatggccaactacaaacagtggtgattggagactcccattgaaaagaaccataataaacatgtgaatccttcactggcaaccaagatatccaggttctctcatcagaaccaactagactctggctggcatgatccacgaagaggagggaacacagtgtggtgtggtggcccacctgagagccacacggggcagaggagcccccaacccacagccaagggaggcagtgagtgagcatgctacctagccggggaaactgagcattatccacagaactctgtcagccacggatcggaagatcccactcacctacccacgccacggggtctagggtcccaaccctggagctgcgcagattctcaacagcctctcagctgcaatctgcttaagcctgcggagctcccctgggggaggggcaaccagcaccacagctgtggctgcctgctgtgtaagccatgtgagctccttgggggaggggcagcagccagcactgggactcataactgcctaacacactaacctccctgggtgggggaagggcgtcattcatctctatagctccaggccacactttgcttttcccctgctggagccagtgaggctggatggcttggtcccaaaaggtgtcccccacaggccaacacaccagctgtggcggactgcagccagaaagcctcttcaggcctgaccctgactcatatttccttactgggcggggctccctgcagtaactccaacaactccagccagaggctcagggacagaacacggatctccctgggcctgtgcccctagtgggagggatggctgtagtctctgtggaccagcagacttaggttttcttcctggcagttctgaggaatctgggcagcccagatgagtgggtttcccccagcaaagcacaccccatccacaaagggacaaagtgcttcgttaaatgggtcctgttccctgtaccacctaaatgggtgagaccctccaacaggggttttcagacactctatacaggagcaatcctactggcatcagattggtgccccttgaggtcagagatcccagaagaaggatcaggcacccatctttgctgttctgcagcctttttgagtgacacctccaggcacaggagcgaaccagatgaatacggcctgaagtgaatccccagcaaaccgcagcagccctacagaagagggacctgaccattgaaagaaagacaacagaaagccacaacatctgcatcaacaacaacaaaaagtccccacaaaaaccccattcaagggtcagtagcttcaaagatggaaactagacaaactcaagaagatgagaaaaaaatcaacaaaaaaacgcagaaaacccaaaaggccagagggcctcttttcctccaaatgattgcaacatctcttcaaggaacagaactagatggaggatgaggtggacaaattcacagaagtagacttcagaaggtgggtaataaaaaactacactgagctaaaggagcatgttctaacccaatgcaaagaagctaagaaccttgataaaaggttagaggagctgctaactagaataaccagtttagagaggaacataaatgacctgatggagctgaaaaatatagcacaagagcttcgtgaagcatagataagtatcaatagctgaatcaatcaagcagaagaaaggatatcagagttttaagaccatcttgcttaaataatgcatgcagacaagattagagaaaaaacaatgaaaaggaatgaacaaagtctccaagaaatatgggacttcataaaaagactgaaactatgattgattggagtacctgaaggagacggggagaataaaaacaaggtggaaaacacacttcaggatacatccaggagaacttccccaactgagcaagacaggccaacatgcaaattcaggaaatacagagaacaccactaagatactccagagaacaccactaagatactccatgaaaagatcaacctcaagacacataatcataaaattctccaaggttgaaatgaaggaaaaaaaagcgagagagaaagaccaggtcacctacaaagggaagcccatcagattaacagcagatctctcagcagaaactctacaagccagaagagattgggggctaatattcaacttttttttttttcttttttttttttgagatggagtctcgctctgtcacccacgctggagtgcagtggcgcaatcttggctcactgcaagctccacctcccaggttcaccccattctcctgcctcagcctccctagtagctgggactataggcacccaccaccatgcccggctaatttttttttgtatttttagtagagacagggtttcaccatgttagccaggatggtctcgatttcctgacctcatgatctgcccgcctcctaaagtgctgggattataggcgtgagccactgtgcccagcctccaacattcttaaagaaaagaattctcaacctagaattttgtatctagccaaactaagcttcataagtgaaggggaaataaaattctttccagataagaaaatgctgagggatttcattatcactaggcctgccttgcaagagctcctgaaagaagcactaaatacgaaaaggaaaaactgttactagccactgcaaaaacacacaaaatataaagaccaatgacactatgaagaaactgcatcaactagtgtgcaaaataaccagatagcatcatgatgacaggatcaaattcacacataataatactaaccttaaatgtaaatgggctaaatgccacaattaaaagacacagactggcaagttggatacagagtcaagacccattagcgtgccatattcaggagacccatccacatgtagagacacacataggctcaaaataaagggatggaggaatatttagcaagcaaatggaaagcaaagaaagcaggggtttcaatcctcatctctgacaaaacggactttaaaccaacaaagatcaaaaaggataaagaagggcattacataatggtaaaggaaacaattcaacaagaagggctaactatccaaatcatatatgcacccaatacaggagtacccagattcataaaacaagttcttagagacctacaaagagacttagactcccacacaataatagtgggagactttaactccccactgtcaatattagatcaatgagacagaaaattaacaaggatattcaggacttgaactcagctctggatcaagtggacctaatagacatctacagaactctccacctcaaatcaacagaatatacattcttctcagtggcatatggcacttaatctaaaatctaccacataagtaaaacattcctcagcaaatgcaaaagaactgaaatcataacagaccacagaccacagtgcagttacatggaaattgaataagctgcttctgaatgactcctggataaataatgaaattagggcagaaataaagaagttctaaatgaagaagaaataaaggaataaagaagaaataaaggatggagaacaaagagacaatgtaccaaaatctctgggacacagctaaagcagtgttaagagggaaatttatagcactaaatgcccacatcagaaagctagaaagatttcaaatgaacaccctaacattacaattaaaagagctagagaggcaggagcaaactaatccaatagctagcagaagacaagaaataactaagatcagagcagagttgaagtagatagagacatgaaaaattctccaaaaataatcaatgaatccagaagttggttttttgaaaaaattaataaaatagatagaccactagctagactaataacgaagaaaacagaataatcaaatagaaacaaaaaatgataacggggatatcaccactgacaccatagaaatacaaactaccatcagagaatactataaacacctctacacaaataaactagaaaatctagaagaaatggataaatacttggacatatacaccctcccaagactaagtcaggaagaagttgaatccttggatgagaccaataaaaagttctgaaattgaggcagtaattaatggcctaccaaccaaaaaaagcccaggaccagatggattcacagctgaattctattacaggtacaaagaggagctggtatcattccttctgaaactattccaaacagttgaaaaggagggactcctccctaactcattttgtgaagccagcatcatcctgataccaaaactaggcagaaacacacgcaaaaaaacaaaacttcaggctagtgtctctgatgaacatcgatgcaaaaatcctcaataaaatactggcaaactgagttcagtagcatatcaaaaaacgtatccaccacaatcaagtcagcttcatccctgggatgcaaggctggttcaacatatgcaaatcaataaacataatccatcacatgaacagaaccaaagacagaaccacatgattatctcaatagatgcagaaaaggccttgataaaattcaacatcctttcatgttaaaaactcaaactgggttttgatagaacatatctcaaaataataagagcaatttatgacaaacccacagccaatataatatttaatgggcaaaagttggaagcatttcctttgaaaactggtacaaggcaaggatccccactctcaccactcctgttcaacatagtattggaagttttggccagagctatcaggcaagagaaagaagtaaagggtattcacataggaagacaggaggtcaaattgtctgtttgcagacaacatgtttttatatttagaaaaccccatcatctcagcccaaaactcctttagcttatacgcaacttcagcagtctcaggatacaaaatcaatgtgcaaaaatcacaagcatgcctttacaccaacaatagacaagcagcgagccaaatcatgaactcctattcacaaattgctacaaagagaataaaatacctaggaatacagctaacgagatgtgaaggacctcttcaaaatacaccacactactcaaggaaataagacaggacacaaagggaaaaacatttcatcctcatggatagtaagaatcaatattgtgaaaatggccatagtgcccaaagtaattcatatattcaatgctattcctatcaaactaccattgacattcttcacagagttagaaaaaactactttaaatttcatgtggaatcaaagaagaccccatatagccaagacaatcctaagcaaaaagaacaacctggaggcatcatgctacctgacttcaaattatactacaagactacagtaacaaaaacagcatggtactgttaccaaaacagacatatagacctatggtacagaggagacctcagaaataacgccacacatctacaaccatctgagcttcgacaaacctgacaaaaataagcaatggggaaaggatctcctattcaataaatggtgctaggaaaactggccagccatatgcagaaaactgaaactggaccccttctttacaccttatacaaaaattaactcaggatggattaaagacttaaatgtaaaacccaaaaccataaatcccctagaagaaaacgtaggcagtaccattgaggacataggcatgggcaaagacttcatgatggaaacaccaaaagtaattgcaacaaaagccaaaattgacaaatgtgatctaattaaactaaagagcttctgcacagcaaaagaaactatcatcagagtgaacaggtaaccttcagaatgggagaaaatgtttgccatctacccatctgacagaggtctaatatccaaaatttacaaggagcttaaacaaatttacaaagaaaatttaaagaaaaaaaacaaccccatcaaaaagtgggcaaagaatatgaacagaatatttcaagaatgtcttcttgaaagaagacattcatgcagccaacaactatgaaaaaaagctcagcatcactgatcattagagaaatgcaaatcaaaaccataatgagataccatctcacaccagtcagaatggtgattattaaaaagtcaggaaacaatagatgctggcaaggctgtggagaacaaaggaatgcttttacactgttggtgggagggtaaattagttcaaccattgtgcaagacagcatggcgattcctcaaggatctagaaccagaaataccatttgacccagcaatcccattactgggtatatacccaaaggaatattaatcattctactataaagacacatgcacacgtatgtttattgcagcactatttacaacagcaaagtcatggaaccaacacaaatgcccatcagtgatagactggataaagaaaatgtggtacatgtacaccatggaatactatgcagtcataaaaaggatgaaattatgtcctttgcaggaatgtggatgaagctggaagccatcatcctcaggaaactaatacaggaacagaaaaccaaacgccacatgttctcactcataactgggagttgaataatgagaacatatggacacagggaggggaacatcacacaccggggcctgtcagggggtggagggctaggggagggatagcattaggagaaatatctaatgttgatgacgggttgatgggtgcagcaaaccaccacgtcacatgtatacctatgtaacaaacctgcgcgttcttcacatgtatcccggaacttaaaataaaataaaatggaaatatatgaggctggataatttataaagaaaagtttaattggctcacagttctgtaggctatacaggcatggtgctggcatctgcttggcttctggggaagcctcagggagcttttattcgtggcaaaaggtgaagagggagcaggcacatcacatggcgagagcaggagcaaggctgggggagataccacacatttttaaatgaccagatctcatgaggtctcactcactatggcaaggacagaactaagacatgaggaatccacccccatgacccacacatctccaaccaggccctacctccaacactggggattaaatttcaacatgagatttggactggacaaatatccaaaccatgtcagtgaatatattttagagtttaaaagtctgtttctaagcttaactttgatatgaataatttaaacacacatgaatgtgccttcaaaccaaactatacaatgtgtaaaaaccccttcgttccacattggggtttcgtattatgaaatataaaaaagaaaaaaaaaagaaatacgttatttggctcagaattatcaagaatctgctctgcaactaatattacttctcactacacatttctttttatttctcagattcttagcactttttgagagatcagagaaaagataaatttaaagattttactacttgttatcatctctagatgcgaaggagattacaattaatcattagattcacagaattcattgataataaaaattattattcttttggccatataacaggatttctgtttctaatgtaggtgtttgatattttaacaaagatccctatgttactttttcttaatagttttcagttggaatgatatacatgtcatatatatataactggagttagaatgttatattgtacaatcattgcatatataaaggtaatataaggtagacctaagaaggccatttgcagtaatacttggaagcaaaatttcttaacttcctgatgaagaaccttaaaatatgttgaacttgctttcctctcatcatcaaattgcacatacttcctgttagaaatgttaacatctctccttatttttgtgagggacaaatattttctctgtatagaaggcagggaaccaatatagggaaattcctaaaggaatgtgtgtaagttgccagcattcatacctcctgagatgtttctaaaagcatcatgaatagtatatagtgaacatcttccctccagctgagcttttgaaatagctcactcagcatttttgtttaacaatatccctgggacataaaccaaatagcatttcctattcagtctcatctgtcattttcctgatttcacaaccagcctccagatgtcaaaatatgaaggtgaatgtgaatgaaattgtttttctatcagagctccctaaatgaaatagaccaagattatcctgtacccctgatgccccaataaattggtcagtcgtcccaaagtaaaagcttgaccccatgagtttctaaatcatttccaacgtgtattgtagtttaaaacaaaaaattatgctatacttgaaggccattttagctgagttataaaatttgcttctataaatcttgccagagtaaaatgggccttggataatcatcaaaacaaatacagatggtccctgacttatgatggttcaacttataatttttctactttgtggtggtacaaaagcaataccatttagtagaaaccaagcttcaaattttgaattttgattttttcctagactagggatatgtggtatgatacttttacatgagatagtcaacacttttttataaaatagggtttgtgttagatgatcttgctcaactaggctaatgtaagtgttctgagcacatttaaggtaggctaggctagactatgttgttcagtaggttaggtatattaaatacatttttgacttatgatattttcaatgtatgatgggtttatcaggatgtaactgcatcgtgagttaaggtgcagttgtattctaagacctctacaaaaaacattgacagcctattgctgttttaatatctgtgggattgcattcttacaatttagatgtagatttagattagatttagaccattggtttctgtttccattacaaccacttaatatataatatgaatctggctccaaggcatgggagaaacatgtaaaagtgcactgtcaaacaccatatgtaactgttggctatattgattttgtggcacttatctattctgtgtgcatttaggtttttgaagtatgcaagttttatcatattctactgggaaaaatggctgatgtagtcttttgaatggcccctcacacaccacaaagcttgggaattctagattcaaataatttttaggaaagaaggactcctaaatattacctatttgagttgtttgttttttcagaggcctggaaaggtaagatgccttgcccaagatcacaaagccagttagtggcagagctgagttaggaaccctgtaattcccagatactcagtttattatttattcttcaattcattctttaggaatctttattagcaatagcatcaacaatcacaaaacatgcttgttttgcccattttggttggtgtactctttcagttttttccataaaaagtatactcagtaacaaatctgccttcagcataatttcccataatcaaacatcatgattaattttaaagtatgaatctaatgattttggcactctagattcttgtgatattttacttcactttgtataaacttaatttatttatctgttttgattcctttttactgagttatatatcttccaccttttttcctataccttttattaaactgtgccttggagaagaaaatggatttttcatagcttgtattctgtgttacagtcacattattgcttaaaaatagaggttagatgtaaccagggacattactgtagtatagccaacttggaatttcttcctcctttggtgagctgatgggaaaagctcttgacttgccattggaagacctggctaaattcctgcagtgccacatttcacccatttgtggggtttttttgtttgttttttagagacaggatctcattctgttacccaggctggggtgcagtggcataataatagctcattggagctttaaactcttgggctcaagcaatcctcccacctcaatctcctgagtagctgggactacaggtgtgcaccactgtgcctggctaattttttttgtttgttttttatagagaccaggtcttgctatattgcccaggctggtctcaaactcctggcttcaagcaatcctcccaccttggcctcccaaagtaatgggattacaggcatgaaccaccatgcccagcccacctgctgttttaatttgggtcatcactaacccctctgaacctttttcatgatagatagaatgggaataatacttgtctattttgtgtcttggaatgtgaccctcatagcaattctgagaaatttataaaggagtactttgttttgtttgtggttcttgatcctttggttatcttcttttaatagggacatcaagagtgtcacctcaaacccccaatatctgttggtgaataaaaaggtgatgatggagaaaatgttttataaattgaaaaatgcagtctaaagtggtctaatattgttaccaagtaatccccaaaagtttttaaattggtacctagggatcaagaaactgcttcactctatttgctgtgctttcttatctttcaaaattttacccttccataaagacacctttcaaatgcttgatttctcttttgtcttttctgattcaccttctccctaccccaacattagcttggatctcatgttcatttattttttacttagtccagaactagaatgatagcaactttagggactgctctcatgaagcatttgaaggaggagaaggccttgcatatgatagttgcttagtaatatctcttaaagtgagatttagggaaaatgcattttttagcgttatcaatttcttccttataattttactttgaattacttatttaaagtttaaataatagtgtatgggaaaaaaatctttatttttaaacgccttctagtatgtattcttttatgggctggaatttgaatggttgaaaacagtagcattttagaggattaaaatttataaattaatttatctaaacatcttttttgaaaaccttcatttaaaaaatctattttccatttatatttttcatttctctctaggtgatcatatttaagtattgtaagttaaggacctgggcaaataattcctcaaaaattatattaatttatttttaaaaggaagtttattcacttactcacggcaaaccaactttaaagataaaaatgtgttgccttaaagactgaagacatgttcaagatggcaaaaagagtcttcctaccccttttaaaaagtaaatgcagaagccgttgtgagcagtgatacttcatgttttgttttccagtagtagaagtgttttaaaatgataagtgttctttaaaatgttatggtcaaaaagaaaagatatttattggctgggagacttgggcttctgatagctttgcctggaattatgatggaaattttgacagaatcataactcaagttgacattaatgggaatcacttccttatgattttgtgtagcctaataaaaaggtcatttgaaaattttagataatcagatggtttaatggccaagtagaaatagcactttattttttgtgtgttaatctttgggtgcttccactaaatgtagatttagtgtgtgtctttcctttgactgttaacacctcttacagctatagtgattgctagtctagtcacagtcagtggctgacatttctatgactactgactctttttttttttttttttttgagatggagtcttgctctttcaccaggctggagtgcagtggtgtgatcttggctcactgcaacctccacctcccgggttcaagtgattcgcctgcctcagcctcccgagcagccaggattacaggcgcctgccaccacacccagctaatatttgtatttttagtagagatggggtttcaccatgttggccaggatggtctcgatctcttgacctcgtgatccacccgacttggcctcccaaagtgctgggattacaggtgtgagccaccgtgcctggccaactactgactcttataaagatttattaccagatgatgacattgctcctgatgtctctaactaggtggtcccccttcacttttcttagtcttctgccatgacccctccctgtacctctatagtggaagtggttcacattagttcgtccttaaccttaattctaacataaatgaatgtggaataccgcaaagagaccaaaagagctagctgtatgctagcactggctctgacagctaacaagctttaaggctttgagcaaaggacttctcctctccagatttctttttcctgatttgtaatatgtgcattggattaggtgatctcaaagatacctctcccttctaagattttatattcatcaaaattcatctgccagaatggcactgtgataattagatagactgccagctggatgcagggaaatagcagagctaaaagctccagtctaaactatccctggtgaatattcatttttgcatattttaataacaatactctcagtgtctcacctccacccagtcactcttgcaccctgtcactcacttagcaagaccctttcttttccttcacgttttacaactctgtaatttaacaaaatccattagtaccaacaaaatggagtaacagtgatgttttaatatatggcatgtacccttaatatcattactagtatttgagaaactaaatgaaagatttttaactttgacttttaaggaagaaaaaaaaatcacctttctttatttaatgagtaaaaaggacctccagtaaagagtaatgcaccataattgttattcacttcacactcattcctttttttggcatgcagagcctcatatattcttaagcataaaatgctggatgacatattaaatgaagggtcattctggaaaataaaatagacaaaatggctttactctcaaagataattgtgaagtaaaaaccaaaataatagcttattcataactatttggaggcctttcttaagtccagaaaggtcagagggaaattgaataaatgtcaacactgtcaggtggggagactctcagcgtctcctgaggaatttaatttatattaatgagaagtgagacctgcttagggccctctcagagactgctctggtgtcaaattttaatgatttaacttcatgaaaaggattcctaacaagttatccaacaagataacctcacataagattgctttttaattgtgaggcctcaattgctctgacctccccaaaccacaggcacatgttggggcttcttgaggacttgcctcaccaagtcgataacttgccgtcagttctggcccttctaggggaccaggtgaaccaagtgagattctgacgataaagttctaattcaattcagcagacattcatgaagacctatcactggggcaatgtgtgagtgacaatagtaggtgccacttatgaacacttaatgtgtgtcaggctccctgctcaacgttttatgttcccaatttctaatcttcatagcaacgttacagaattacagatgtggagaaggagactcagagacattaagttaacatgctcaagattataagtattgccaagtagctagcagaaccaggattcgttaggtcagtttgcctcccaaatccatggctttctgctactcacctatgtcttaggtttttttctttactcatctaacgttccagtgttcataatagctttcctttgtctagctatgttccagatactgtgctgggtgttttattatgtaaacctactgaatagatgatagtagccccactaatgaaaaaggagggatggaggattcagcagcttgccccagatcacacaggtagaaaatggcagggctaaaattctaactgagatctaactgatcttccaaacctatgctcttacgattagagaacagtgactttaacagtgctgtgccctgaggtgatacagaagtgttaaagcaggcctgttcactctgatagctgaaaagtccactgggttgagatggacttggactcaagtgtctgtaaagccaagcagaataaatgtgaaatgaagtgattttgaaaagatgttggggaagtacaggggtaaggaagattaattccaaatagaaggcacagaatggttttgccaatgaattggattttaaaatacaaagaatgaaagaaaacacatttcaggcagagaaactagttttcccttgagtaagtacagctttggtcacttcacttaggtttggatgtatagtgtttttgttgtaatttcaagtaattagtaactttagttttaattttctcattggctcatgacttatttaatagttgtcagaatctttaatttgttagttttgtgttatttaataagttatttttatttgtactgcctttgggttggagaaaataactgagtcattagtttatgaatttattaaggttttctatgtggcctgtgaaatgactgatttttataaatgtttcatggatatttgaagtgaatatttaaatgtagatgaattttctaaagagtgagtgtgaaggtagaaacttgtttattagattatttgaatcttcacatattttttcattgtctgatgagctaacaaattatcacacaagaatctcctacttgtattttgggttcaaaggctttttctcatattcttggtttttacttcatgtaattgatgatgtgtgttttggtatatataactttgtgattattatgtcttcttggattatacctattatcaatataaaatatccatctttgctgtattttttttgctttaaattcactctgttatgaatattgttagagcgaattcagtttatataacagataaattgttgcccacatttttctttagagttgtcttttatattaacaggtttctactccatcagatggtcttttaaacaattttaccaacaaacatttattttgattgctcatatgattgattttattcctgacattttattttgtgttttctgatgcttttttggtatgttttcttttagcctccttttctttctttgactttattgattttttaaaaatgctttaaaactatattttctttcctactagcagcagccttttaatcaatacctacatactttatcaatattaaaaatgaaaatatccatgggctccaaccgaacaagaaaacatatttaacatgctttgatttatcctttttattccccttccttcagtgcttcaagtgttttatggaaataatatgagattttatttccacatcattatctatataggtgtactttacctatacgttttgtctcttaaaaatattataatgtggctatatttatagccacattataataattacatgtatttaactttgagttttactgagttcattgttcactaccatttcttgcctgctatacactcctttcttgagtttttgtttgagttaatttctcatttcatcgcagtatttcaagtaatttttccagaaaatgtaaatgggtgaacagtatgatgatactgtgtcatcagtgacctgcatattgctaaatctaaatgatcagttctttgtcctcacctttcttaagctctcagtagcaactggcaaatgattactttcttgtcttcatttggcttttaagataccagtttcttttggttcttttagctcaatggacactatttcttgacttgcttttgttcatctccccagtttcttaatgttaggctatcccagggctcgttcctcaactctcttttcttctgtttacttgtgttctctaggtgattccatctaggttcgtggctttgcatgtcatcggtataaatccaaagtttacatctttagctcagacctctcctgtgactgcatgtttcccattgtatactttatatctgagacttaacatgctccaaaatgaagtcctggtctccccacccaaacctgaactttcctaaatattattatccatctattactattataacatagcctcctagttggtttctctacttccatctttgaccctccacaccccattctctgacacagcagccagtcagcatccatttcttcaaaggttcatgtttttataagggtctacaggatctgcatcgacctcacactctaaactcatcttcccctaaaattctcctcctcacccagtcatattggtctacttgctattcttccctcacagcaagtgtttatttaaatgtcttcacacatgctgtttcttctatctgaatgccttcccccagatttctacacggcttcctcccccacttacttcaggaccctgcgcataggtcaccttatctcaagcgcttgaatatgcctcatatgatgtagctccttggtacatacttgttgatgtctgtggggataggcaaaatgccttttgtcatgtttgggtctagtattttacatcctcattcttttttcttagaattctgatcagaccaattattgagaagcttttgggaaacactgtttatctttcctcatagggtgtggaaaatctcttctgtgctagttttgggtgccaggcagctttgcattatttgtttttgcgtaagttggtctcatttgttcattttgtcaaaaaaatccttttaaatttctgatttatggtttcctaatttttcaatgctatatttctttttataattatttttgttatttccataggatttttgagaaggatgggaggtaaatgtgtagggccaattctgaatctttaaaatagaaatgcataaaatgtgcttggctctgttcattcacaaccatacctatccatttgaaaaattaagcatttttctgtttgtgtgtgtgtacgtatgttttaatttattgagtctgattacaatgcccacttctacatatgaattttcagagcctcttgtaatagttccacagccctaaaattgggaaactatctgctatgaatatatagcagaaacatagtcattggaaatggtgggcacattggtatccctaaagagtagagtaaaattcattttcatctaaaggaacccaatcctcttgtttcacatttagaaatcatcttatgtcattccctgttactctcacagaaaattcagagtaaggaacacaggtggagaagaaatgggcaggcagctttgcagagatgttatcaagataacatttttcttcacattctgtagactctagagaaatggtttacaagagagctttaaaggtattgttttaacatacatatgagctgtacttatgtatgacacctattttactttttcatttttgttgttattgtcaaaacaaggccagtgtttttctacatcgactgaatttctggacccacttcccattcaaactgtttttttgaaaaacagtcttattaattttctgtatattttgttttctttccaacatttttagattcaaccatcagacacaaatttctttttatatctgctttgttagttgtggacatgcctttctaccgtgtcccttgatacatacacccattaagatgtttatctagctcgactaacactgagtgctggaatctgcaaagttacagaattgagaggatttagatcacatatcatttactctgaaaagaaagaaagggcacagattctggaaacagacaagtttgaacccagccctgctacctataaactgacttgtgggaccttagataaggtacatatctttaaaaaggtggatagtaatacacaccttgttagattgttgtagagacagtgatacgaaatcattgcccaaggttaggtgtggaatagtagctgtgtcagtcagggttgtccaaagaaatagaagcaatagtgtgtgtgtgtgtgtgtgtgtgtgtgtggtatgtgtgtatgtttgtgtgtgtgtgtgtgtgtgtgtgtgtgtgtgtattaagagacttattctaaggaattggcttatgtgattgcaggagctggcagatcaaattctgtggggcaggccagcaggctggaaattcaagtgggatttctttgttacagtcttgagtaagaattccttcttccctaggaaaactcaatttttgctgttaatgtctccaactgatggataagactcacccatattatggaaagtaataacttttacttaaaatcatctgattgtgatattgatcacattctcaaaataccttaaaagcaacatctagactaatatttgaccaaaacaactgatcaccgtagccttaccaagtttacatataaaatataccatcaaaatatttaataaatggtagctattatttttaaagatggtattttctattacttcaattattattattttattccataaacatctcttgaggatctaccacataccaggcactgtgctaggtatgtgtgtgtgcacacatggaggtgggggaaagggagagggataaaggtggataagttataccacttgttctctaggcgtctatattccaatggaagagacaagtcaaagggaaatgataatgtattaggaattatggatagatatataatactgtaaattatatatttatgcttttgtattgtatttatttatattgatacctatatttatcttggtaaaattctgtccatctcttcatccttccatccatttatccatctaatctgcaggaccttgtttccatttttgccttgagttgaagggaagagaaaaattgtcttggatgaaactactctgaataagcattggttgatgtcaagcaggggaatgaacctctaccatgattataatgagtcaggtagctttgttgttttataaaggtatttctaaaaccctcttcagaagcaatgcataagtaaaataagttttctacgtgaaccaaggctaaagctccactcccctgcaggttttgcgattttactctagataatatgtactgtttaattatggttcatccatataataaaatattatgggtctgttaagtacttttaaaagcatatatgatgttctttcaatttgttaggtagaggacatgactgtaaaatattacttagtataatctttatatgcattgaaaaagactggaagaaaatacaccaaaaactttacagtaactatttttggacagagggattatggttggttttgattgattgctgtatatgtttctgtatttctcaagttttctaatttgaatgtccaagtgtggaagaggaacagatggtaaagagtatggctgtagactcttgtattgggaagatgaactcaagcaggtgggccaaattcttattgaccttgccttgttaaggtatcagtgctacattattgatagctgcacttataactagatcttctatcatgttcaattgcagtgtcttattatcataggcacattatattatggggggaagagggagagagagaaagagagagggagggagtgaaggaaggagagatagagagagagagagggagagagaaaatgaaattatctttcacaatatgagaatctatctttcacgatatgagtggctccctatgctattcctggagccagcctgagatgtgagatgtgaacctgctgttcctcagttatattggttgccttgtgtgtctcatgttgtgagcctcttgccatgctgggtgtgattttggtgttgaaagataaatgattttataaaatatgatccaacttattcatttggttcacagcagaaaaataaagatctgctctagtactggaggagggactggctgagttggactcattgagcgatgttacaatctttgtttccatgaacttttctaaggaatgttaagggtagttttgactgtatgatttgctaatccaacctcatatatctttattatacgaaatttatttttgcatttccctaccagttccaatatataagtgtctctctgaataaatgttcttcccattgtggccctactttgataccactatctaattatagagagcatattttgccaatggtaattcttaatctcattatactctaacctgaatttgttcatcttggaacattatattcttacaggttgacactgatttattgataagctctgaatattagctttccagtctttcaaatgcccgtctaatagttctgagatatatactttatttaactagtttttttggtgatagccccatcattaaagttaagcttatattagatcagtaagttttaggtctaggactatctttgtttaatacttgtaatcagaatcataatcataatatactgatactttatatacattggaagtgccttgttttaagcgattataacaagtgattttcgagagacagatgcagtttattttagtataccaaaaggaagtcatcaaaatctacagattgaaatacatctagctttttatgttatctttcattagttctttcccttccttagtttaacacagttttctgttcttaaaattctagtattggttgaccctattctcatttgatttttgatgggaaaagtagaactagacaaaacatttttttaaaaatcacatttttttctaagacttttttctttttatttgaatgctttacattttaattgctcatttaaaccttttaaaatcttagccctagttttcctttatccatcagttttagcctttcatttctattgcttccttttgggcttctattcattgaacaatttctaatttttactagttttctttctttctatttcctgccctttcttaacattattattattatttttttaggaaagaccatgtgttctgattctttaaaattttatatttttccctcggtgcttttctattggattctacaaattgtatttctataggagtgttcattttaaaaaacaaggtgaggtgtctggatcagtatgtctattaggttatctattgctgcataacaacataccctaaaaattagcagcttaaaacagcaaatatttgtataataattgttgtggattaaggacccaggcaggccaggtgcagtggctcacgcctgtaatcccagcattttgggaggccaaggtgggtggatcacgaggtcaagagatggagaccatcctggccaacatcatgaaaccccatctctactaaaaatacaaaaattagctgggtgtgatggcacatgcctgtagtcccagctactcaggaggctgaggcaggagaattgcttgaacctgggaggcggcggttgcagtgagccaagatcatgccactgcactccagcctgacaacagagtgagactctgtctcataaagaaaagaaaagaaaagaaaagaaaagaacccaggcacaatttacctgggtgcttctgactcaatagctctgatgaagttacagtcaggatggtggctatggctgaatgctcatctgaaggtttgatggggtggattcactttcaagctcactcatgtggttgttggcagaaaaaatttaattccttgtgggatattggacagagagcctgaatttctcactgtttgttggctgggggcctcccttggttccttgccacataagcttccacagagcagcttacaacatggcagctgatttcctttagaacaagcaaatgtgagagcaagacagagtacttaagatggaagccatagtctttttataactccagaataatcactttatccatgctttatttgttagaggcaagtcacttggtccagcccatatgcaaggaagcaattacataaatagcaggggctcagattattggggactattttaggggctgcttaccattatatgtgttttagaagcagaatatgatacatactttaaagcaacaaaagcagagctccctggaacatggaaggcatggaatatggaaggcagtagaaatacaagtttgagataatatctcagactacaagagtagaacagtagcagggctttgtaaaaatatagatagtgagaaataaatagtttaggatgaagattaaagaaaactttcttatcaatattaattctggtctacgtattttctgttcattgaagctacctagctttttgaaagtagttaaaacaaatcacatccaaaactaagaataactatgcaatttatgttcaggaatttatcataacattatttttaaaaatttatgtgcatacatttttctttttctctcaagtttattttttattttctgtgtacttcttcatttctcttggcaatatagtgttttccctcttgtatatataagtgttttgcttttaattgctgagattttatcataaactatctagccaaattcctttttaagtattgtcactatgtttaatgaatactaaagcgtggcagagttaaggataatcaaaaagggatgataaagtgttcctgggctagcaacagtgggaaactatcactaccccaagcatgtaagggcaagaggagggaatcatgttcctggaaactagcaggagctgaacatatgacggagggaatgcccagctggagcaggaatgcagccgctgcttgtggtctgtcagggaagaatccaaggagatgaataccccaactttgctctcctcttaccctctgatctcttgcctccccttggccaaacctacgagaatccagaaggtaagtgagcccagttgatgcaggctgtgcaggtcagcctctcagggcagagcccagcagagaagagaaagggagagaatgattctgaaggggcaaaaggagaatattcagcaaagaaagaagtttttttaattctttgtattgtctgtgtttggctattagcctatttgaatgtatccactgtctaactgtaaaagttttgagttttggttagtctttctactcaaatggccccataatggttacaatcaagtcttcaagaaactttgttgttggttttcttttttaagtagtaggctatatttatattatgttttatttatgatcacaagcatggtgtaagagtgcttttactgtggaagtttgactttaaaatggcctaccaagaaggaatatgcatcctcgttacatttggaactataaaaataaatacagtgttgttcacacaaacaaataatttttgctggatagttgtttatcagtttcctggagccttgttttataaatactcataaacttggagaaaaagtctacttgagagaagttgacactatatgtagtctgcttattactactttctttttttttaaagtgtatcttacatttagaaacagatactataacatagaagcaaagatgactgatgagattttttcaccaaatatttatggaaaccttccacttaatatgaacacacagagataaatagtgtaggcgtatggtgattaccaagacagagtccttgctctaaaacagtttaccaccaagtagggtatttaagtgcataaacaactaactgtaatgatgagtagtgtcccataaatactgtcttacagggacaggtaatagtataggagtgcacagagtgatttcagagaagctagtgtttgagctaaaccttgagtggtgaatacaattatggtagaggagaggagaattcattttgggcttagggaatggcatgaataaggcacaactcaataaaaatacaaatatgaaggtggggtaagaattattcaagaccgaaccttggtgaacaacatatacaagcaatggcaagagtgaagggtgttcagaaacatggtagaagattaggttgccaagagagaacagggctaaattgtcaaggtcctgagtgctttgctaataattttatgttttctacatagaccttagaaacgtttttgtaaaggggagataaataatggtaaggtaagggatcagctcaagatggaagagaatggggcagagaggcttttggtgatagtgtaggaggaatgaggaggaatttgcatgaaggaggaagaggatttgcctgaaggccatggcatgggaaggaaatggagaacatagatataagacatcataagtgctgataatagacttgggggtttcttgatttctgtttggagtaattggtagaaggtgaagctgttacctaagagacagtagaaaagaaagagccggctctggaaggaagttaacaaattcgattttagacttattaagtttgaggtattagcactggtctaatgtagatgtccatttagatccactggaaattttgtctagagctcaggagttgcctgggttcagaatagaaatctgggaacataagcctgaagatatttttaaagccatgaaagtaagcgagccctctcttaaggagggagtttagcgtgaaaaaaggaccaaacagagaactgcctacagagaggttggacaaaagtccatttaaaaagactgagaagaagaaatcaaagaactaagaggaaaatcagggaactgcagttgtcatagaagccaaggagtcggggagtttttagaagattttagaacaatgcgacattaagaactatgtttatagcaacttgtaaattagtcctttctttttcccccaggagctttaaattctgcccatgtgggtgggttgagggagtcttcagagtttgtagaagtagctctgggtttctgaaaaatgtgaaggtgatgtactgacctagttaataccccgtaatcctgggaggaaggaaggggctgtggctggagtatttatttcttgtcatgataggtcttgtcatgaatattaactatttactctttgaagtcacaagtgaaagaagggtctggctgttctgtttaagcatgtcagaagaacaataatgcttactatgatgacttctcaatcttgaaatatattcagcgcttgaaactttctttccctccctgtccccttccccttccccttccccttccctgtccctttccccttcccctttcctttccccttcccctttcctttccccttcccctttccccttccccttccccttccctttccccttccccgttcccttccccttcccctcccctcccctcccctttttgacagagtctcactggtcacccagtctggagtgcactggcacaatcttggctcactgcaacctccgcctcccaggttccggtgattgtcatgcctcagcctccccagtagctgggattaaggcatgcgccaccacacctggctaatttttgtatttttagtagagacggggttttgccatgttgaccagcctcaagtgaacttctggcctcaagtgatcagcccacctcggcctcccaaagtgttgggattacaggcgtgagctatcgcgcctggccggagcctgaaactttcaagctttcagtttaattccatggcttttattttcttttccattttaaacccagttatttcctgaatctaatttatttatttttgtgtatatgtctttaaaaggtttcctaacaattacatttggtaaataagttcttattaagtgtttcttttagttgttgtgcttttgtttattgagagaaattgaaatttttaaattttgcacctttattgcaggctgccacaggtaatcaagatgatatgcaccatggtaaacaatttctttggaaatccaagatatttcttgaactcggggattcaggaactgaagtttgaccttatcttattgtataaattactttaacattatggtacttttgtacctcatttggagattaaagagcttgaccaaacaagataggttagcatccagtcacctgtaatgaggaaggagttagttttcatgtgtgatgctttgggtatcagggatatgcatagcttcataaataactgggattttcattggtattttcctaccgcaggtgtactattttgatattaatagtctcatcctttggatctcttacgtttggcagaatataagtaagaaatctgaataaaggtgaatgttcttacatgtgttcttggtagaagtatatgtcactgtcagagtaatgagattgagggtgaggttgtatgttatgtatctctgatggagattttgaggggtagccagacaggtcaccaatcctcaaccatagctgtctagcactgccataggttctgcagagagttctgcagagcagaccttcttagcaaatgcaccttcttccttgtgctgggctttgaccccagagccttccatggaagctataggtctagtgggttggcctcaaccacttgtgagtgagtattccctttatccttctggcctatgacttagactaaaagaagtctgcctgggctccttttactgaggtctaatttttatccttggattcctgccattcctatgcaatgagaaaaacaaaccccagggggagagaaagagagtgtactagcattgccttctagcctagaccctcacaagacaggagtcctgccaagcaagacacagccttttcacatatgggagtaggcaattcaaaggaggaccagtaacttctagtgatgcagatagaggaatccaaaaggagcacacagagtggatccaagaaatttaactgtaccacttcctaacatgtaaaccatttggcattggttccatactaatgccaattcatctgcttctcggagtgatggaggaggagtgttgaaccctgagagtagtttgtatctctgcattcaagagagaaaacaagagaagctggtagaaaaggcttctcaatttgtgagattaatctgtgttacatcagaagtagtgagaaaggagagttaggatttagaaggcttgggaagacctgaataatgtggataatggtatgtgcaaagccataaaatgtgtggttttgatgaggttagaatcatgcctgaaagctgaatggggatttagacatcatgtggggtatgtaatctgcaagctccgtcctgggcccagtgaaaacctttctgtgagctttccctaaggctgtacttcaggcaaattattatacaagggggaatctatttgccatctctgagcaaatccatgcctccctacctactataggttaggaaataatcttttatatctgttggtgttgcatttacaaagggcttccccgtatattatcacatctaactctgcctgttaatcacagaggaataaatcatggcatctgcagagtagagcctctaccagggtgtgtactcttcatacaaccatggacctgccctctgttaacaggattctgtattgggagagcaaacccttaaaagcagggataaagatattaagaggtcttcctgtcttttactaaggtctgaaatgccaccaattctagcaattgatttatctggatcccctaagaccttctattagagtgtgaatatccatgcaaaagagttatgggctcagattgaagtgtgtcatgtagaaattgatgaagaagcgataattatagcagattcattgatagttttatgtatgtactaatttacttgatgttattaagaaattatgaagtttagagcattgctatagtcactgtgaggattaaaatgctgaaaaataaatgatcccttccccaaagattttacagtgtagtaggaggtcctccagtgaagaaagggggagactttggaaacagaatggctgtaggaagtgatgaagaatgatgtagataaccctaagctttcttttgtaaaagttacatttgataacctctttgagttgttcatttggtggcattacatactgtgatggggtaagatgaatatgaaacaggttatcatgggatagatgggatgccctgtggacaaaatccatgaagatggtatatgaatttttgaaaatagatgaggtgttcctggagacatgattaaaaggaagaagaacagaggctcaagtaatagctcaaagagttttaggccccccaacaggtagaagagttggattaatgggttttgaaggagataatgcacaaaaagttaaattatgaggtcacagaataggtaaattctgtattctggacaacaagcaggaaatctagcccaccttggtgtagacagtgaaccctgatgtcagaggtcgaagaaaatctgatttcacctatattttttagttttgttagcatgaaactactttttaaaatcactttattgaggcataatttatccacagtaaaacaaacccattttaagtacatttcagtgagttttgataaatgtatatagctgtataaataccaccactatcaagatctagacttcaattactccaaaatgtttcttgtgccccttcccagttattctctaccctgatccttggccccaggcaatcactgccctctgtcattatagatgtaaatttgtcttctctagaatttcatattaatgagatcgtataatatgtactcttatatctggctttttgggggattcagcataatgtttttgagattcatccatgtcgttttatatgtcagtagttcattccttttcatttctgactagtattccattgaatatactacaattcgtgtattcattcagatactgatggacatttgagttgtttccagttttctgactaccattaatttccagtttttgactaccattaatcaaagatatacatatctttgagtactcaaatatgtacatctgagtagaaatatgttttcatttttcttgggtgaataggagtgggattgctagattgtatgttaagtatatgtttagctttataacaaactgacaaactgttttccaaaatggttgtatcatttttttcttattcctaccagtagtgtatgaaatttcaagttcttccacatctttgccaacacttggcgtagacattctttttaattttagtcattctaataggtgtgtattggtatatcattgtgttttatttttcatttctttggtgactactaatatgcttggtggccattcatacatgtatttttgtgaagcatctgttcaaatctttgattttttttactgtgttatttgacttcttagtattgagttgaaggagttcttttttttattatactttaagttttagggtacatgtgcacaacgtgcaggttagttacatatgtatacatgtgccatgttggtgtgctgcacccattaactcctcatttaacattaggtatatctcctaatgctatacctcccccctccccccaccccacaacaggtcccggtgtgtgacgttccctttcctgtgtccatgtattctcattgttcaattcccacctatgagtgagaacatacagtgtttggttttctgtccttgcgatagtttgctgagaatgatggtttccagcttcatctgtgtccctacaaaggacatgaactcatcattttttatggctgcatagtattccatggtgtatatgtgccacattttcttgatccagtctatcattgttggacatttggcttggttccaagtctttgctattgtgaatagtgccgcactaaacatatgtgtgcatgtgtctttatagcagcatgatttataatcctttgggtatatacccagtaatgggattgctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctctttatggttttgatttgcatttatctgatggccagttggaagttctggccagggcaatcaggcaggagaaggaaataaagggtattcaattaggaaaagaggaagtcaaattgtccctgtttgcaggtgatatgattgtatatctagaaaaccccatcgtctcagcccaaaatctccttaagctgatatgcaatttcagcaaagtctcaggatacaaaatcaatgtgcaaaaatcacgagcattcttatactccaataatagacaaacagagagccaaatcatgagtgaattcccattcacaattgcttcaaagagaataaaatacctaggaatccaacttacaagggacgtgaaggacctcttcaaggagaactacaaaccactgctcaatgagataaaagagggatacaaacaaatggaagaacattccatgttcatgggtaggaagaatcagtatcatgaaaatggccatactacccaaggtaatttatagattcaatgccatccccatcaagctgccaatgactttcttcacagaattggaaaaagctactttaaagttcatatggaaccaaaaaggagcccgcattgccaagtcaatcctaagccaaaagaacaaagctgggggcatcatgctacctgacttcaaactatactacaaggctacagtaaccaaacagcatggtactggtaccaaaacagagatatagaccaatggaacagaacagagccctcagaaataatgctgcatatctacaaccatctgatctttgataaacctgacaaaaacaagaaatggggaaatgattccctatttaataaatggtgctgggaaaactggctagccatatgtagaaagctgaaactggatcccttccttacaccttatacaaaaattaattcaagatggattaaagacttaaatgttagacctaaaaccataaaaacccttgaagaaaacctaggcaataccattcaggacataggcatgggcaaagacttcatgtctaaaacaccaaaagcaatggcaacaaaagccaaaatagacaaatgggatctaattaaactcaggagcttctgcacagccaaagaaactaccatcggagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagtgaaaacacacatgaaaaaatgctcatcatcactggccatcagagaaatgcaaatcaaaaccacaataagaaggagctcttatatatcctagatataatttttgaccaccggaaattattaaaaatcttgccatgatagtgctttcagtgcattactgtaataaaaataatggtctagatgctaaaatgtaacacatctgctatgatatagctcatttgaggataatagaaaaatatcgataaaaatattctttttgtcatcttcaacgtgcatgatctcagatttcaaaaaggatgcctgcctacatatctcttcttccagtacactctgcaatctacttaaaaaaaattttttttaagatagctgctagatgagtgccagttttatattcttttttttttctggcaactcctttgagaaacatatgtttctaacttaagttactgctttttcctccatatgcttcttattccatttctaggtatcagaaaggcatttgggttgaatacgtgcatgattaagtccatggagcttattggtggagtcaggccctccaaataggaaagaaaagagaacctgatcaccaccaatttaaaagtaacttagaaacaaaacatcaaactctttttctgccagtgactttaatttttaaactatataaacacttgctcatcagctattttttgtgctattttatgcattgttccaagctaaacttcctggggaagaacacaggcactactttcaagagctcagagaacaaatgctggaggacaagagagggaattaggattcttgaatgctacttatactatttacttctggtcttccacaacttcatgtaatttatcatctgcccttattgacttagaagcttacatgatagtatttggttcaatgacattgagtaagcattctgcaaattaattagtgggacaaatttggtctcataattccactgctgcttaaagttattaaagaaatctctcaatctgctagcattgtaaatagcctattctagctagttatatagattcaaaacttactttattatgtaaactatagagtgacaggtcagtgaaagtgtttcaacttttagaaattgttgactttccaggacttgcatttctggccttaattatcttgaatataacaaatcagtgtacggtaagcaaagtgatctctggatgactaaaatagatattatatctcatatctcatatggttcaggcacagcataattcctccaatatcactcagagcttatgtattcttatattaggcatgattttcataagactggttatttgtttcccctgcctgcagctattaaaagcaaaaaaggtgggagttgtggggaggtggtggtaaagagggactcctatatgcaaaaacactgatagcagattagagaaggagagaatcatattttaaaaaaaacatgatttcaaaggaaggccaatttgggaccgtttagtacatgtatggcaaagcccagtggatcttaagggcatccctgtgtcatagggtacaccaacaatgtgatggcccatgagttacaaagactttacattgtgattaatattccttttctttgttcgtaataaaattcaagatagatttcaaaccaaaatgataaacaaaacaattatgtgtcaagatttagcaccttgaccacctggaaaactttgtcctgttccttgccctaatgcctttgtgccctccctctccccagctgcacatgcacacttgcacgcgaatccttctcactcacaggagtcacccaccgatggaattttctctgggaaaaactggttgagctgcccttcctttgagctccctttgcttataatatcatggcactaacaaccccatatggtgattacctgtttatttgctcttctttccgatgagactgaaagctatttgagggcaaaagcttgtcttatccactgttatataagcctatcacttaggacagttgtacctggcacatggtatagagttaatacataattcttaaataaaggaatggttgaatgaatgttgaataaatccagaataacttctgaggaaccaagatttgtctgcacagtactttggaaaagcagcatgctaaaacctttggaaaatttgcgctctaatctgtttggaaatttctattagaaaccatcacatggataagagtttagagtaaggtgtctttaagttagatgtctttaagctgtgaaaaataaaactgaatctgaaaaatgaaactatgcataaatattctagcataataaagaagttatggattttgtctttccttaagagttcttatttgatataaaaatatcctccatagcaaaatgaaaaattgaatatgctatatttctataattttaaaaaatacttttgcaagtgatactttaagaaccattaatagttcaccagtgatttggctgaaagagaacaatcagaagcatgttgtttcatggatctagtaactaataaaatacccttgcctggaataatttaaatccagaaaagagaaaaagctcattactgacaagtttgctaatgataaaaaattagatggcagtaaataacattaggcaataacattaaagttcaaaaatgccatgttgaagttattagacttgtaagtacaatgatacatacaaatgaaggagaccgggtttaaagtgcagtaccaggaataaaacagagattaaagagaagggttatttaacactgggatggttagtgaaaaagctcgtgaaatctcctcagactgggataatgtctttgaaatcctttttatatgaatgagtaaaaatcataatcattaatattatttagttttagaataaaattggggaagcccactaaatacatgaagtgttggattagacaggtattttaatggtctttgattcaggaggctgactgctctacaagccttttctgagagattctttttccttctgccttttcctctccatctggcctctgtgacaactatgttcttctactttttcatttatctaggatcatagttgggccacttaagaactgggctttcttccaaaataggatatttgattgtggccattttgacaatgttgtcttaaatataaaaaggcacacaaaaatttttcttaataaccaatgggcattataggcatgcgtgggtgtcatcctcatgctaccttacagtacctggtaggctgatggatggaggaaggctcttggagcgagagaggacgtctgttgcaaatattgcattacttgttatgtatacaaaagctaagaacgcgtagcttttttgttagtttgttttagactgaatagtctaatatatatagttataatgttagttatgttttgacacaaaagttataacattataactgacatagtttgtcagcttagtttgttttagactgaagaaaaatatccccctttcagaaaaaaagctacatcaaaatgtcatatacctgcttatttctgttttgcattaggaagttaataagcaagtaggtgggtgaattgctctgtgaaacctgggctcaataaaacattttgttttctttttattacttaaattggtttttgagccctgcttgctggtgaggtatctgatgtcgcccattgttgggattccttccccagctttctccccacaatgccctctcccctgcaacactgtattgccttggactcccagggcttaaatgggtcctgggaacatgggcagatgtctggtcctgagccatcactatggtcaccatggctccttctatccactttaccacgtctgaaatggcacttcactccttgggggtggggagctctcaaaagtgtctctccacagctcttgtctctgcaggcgggctccagagtgtcagccaagggcaggatattctgaagccagccagtgcccacagccatttgtgggtaccctgctcagaagtctgccacctctgggagctctatggcaataagggccaggcctctaagactctagggcccaactgcactcccagcttgccccttctcctccccaggctcccagtatctcaaccatgcaagggcctttcttggccttttctttcacaatggggtttaatgacccatgtggaatttctaaatggataaaacctgaagaccaccaaagcctgtttacttttcctgcacataagaaggacttgatttttaggagtgcggtgtatggtctcccatctaccaaggatagacggtatatttctttgaggcagctgaaacccagcaactgcacttatgcatttagtttctctctctctctctctctctctctctctcacacacacacacacacacacactcacacacacacacacacacacacacacatattaaagatctgagagtatttgtttcggacaatcccttttagcagtaggagggtggtgatgagggaagctttatttcaaaatgctaatactgtaaagttattttactcatctccttgactgtcttcatatactagaaactgactataacatgatccaattgtagtgtgaaatttagcataaccaggttcccctggcagctaagaaggtatagttactagaaggcctgcattataagatggccacaatgtgagacagcagcacagtagtgactatctcaccattttcttacatttttattcagttttctcggtatcagaaatttacaaaacccttttctcttactttccatctttgccaaaaacatagaaatctgaccagatttcaccagtcaaaactcattgaaactcctgaaatttaagttaggcaattcctgcttttcactatagtatgttcctgtaaagaataacagaaaacaaagacagcaaaaaattagtatttaatctttcctcctgcgtaactgtggagcctgcagttacccttttaaatcactagatgacgcttcggcattaaggccagctgtggggactggccagtcagcaggctgaatattaggatggtaaagacacaggcagtgagtgatatgagatttttttatgttatccagggtgatttttatatgtgacaaaaagactattaataaggtttaattttgattttaaaaactgacatttactttttaaaaactactttaggcttttcagttcagcttccaactctagtttcttcttttttatgtataagtcagacagaagttagtaataatttcaaagggcctttgaataacgtttagtcccatttacaaaattaattaaacatttaaactgtccttatacatttaatatatgtatttctttttaaaaacttaaattatcttatttaaaatgtcactggatagtaaataataacttcacatttaataaatcaaatctataaatacagtgatcctcaaattttctcaaatgttccaaatatataaaatgtcaaaaattaatagattcttgaaaaataattattttattcttaaaaatctttacatacttacacttaactttctaaacttctgaggtataaaagatacaaccccatttgaggaaggcagttaaaaattcagttaactaaggttacttatgaccagggatttcagtattaagacctagagttgcagagacccagagcactttgtctcatcaccaactaaggaaactaccaaatatcaagtaattcagggcatttctcagtatacaaaggttactaatgaccagaaattcccatctggatgctgattagattcctgctgacggctgggcacggtggctcacacctgtaatcccagcactttgggaggccaaggcgggcagatcacgaggtcaggagatcaagaccatcctggctaacacggtgaaaccccatctctgctaaaaatacaaaaaattagccgggcgtggtggcaggcacctgtagtcccagctacttgggaggctgaggcaggagaatggcgtgaacctgggaggtggagcttgcagtgagccgagatcacaccactgcactccagcctgggtgacaaagcgagactccgtctaaaaaaaatatattacatatattcctgctgactagattccaggagatctggatgatgatagtagaacccattttatagttactttctcagggatttcaaaacaggcattgagtcttatatgttcctctgtccctgggtctagattatttacacattactaagtcctcccgattactcatataattctccatcacccaccaggttcatcacttatatctttttggttcccaagttatacaaatgattcatctaagtctaaggtcttttgaactagatggcatcttatattctttcatattctcaggaccatacaactctaacagatacttacaatgagatagattgaatttggatatctcagtatctactttgaagtcacctgtcatgaagtaatggttcccacagcagtgaaaagtaaaaggatttatacacttttggtacttgcagataagcaaaattatgtaataaaacttttgtctttttaaggaaccatctatatgtcaggtactgtgctaggcaaaagaatataatcatagttaacacagacatgggttctcttctcataaagggtatgataaagtgaggttgaccatatcctaatattgaaatttggataataaaagggcaggtacctaaatattggacctgatttctgccaacgaataaactactaatgtacttaatttcctcttttctggagtgaaactaatgcctattcagctggagttgctgtagaattaacatggagattattactagcaatgtagctagaacttgtggcaatttacattaagaatgacctcatggaacaaagaaaaaagttcagttttaagagtaatttatttattccctattcactgatgaggtttatttttaaatgaaactactctaccttttaggatctcactatagatatcatagtaaagcttgatcatgagactttgggcagctcctgttgaagccagtaaggaaattggaatgagtcacgtgttatagaaaccagttcatctgatttttgccttatttccatttgacggtactttctgaattaatattttattgttctgaagagcttcataaaaaccatatgtgttatttcctgattcttaagaaagggctttagaagttgttctagtccctcaagataacttagaaaatatggccttattttagcaagttttaggccattgagtggcatatgcaactggtttctgaaatgggctcaacccatggcaacacttgggaaatagctttattcttctctcactattgctctcaaatcacgtcacatcaaagaatattgaaatggtgtccagaatattaaatagaaaagtagttaaccgtaagaaaatatcagtttcctcttcagtcatcccttgcttttaaatgagtagtaaggctgggttggaaattcagacagtgtaggatgctactgcatttgatatgccccaagaatgattctctgactggcaaaatagtgttttcagtagagcatgtggcggtgcatttgaagccttaagagtaataaagtctcaggacagtcctctccttgggctctgggactcctgataccttcacaaaatgttttttatttttcttctcaggggaagcagatggaatgaacaacttctgtctattatctgctatttttaggcaaggtaaaccatcatctgtgtgccccctttagagaagttgagctaatttagcaaaaacaaacaacaaacaaaaacagtacaacaaatgtcctgttaaaagtctgttttcattagaaattatattcacttgtttctgtttgttttagaaaagaggtaaatgctgaaagagggtgcgatttggtgttgccattgagccacaatttctgtcccagggaaataattatcctctttggaattgtcagtcagttgctcccacagagcttggctatgggctgtgagcaaaacccagctataccagcttgaagcctagaaattttggatacattgaagaatccaatcttctgcaaagggtcggaagcagtgtgggtaatagttaaatattgtattggatagggacattaaaacgtttggctgttctctctctttttatctgaaacttccagaatcaaaaggtctagccaagaaaggaaatcattcctaattttggcaggttctgtaataggaagaaagaatcaagtctagctagccaaatctagcctaataaccaatgggacaacttccaaatgtggaagtcagtgcctacctaccattgttctccaggacaatataaaatagttcaataagccatttagcttaggtgttagaaaaacgcagcatccttagtatagttggtacctgaaaaacatttgctatttcaaggcttgatagagatactggcatatgccttcctcaatctcaatgtaatatatagtacctcatggcctatcaaagagaaaaatctccagagtaaagggagcacttgtgtaatagggtattcttctccatataggacagagataggtcagttatggtacttttgcaaagtgaacctgaaattacaagctaaattctgacttatatctaatgataggaaacaattcgcatttagatttcctttctggtatgttgtccttttgtcagctctttactgacataaaacctcattgcagacatgctagaggttcattttttgcctagcttagcaaaaatatgtaaaaagactattctctcctatttgttttatatttcctttcagaataaactgcatctgcccaaacaaattcaagttgtaaaaagcagaaaatcaagaagctatacctaatcattgaaatcagcttctagaattataaatatggaaactgcttgttgttatcaaacaagaaatggtcatgaccatttacaacagccgctgctctacaactctgatttaccagtcactaaaacccctgtttataagtgtcacatttatatgcgcagaattgaacttctcattccagtttatactgccagtgagttttggaaatgggaatcatgaattttttgagaggttttttatttatttagcatggtatgttacagagtaaatggtaaatagatggaaataaaatgtagttttactttaagttagccatttaggtgatcaaaacatcaattcaattgagtttggcatattgttctaatgtgattattattaacaaaatttagagtcttggatttttacactagttgtaaagtgtttagtgagtcctcgtgttctcaggaggctgttttactggaaactaacccgccattactggaagtagaagaccaactcttaattcattatctcaacaaatcataacaaggatgaaaataactctaccatatgttttgagaataccttatggtttaattatacctattatttcatgtataagagatacatgagatccttagatgaaatcagtgatataagtaagacagatattttggaggaggaaaatgaagtctaaagagtaagtggctagtccagagctgaagaactaattaggggtagggccagagaaaggacagaaaccccatctttctagttctactcattgcactcttatagggtgctgacattctttaaaggatcttcttgagagaggtgatggtggtggatattctagctgtagtataagctaatctcacagccacaaacctctggattcagaattctagcaccaaggaatattactgagagaaggagaagaggcagcgttgagggtagctgaatgagagagacgggtcttgtatctaggaactttgagactagggtcctggcagagggtctccttcaggaacctatgtaaatacagccagaaagtctggttgtatacctacctgcccctttgcccctttcctctagcgtctttttctctgtggattcataatgtaattcaattgaaacctttctttctggagggctgcagcagcagcctctcttaaagatttctgagccataataggttgttccatgcattttgatgcttgattagaatcttagaatgtgggaactgcagtttacagacaatctagctaggtccttgtttgaaaatgaatgcagtgagaagactgctgtgttgatatgaaagctgataaatagtaaacctggaaccagaacccctaattcagatctctttccactgcatgattgctcttttgtttcatttcgataaggcagtcagcacaccaagagtttaagctttttaaagccaaggacttcttagaacctcccccccttaatgcctaccccatgctgaatatgttccagggtaacaaaagtgtacattgaattgactttggagcaaaagaatctgttagctgtgctgactatggctccctctgattaagtagggggatgtttgtttcaatgtgagaaattccttttctgggctctgctatgaatatgctatgccagtggtggctgtgggtggtgggtacaaagtcaagatactaagccacaggactgcattctgacccagaatagttagttggtcattatgatagcattcacctgagctctcctgacttgcttgggttattggatatgtaaaacatacattgataaaggaacctctttaagaggcaaggcacttgtgcgtgttttatttcaagtatattccaaggagcttgtttagtcctataaataatcattgatcctcagtgcctcacagcatgtattatttccattttgcagatgaatcaagaaagtcagacttgttaggttttccacctaaggcaaatgtgttaatattgtgtaaatagaagctctgaaagacaatgggataggaggcctttttctgcacctttacctttgccagacatatgtacaaggaacatcccatgacttaaagatagaaaaccctaacctgtattactttaatacaccaacgtcaacaaaggcccagaatcaaagctgggctgtgttatcttttctaaccagaagctctctcaagaaagtacagctggaaaagcaaagtaatttccagttgtgtctttgaagttgtctggtgtgatatgatggatgtttaatacatgctgtggatatttttaaaatagggagcaatcataaaatcataacatagagcaacttttgaacaacaacatttaaggtctaaaaaaaaaccctacatagcattttttttcttcctttactttatagctgtgtctgtagtctgatgctgatgaattttctttttaaactagagatttagactcattggtagtgaaactgttacatattatgtgatttttataccatgaaaaatttctcgatttcatgagatctttcatttccctatgtgtgtgtgtgtgtgtgtgtgcgtgcgtgtgcgtgcgcgcgcatgcacgtaaatgcgtgttagtggttaacatgtctataagaaaagctatttgcctctctccctctggtagctggtcgaacgaaacttgtcactaatggctacttttaagcagtgactatatgaatttattgttctatttttggtcaggcagttgctatgtggtttagtggctttgtttagtattagggctcctagatgagcaatacagcaagagaagagtgtctggcacatagtgtgtagtaggtacccagtaaatgtgtattgaatgaattaattaaatagagaatgaatgactccagatcataccacaaagcctggactaaaccagttagtgaacaattttagaatgttagaggtaagtgacattagaagtcacttaatctactttcctgttgggagatatcaaatgaattagatctatttgctctagaaaatattttaaaggagagatttagagtattggaaaggataccagatttatagttcgatgatctggcttccatagacagctaaactcttgcttttttgtatgaccttggatacgttccttagtttttcgcttctaaagtatggataaaatgagataatggatgtaaaattgtggggtggggttcaagtatttaatctgcctagcacccttcttcacttctagcaacagactgcacacccatcctgaccacagggcatatggcctggtacctcacctcatctgaacacagtgattggctcaggaggtggtcacatgattgaaacagggccaactagagtcttcctgtgggatttttcaatgccatcctgacaggcgtttttctctagtatggtattgctgtaaggatcagcgtttggagctactggtagccaattgctaccttccgactccctctattggagagaatatgatagcatacaaagagtatcagtgctatgtttgaatatttatgtactcaccacagtttgtgttgaaacttaatccccagtgaacagtattatgaggtagggcctttaggagatgattaagtcaccagggcagagccctcaagaatgggactagtgaccttataagagggctggagggaactagctaggtccttttgtccctctttctctcctaccatgcgaggacacctagatggtgccatctatgagaacaggccttcgccggagactgaacctgcgaatacctcgatgttgggcctcccagtttccagaactatgagataataaatttgatttataaaatgctcactctgtcgtatattgttatagcagcacaaatcgatgaagacaagcagatctaaggcagagatgcaaggcagatggggtctaagtttctgatttagttttctttgaggcaaacctaactcctatgtttacagcagttttttgttttgttttgctttgcttaaggtagcttgtcaggtttctatgatttgctgactgaaagagtttcaactcatctagtaaccagtgaattgaaaaaaacaagattcaaggggtctaaccagaaagcatttttattttcctattttccaattagagtgtattcagtagaggaagctcctccctaccccaaaatgaaaacttgggtggtcctatgatttttctcttaattttaagtaatatactttattacaatgacttttagttggaaattatcagagtagaatggccaattccatgaggtactcaaaacttcaaagttgatatgagttaaatcttctcccagtttcccttccccagttaagacctttgacagttagaaactctgtcttccttaagtttccacttgctagttgctgatcctgcagggtctaagctggaaaaggaaggaaaagagggagaggaaaagagagggggcaggaaagtgcttacttggctgatagtgacacatggcttcatgcttcagtgtctagttaagtgtttaaagctgactcttcctgctggtcactgtgagtttctgccatgcctaccctcttcattttatttacttgtagtgtagtcagtgcattttccccatatcctggttttcagcaatctgttccataaatgctccattgtgaggtcctttcactgctccaggcagtcctctggcaggatcgaagtggcttcaggccagctctctcccccttgtggctcgcatctgtccacagggagcactcatgatcctggacagacaagcactgggagtgcaggccagtctagcacagtccccaccaccttcccacctctccttcagcttctgctcttccagcttttccaggcaggagtcacacacatatcccctccaaactgtaggggcacatgccaggcttcctgaacagcccttttgaggcccctctctcctgacttgcccacgtcaccatcactcatccctctgtgttacatgtgagaagggggacactgtgctcccaagaaaccttcctcagaaactctcccttgatttccatacttttgactctttcattttgaatgtgggttagggctttttagaaccacaaaacaggtcgcaaagtgtttcttttacaaatgtacacgtgggcctggaacttcagagtggaatttcatgaacatgtcttggtatctgtgttgaaatttctaatttagcagtcccttaaaaaaaaaaaagtgttttgtaaactgtgaagtgctacacaaatgtggggaattaactccctttgccctgaagacatacaaggactgaatgaaacaaaagagagaataaaatgtggttgtacttcttgaagaagaaaacacttgcaagagatttatgggggctagcctgagtgacttgtttctgtatctcgttagttcatactttattacttagttgaggtagtattgttcataatacacagcttccaatttgtactgcttgtaaccgaattccggtttagctgctccccacctgaaaaaccaaatacatgagaggtgagatatggtgcaaggaaggcagttttattcaaatgccaacagaagacatgaccaggctgaagcctcaaaggaaccatctcaaaattttaggcggagtgaaggagtttaagagggaagcttcgtatgggaaacacgcaggagtggtgcatgctgtgggtctgcatgtcactttctgatggccgtcttcagttcttacacgcctggagtgagagctggtgccattttggttgcggctgggttgtagattcactgccttgaggtacctctaactgggggagaattccatacctaagtcttcatgcctggttcatttcaagattaccccttgaatttctaagcaagcatatggttagataagtgcagagtgccagggagtgggaaagagagggaaacagtgaattttaaggtacattttaaggctgtagtttaagacaggggacaaaaaaagttttaaaatgcatttctaagctgagaggttcagttacatgctcttctaactaaatgtataaatgacactaattaagacagtaggggacaaacatttgaaataaaaaatatgagttgctcaggcagccagtatttctctgctttttggtttaggcagcctgaagtttgtacagacacataccatgtccacatactcagtgtaggtttttgtggttatggtattttgcctgtgtgcacaagctgattgaccatcctgtaccacaccagaaaagtactttctccactcaaaggttggagaaattgctagagaacaggagagatcaaatgggaagctgcacccatcacctggaatccacacgtcctcatttatccatttagttcattcagcaattatttactgaacacctactatttttccaaggcactatgctagccagtagggctatagtggtgaaatagagtttgctatctaatgggggaaacaagacatcacacattgtcatgcccaattataaattgtgctaagtggcaagaagaaaaagaaaaagatgggagaagagcagggatctcctaacttagtttggtatgtgtggggaaggcattcttggcagaggatacataaagggtgggtctcactatttgtccttgttttcagttcacatatgttcctaattaaaattaaataccattagtcagtatctaaatatccttaggttaggatgtagtattttccagggttttgatgcaaacctattcttccaaaatgttttcttcttcagatggtgctttatacttttcttaagtagagctaagaatttgttttaaaaaggctactttgagaaacatcactgtttattggaatataaatttgtgtataatactttctctaagtagtcaattctgccttctcagagacttttttaatgccaaacttgaagagctcttgcagaggagtcattcttttgtttttttgctctttctcattctttatggtcagttcttccactaatttattttatttcaaagcagggatccaagggaaggaggagtgaggaaaacctttttagctatgtatgttttctcaaaaaaaaatttacctaaggttttcttcaagaaagcaataaagtgaatatggttttgagcatgttatgaacacagagcaatttgacttgactgaaataggatggattgagaaaagcctgtatttccactgtgatataatatctgcttaaagtatgggctacagggaatgcttggcacctcttcaagctatcagaagttttattttgatacaaattatttcccaaatgctgcatgacataggagacatagtgctggacagtgcattaagaaactttgtttctgacttctattttgtcacctatagtcttatttgggtaagttgtttagttgctgtatgcctcagttgccttagctacaagctgagggtggtgataatacctgcctcactgcttctcagaattgttggggaaatacatgaagtaatcttataggatgaagactcctttaaatgatcaaaatcttcacatttgataaatgattattattgccatttgtctgtttttgggtatgatattcatggctgatcttagtctatcaaatcattttccccaagttcatttatccttagaccaagattcatggcatcttacctgtgtgtctagctgggtaaatgttttatgacatggctgccactaatacagatattccaggaggtcatgtatattagaaaaacgtgtcttttgaaatagaactgaatttgaatttcagcctcatcattcactgctaaacgacctggggaatttaatctttttgtgcttcagttttctcattgggaaatggctgtgataattaaatgataaacactgtgaaaatgcttaacacactgccaggtgttatggtaggcttttaatatgtgctagttctctttccctttaaaacaagcagaatggaatccagtatttgcaacacaggttattttctttataagagatccatgaagggagtatgattaacacaaattcagtttctatttacattttgctgtagttgagaaagtgaggcacatctgtacttgttttctgataaaatcataatttcttagataaaattgccttgtattatatgccattttttttagagaactgagtattagctgtttgttgatagaaatggcacagaaagcaatttgttgtttttattttattataatttgaaatgctatattttgagtgaattttttttttgttatttacgtaggacttatatctacctatttctagaaaagtttttgaactgttcacaaaattaagcccaatagaaaacaaggcaattaaaaatgaaattgaaacaaaaatagggtaagcataaaggtatcttcagacacctgatgataagtggtataaaatggaaggacaagagctcttcttgtttgttgcatttcttgttgttcattatcatttttcattatccctgtttgagcatcccccacctccctctcttccttgcctcctcattatttggaggaatgggagacatgggagctagggaagttggtgggtaataagccacagctgaccaagaatttgcagcatgcaaatagaaagcatacattctttttgttgccttgacttttttttttttaattcacagcttcaaatattgcatctgcaaatatattgtctcttgcctggggtataacctttcttcctgtctttatttgaaatgtttctgagccaggaatgatggaatgaatgactcaatctgattacataaaaaaagattttgatacatagctttgtatttgtgaatttaaaatgactgaatttatctttaataaaagtgcctcctgagaaatgtgtttaatggaggtttatgctgttatggatatttcaacctaatagtgtaattaccatatgtcattaatcctatttctacagggaatttgtccccttgtttcttttaaagctagagggtaacaagagcaaatgtttttaactttagcacattattcattttagatgtaagttgacaagttgaagatatgaaaataagaaatctggatgatcaattttttaaaaagtggcaaccattaagctgtgttcaaaaagaatgcctcatggcatccccctcctgtgctgatattagtgtaaaacacttatttttagcttttgattttctgtgctccccaccccaaatacttttttggtaggcctcctgctgtgaccaaagtcaaataagtggaaatgagggaaggttaacatttaagtgataaatttaagagaagattacacattcagtgtttgcttgctcagtcttctgagagaaagaggtggtgtgatctgttgtttttttctcttcccttctttccattattcccatccaacattatgttataatgaaagtaatatatgttcattgtagaaatccttaaaaatacagaaaacttagagaaggaaaaaaatgtctcatgtaattccttcactccaaaagaacaactattgctagaggttctgtaatgatatacatcattattttatgcatatatggattcaggctgtaggacagcttggtgaactttttttttccagttaccaatatactataaatattttacatcattggccgggtgcagtggctcacacctgtaatcccagcactttgggaggccgaagtgggtggatcacttgagcctaggagtttgagacacgcctgggcaatgtggtgaaaccctgtctccacaaaaagtacaaaaatttgctggatatggtggtgcatgcctgtagtcccagctgcttgggaggctgaggcaggaggaccacttgagtccaggggggttgcagtgagctgagattgtgccatcacactccagcctgggcaacaacagagtgacactctgtctcaaaaaaaaaagatcacatcattaaatcatgttttaatggctgtatgatgttttctctacaatataaatgtatctagatatggacaaaacatagttacatgaaaacaaaagcctttaagccccaaaccctgaaggtaagtcacaaatcatataaccctggcatgagtgaagacctgtgtgttactcagcagtggctgagctgcttgggaccatccagagagcttgtagaaccaaatatgtagtcgtcagggactgctcaacttcttttgattataaataataactcctgttaactttatattggcaattgtttaattctgtcaccctgaagatgtagtttcgattctgatctgttgctcttatctccaccctaacttaatcttctttaaagaatggtataatttacaacagtcagggtaacctttctggaggtaaggaggctaggagagtgactgggtgcgtacatctgtatgtgtatataaatgcccccttcttgtttggtttagcatagttaaaaaagtagtgatccatcagatagagtttgctgggccagaaatactgcagtgcagcagagaccttggaaaaagtgagatagcatatgcttaagcaatactgcactagtgttgcataaatggtggaggctgcggctcccctgtttgtttttcccagcagacttgtcctgaggcgaagctgtgctacctgaaaggagaagcttcagtgatggagtcctaattgtaccaaatcaaagttcattgagtcagctaggtcattaactcgttgatatttaattactagctgcttcactgctggaaaatgtcattaagccgttgtactaaatctgctttaaagaatgcattttcctttttgaatggttcatgttttgtagtcttgtagaaaaatcagaaaaacatctgaacaatccagtaaagctggcaatcccagctgctgtgtcctcagccaccattggtctctcaggcctgcatctgattgtgggcaggccctgcagaagaaacacatctggagattcggcaataaactaagacttacctgggtcaagggtgtggaagagctttgaagtgggtcgttgttctagatgttttatctgtttgggtctctcccacctcttctgttaacaattataagggttatgtgggggaacttggagagaattttttttttccccaggctggagtgcagtggcacaatctcgactcactgcaacctccgccttccaggttcaagcgattctcctgcctcagcctcctgagtagctgggattacaggtgcccaccaccacgcccggctaatattttttgtatttttagtggagatggggtttcactatgttagccaggctggtctcaaactcctaacctcgtgatccacccacctcggcctcccaaagtgctgggattacaggcatgagccactgtgcctggccaggagactttttaatcaaatttcttgacattattttaatggtctgagattcattcaaccctaggtagcaatctaatgttgtgaagaatgtatgcaacagcttctctaaaacagctgtaagtgcataaagtttctcggatgtttagtattcccaagggtgtattttgaaatatggtttcagaatcaacaaaattgtttcttaatgtactgttttgcttgtgtaattatgccagttagttaatggcagaaacattataatggaaaacaaccttaaatatgaagtatttaaaacagttgtgagattttgtttcccaaatggacttaataaatcctacctgatattatatttcctttttaggagagtttaatccatttgtcgtcattataattatcttattgatcctgaccttttaaattactttcttatggtttatcatgtcacacaggtggagcctcatatgtattgatagttatacagtgtttgatataataattctaaaagtagaatgaatttcacttgaaaaaaccaatctagtgtgaattttgttcaggctgagcgggtttctttcccctcttaattttagtttaattgagagaatacatctgtggttcttagcttagtgcctggcctatagtaaatgctcaataaccgtcagcacttgtgaacatttttattatattcactaaaatatttcagttcatttgttttttacctctagtagaagctggtatgcttttgtttgaaataatgaaatctctcagtatttatatttacatagtcttacacaattaaaagaaaagtaaactctatgaatatattctaataaaatacgtttcccaggagctggttaaataatttaaattcatttaatagtcatctcagaattataacttttctcatttatcatccattttatttaatgatgaaagaatacaaaaccatgtaagaggccaggcgtggtggctcacgcctgtaatcccagcactttgggaggctgaggtgggtggatcacaaggtcaggagatcaagaccatcctggctaacagggtgaaaccccgtctctactaaaaatacaaaaaattagccagacgtggtggtgggcgcctgtagtcccagctacttgggaggctaaggcaggagaatggcatgaacccaggaggctgagcttgcagtgagccgagatcgcgccactgcactccagcctgggtgacagagcaagtctccgtctcaaaaaaaaacaaaaaacaaaaaacaaacaaacaaaacatgtaagagaaatctttgacccaattggaataaaatggctattgtctgcttaaagcatttcaatgctttgtactattttttgaagtccatatagtcaaggtcccaaatgttttatgccctcaaagcacaatgaatttacatgaagagtcactaaatggtaggaactgttgtgtctcaagttcaggatactttctaagtgtatgtgttttaatatttttattattgttcaacattactttttgcaggtatgatctacataaaattaagagagtgtggtttaagtttgttgatacttaaatttattttaaaagactgacctcaagagtgcttgtcctgaaatgttaagtgattttaaattcttgataggaagtccatacaagtatttttcctgcttcatccttatatcattacttcttattatcaccacactcttataatgttgaaaatcagtcacatttggtctcatttttgctgccttagttaaggctcagcaagagaattgctattatttaataaatagatttgttcattgtccctaatgtgacagcaggaatttgaagccatctgatttcttagctggttctgttaattcaataatggcgtcctactaccaactgatggctgctaagtcaccaaagctaaggtagaggtgttggagaaacttccgtttcaatgatacatgaaaatatgagcatatttgtaaccttctggataatcaatatgcttctatcctttaggtttatggagtttaaccttgcgagattaccacttaatatgatagctgcaaaatagattgtcatattaggagcctgtgaactattatctttactctgctattagtctatcaatattatggttaattctcaggatttccagattatataggctttgcagattctttgtagcctgccttaaattactcattaacacctccgaagtagggtagtttggtagagggaaataaataactaaaatttatggaataaaatttaagacataaagtgattttgaagatcttctaatccaatccctttagcccactcccctgttttacaggtaaggggactgacagccagtgaggttaagtaatgtgtacaagagcacacagtcacagaactggctgattgctgtgtgactgggaacccagatttcctagtcttgttcaggactccttccagaagttggaataacagaactttattgccctgcattttactatggaacagaatgaactgtgcaaaaacagcatgccttacccacttctaaagacttttgaaacaggtgagttgtggggcgcaactgttattagagcagctccaaggcaagaacccaaggacagagcaatgacagggctctgaaaaataggtatagaaatagcacatatgtttgagagtcataatgaggaataaataagataatgcatttatgcacttagcgtagtgttcaacatatagagagttttcaataaatattagctattgctatttatcatagaattaaaattcttaagtatccttatagagttccagcctgctgttagttctgatcttccgccatttcctttcccttcccctccaaacacacgtacatactcttccctccagctctataactctgcagctctgtagcccaattctaaaccccaaatatccatgtttttcatgcctttatgtctttatatagaatgtactctccacctggattgctacccagcccattattctgctccgcaactccttacatccctcaaaatttggctcacatatccctttggacatggtatgatatggtttggctgtgtccccacccaaatctcaacttgagttgtatctcccagaattcccacgtgttgcggaagggtcccagggagaggtaattgaatcatggggccctgtctttctcatgctattctcatgatagagaataagtcacatgagatctgatgggtttattaagggtttccgcttttactttttcctcatttttctcttgccaccagcatgtaagaagtgcctttcatctcctgccatgattctgaggcctccccagccatgtggaactggaaatccaattaaacctctttttcttcccagtctcaggtatgtttttatcagcagcatgaaaatggactaatacagtaaattggtatcagtaaagtggggtgttgctgaaaaggtacctgaaaatgtggaagtgactttggaaccgagtaacaggcacaggttggaacagtttggagggctcagaagaagacaggaaaatgtgggaaagcctggaacctcctagagacttgttgaatggctttgacaaaaatgctgacaatgatatgaacaataaggtccaagatgaggtggtctcagatggagacgaggaacttgctgggaactggagcaaaggtgatttttattatgttttagcaaagagactggtggcattttgcctccgccctagagatttgtggaactttgaactggagaaagatgatttagggtatctggcagaagaaatttctaagcaggaaagcattcaagaggtgacttgggtactgttaaaggcattcagttttataagggaagcagagcacaagcatttggaaaatttggagcctgactatgcaatagaaaagaaaaacccattttctggtgagaaattcaagccagctgcagaaatttgcataagtagcaaggagcctaatgttcatccccaagaccatggggaaaatgtctctagaccatgtcagagacctcatggcagcccctcccatcacaggcctggaggcccgggaggaaaaagtggttttgtgggctgggcgcagggtccctgtgctgtgtgcagcctagggacttggtgccttgtgtcccagccactccagccttggctgaaaggggccaatgtacagctcgggctgtggcttcggagggtggaagccccaagccttggcagctttcatgttgtattgagcctaggggtgcgcagaagccaagaattgaggtttgggaacctctgcctagatttcagaagatgtatgaaactgcctggatgcccaggcaaaagtttgctgcaggcgtggggccctcatggagaacctctgctagggcagtgtggaagggaaatgtggcattagagctcccacacagagttcctactgggaccctgcctagtggagctgtgagaagagggctgccatcctccagatcccagaatggtagatccacccacagcttgaactgtgggcctggaaaagctgcagacactcaacaccagctcatgacagcagccaggagggaggctataccctttaaaaccacaggggtggagctgcctaagaccatgggaacccacctcttgcatcagcgtgacctggatgtgagacctggagtcaaagatcgttttggagctttaaaatttgactgccctgctgaatttgggacttgcatggactctgtaacccctttgttttggccaatttctcccatttggaatgactgtatttacccaatacctgtacccacattgtatctaggaagtaaatagcttgcttttgattttacaggctcataggcagaagggacttgcctcgtctcaggtgagactttggactgtggacttttgggttaatgctgaaatgagttaagactttggaggactgttgggaaggcatgtttggttttgaaatgtgaggacatgagatttagaggggacaggggcagaatgacatgcttggctgtgtccctacccaaatctcaacttgaattgtatctcccagaattcccatgtgttgtgagagggaccccgcagaggtaattgaatcatgggggccagtgtttctcatggtattctcatgatagtgaataagtctcacgagacctgatgggtttatcaggggtttctgcttttgcttcttcctcattttttctcttgccactgccatgtaagaagtgcctttcccctcccgcgatgattctgaggtctcctcagccatgtggaactcttaagtccaattaagactctttttcttcccagtctcgggtatgtttttatcagcagcatgaaaatgaactaatacatggtgtttctgaggcttctcaattagagaatttgttgtattattttgtagttatttatttacaagtcatctgcttccttaagtgataagctctttgaggtcaagtactgtttcttttagctctatgtgtttattagcaaatgcttggagtacgataaacatttgataaatgttaaaagaatgaatacttgaatgaattattaggcttactttgtaactcagttcagccagccctctgcttttcatagctgtgaattttgacagttgctcatgtagtagacaagaggacaaccacgcttactactttattcattttccctttcgagtgtcatagatgttaaacatttcacttgattcatgggtgccatctggtggaggaaaggctaactacagatgcatgcttcaccaaaacatgtagaagtttaagattattactgctcattaatatggaagttgtcactgtttcctggtagtttccagaagtgtagtcaggaaaaactccttggcgactgcttttttcattcctgtacattggtttcttatttttattttgtagagatgggagtcttgctatattgcctaggctggtttcaaactccctgactcaagcaatcctcccaccttggcctcccaaagtgctgaaattacggatgtgagccatcacacccagccttaattttaggaagttgttcattcatgaataatgtttgaaaatattttttaaaaagatacgtgttattaaatattgtttacttgtcagtgtggcaatttatgtgatttaaggtaaactgattatttaaagtttgagatactgaatttttaaatttttccatgacactgagttttttattcattcattctccaagcatttattgagcatctacctaatgcctgacattgtaaaaagtgctaaagaaccagaaatgaaagacagtatgagtcttggtccaaagaatagttaggtaagaatgtaaaccatgtaacttttcataagacaaatcatacaaacttcatttagattttcataagaattccttatgtgcatggacccctccatgtgcatataaacatcatagatataaagctaccagttttagacttgccattttgatggattttcttcgagtatataaatctaaagggaaattctttatgatttttcataaaaagtagatatttattcaatattcacatttctgtactgcttacactctacctatctgaaggatagactttttttttttaagctacctggaacattgtaatgaagcaggaagtaaacaaaaaggaactgaggagtaaaaaacaatcacaaaactcatgtacctttctccagtaagaaggttaaacattttccaagtcttaaggctagataattgtgcataaagcagcctcttagaaacaggattatctgccaatggaggagaaccaagagcttctcacagcgatcagggtaatgtgctgtggaaaccaaactcatatgcaggagacatgcatgccacaaccctccctttgtgttcccaaggtagccctaaatcatcaagaaaatgctggattttcttctgtgcattctttttgaaaaactttgagaagtatgttttttcattttgaagcattttcatcaaaagaggttaaaataatttttcatcagttggagtattaaagttgagttaaatgggacattcacttacgtggaactcttcattccctgatggcactcattaaatgaggtattgtggaatttagctatcatttacagaagttgtatttgaaagattatacaagatacacacatagaaatccaaacttaattttctttttaattgaagaactggaaaggattctgagaatttacctagttcttaggaaggataccattaaaatattgtattaaaatgtgttatatgtaaaattttgttttgtactgctcttgaaggaaagatttcaaacagaattggcatttcatttaattgatagtagaaattcagtgcaaaaatggccagccacctgtcttctgaagttctattaatcttcactatttaattgcctgaatgtggacatagatttgtgttagaaaagaaagcttggtttgttgtgtgtgtctcataagtcatgttgacttatttagtgacttctttattctagggcacttgtatcaacacaatgtgttttgaagaagaatcacaggtactaccttggggaatataaggaaattaataattgggtatattgtagatggcaaagtttataatttttctcatctctttccataatgctttatgacatctggaacttgcttgttgcaaccataaatcttcacgtggatcatccttgtttatggactatttgggtataggacataaagataggacactgttccacagcagatttttttttcttgctgtttgagagacaccagccttcactaagcagttcattattttctaaggttggagcagctgtggatcaccataattatggatttagtatgtccctgccaacctactgtgaatcttaattcaaattttacatgtctctttggggccttgttaattttctcattattatgtggttcctgacaaatgacagttttgagaatctaaagttgcttaagttagttttttatgaggtattgccaattgctcattgtttttataatgcttaatcacatttttatttttaatcttacattaaataaagcagctgccctttataatgtctgggtgtatttttacccatccattttctctgaggactgctaaaagactacaatttctaagactctctaactttttaggttatatggtcaagcagaaagaaagaaaacgcctaagaaaaatatctggagtgttagaatttttaaatcagagctatttcaaggtgaggacgatgatgtgcagcttatttttgtacacctcaaatttaacacagtgccccatacatgaaggcacataataaatgcaagctaaaaaattaattttatatataatatatatgttatatataacatgttatatattatataatatatatgttatatataacatgttatatattatattatatatgttatatataacatatataacatatatatgttatatataacatatatatgttatatataacatatattatatataatgttatatataacatatatattatatataactgatgttacatatataatatatagtggagatatatatattatatataactatatataactatataacatatattatatataactatatataacatatatataactatatataacatatatattatatataactatatataacatatatattatatataactatatataacatgttatatataactatatataacatgttatatataacatatatgttatctatctatctatctatctatctatctatctatctatctccactgattttgttttagtttggccatccatctgtaacagtgtttggcacacattttctgtaaagagccatgtggtaactatcttaggctttgcataccatccagtccctgtctcagctgctcaactctaccattatagtgcaaaagcagccataggcaatatataaacaaatgggcacagctatgttccagcaaaactttataaagacggatgtttgggcttcagtttgccatcctgaatttagaccaaggctcataaagaggtctcatctcatgtgctaactttgattgattggtggctgccttggaatactgtattgagaaggaatctcagggtcaatctaggttcagtggtaaataattcattagttaatggctgccataggcattgttttgatctgtcctataatttattttgaggacactgtgacttgtgcagatggttgcctttatttctttgcattgggtgccaagaaactcagagttactttttaatcatctgtaacaaatatagttgacccttgaacaacctgggtttgaactgcacaggtccacgtacacacagattttcttctgcctctgtcaatcctaagacagcaagaccaactcctcctttttctcctcctcctcagcctactcaacatgaagataacgaggatgagacctttatgatgatccacttacacttaataaatagtaaatatgttttccttatgattttcttaataacattttcttctctctggcttactttgttgtaagaatacaatagataatacatataccatacaaaatatgtattaatcaactatttatgttattggtaaggctgtcattcaacaataggttattagtagttacattttgggggaatcaaaagttatttgtgggtttttgactgtgttggagttaagggtcaactgtatgtatgtaaccccatgttgtttaagggtcaactgtaaaaggaatagtaaagcacatattttgcatctaactttatccctagcttcatctcaattttaccatcttacttttcttagcccagagttcctaaaacttgcctacataaaatatttatgaaaccatagactttaccaaagagcaaaggcttactgggggtttgcaaggacacatctacaaaacattgataatcatacctaccttgcagggttggtgagaattaaatgaagtaattaatataaaataccaagcacagtacctggtacatagtaaatactgcatacatggtagctgttaaatgtatgccttcagagagctccgccaacccacatagaagggtaaatcacattacttctgatttctccagccctccttgcagataggtggaaaaacccctgaagatgtaaaaactctctcttgattacccagatttcatcttgtggaactgagtcctccctgtgggaaatactaggccactctatacatttgagtatttttttttcctactcctctgtttgtgggcaactttctgtgtggaataggaccacgtatccacacaggaaaataacaaggtgggatttggagtggggagaccattgggcttctttcctttgcctttgaaagtgccactttcttgtcatactgggcaatttccatgcaattcttaaaagttcattttaattttattccactgagttttggggcaagaattttacaaattgagatgaatgatttgaagttagttgatgcttatcaattgatgctattttagcccacagttcccttcataaaataatatcttttctgacttaaaaaatgactggtataagacacccagatattttacaattctacatgctatagcaaagaatcaaaatggtgtacattctacacttgagagaaatgtgaaaggagagttgccaacactaaagcagcagcatgagtaagaaagagaaagagtgaaaaatacacaaagtgttaactggcaagtcaggagctcattaggcctaaccttgttcttaactcagactcttcatcataaacccattttaatgaaaagaaattcggaaactaatttttccccacaacaaatagaaagttagtattggttttagctgggcaaatgtagtgatatttctcccttccttaatgttcctcagcagtcccaatggccggtatctagcacctcagagcaattttgaagccttttctcctgtaaaatacaacttctattcacccatggctctaatttatccacatttttgaaaattcatatcaataaaatatactgtttttcctgtctgtgttagcttcttcttgctccttatccctttgtctgtgaacctcctcatcattttttagatcttggctttacatcactctctcaggaaaccctcttctccccattcctccttcacccccaaccaggctatttaggttctttgttttatctcatcaaagaatcttgttcatttctatctccccactagaccataagcaccatgagagcagggacatgtctacttctgcccactccccaagaacagctaaaagagcacacccgtctatgtagcaaaatagtgggaagattcatgggtagtggtgacaagccctccaagcctggtgatagctggttgtccaagatagaatcttagttcaactttaaatttacctacagaaccacttaattcccctgtaaatttaactgttagtctaaagacggacagctctttagacactaggaaacaacctttatgtagagagtaaaaaatattatttccataattggcccaaaagcagccatcaattaagaaagcgttcaagctcaacacctaaccacccaaaattctaatcgcaccactgaactccttacatcacattggactaatctattactttatagaagcagtaatgttaatataaataaccatttatctctagcacctagcacagtgtccagcacatagtcgacatccaataaatattaattaaaaggatatacttctagcttatgactgtgactgcccgtccagctattttcttatggagttgaagtcagacttgggaaaaagatatatttttctctgtaaggttcatgaactgtatgcccatccaaattttaaaatatgtcattttctatttacacaagcaggtgcagtcactgctgaaactatagcttttccacacaattaggtatctcattttcctcttgctaaaataagataccctttcaaaccttgtttgcatagttatgcaacactgccggtgatgctgagttcctttcccttctgctatattttgctgcagctttccaggattcaaagtcccacttgcagtcctcggcaggaggggtcaggtcagtgttcttaccatgcctgggatggtcaagaggaaatcattgtgttttcacagtgctttgccacaggtcattttgtggcctgttttacgcagcttgctgagatttgcctgattgcccacaagctgttgggaaaggattccaggtgctcccttgcattagaagtacacaaggtcagttagtttgcttcaggaaagggctcagccttcttgaggctgagcagactagcaattttgtatgatttaaaaaagctgtggcactgagggttgaaaggccatgtaggaacgtcattgcatatagtcaaggttttcccaggaattaaaaatgtttacttgccaaactctgtcttgggggactcttcttgtggagggtcttgtacaaccctagatgtacatcagaatttgttacaaagctttgtaaaaatacacatgtctagaccttagaaaatcagaatctctagggggtagaatctggtgtttttcacctgttagtgagcctgttaaaatacggcaaacatttaaaaagtagattctagagtcctaccctaaaaaaagttgatttactaaatatggagcaggccccatgaatctgcgtttttaaagaaggcaatcccctctttccaccctaggtgacttagaagcagttggttggaataccagccatgaagaaacactgatgaagcccagtgaccgaattttgtagaaaaaaccgaagccctgtcctagtgcccttcccctgtatggagctaataaggcttcaccatgaccctgtttatgagctttatacctggattcctaaaataagacattagatactgtgtgtgtatttctgggaaaaggatttgttgctctcagagattttttagtcgggttgaaaataatacaaaaatatttgaaaatacatttttatcatgagatacaacaggctgtggctctgtccaaaccagcagtccttgcaagtgggttcctgtggtataaaataaggtgtgatgctcggcaagtataaaatagtctgacatttatatgatttatggcagaagagaggcaaatgtcagagtgataggaagaaacattgtgggcacggtcccttttatctttctttgtggtcatgtagagttctcactcataggacattaagcctggttttaaagcacccattccccatccttttctgccatcgtgcctacattggactaagtgtcagggagacccacatagatgaaaaagcttctgtcctacctgctagttgctcataaactagtgggaaggcaaataggtgactagatagagacactttgaagtggttgagagctgtaacggagatctgaacatagtacattgtggtgacaagtgggaaagcaattgctttaattctgagagactacttttgcaaccaaggtgatgattcctatttgtacagaagttttaaaactatatgtatgcagtagatgctactgaatttgttctttatttacccatatgtgagatacaacaaattaagtttgcttcgttaggttagcctcaaataagctttgatggcaggtctcgaagtgggagccagagagagaagagtaatttagaccttcaaggagcacagatctttgtgttttcctccacacaaagttaaatttcagagtagagaacatttgtctttctttatcttcactttcatactttacactccattcccaggagtctccttgggtgccttattgcttgtcaatccacctccttgtaggtaaaaatctgatcaacttgctcacactaagactgaatatttacttagcatactacccctccttaaaatatttaccttttggtaggtgaagagctggcattaaccgaagattgaagctataatgatagaatttcaggcgtcaaaaaagggaaaacgatttggggatggggatccttttggggttactcacatcacgctaaataaggcagttaccagctctcaggacagaaagaccaggccttctccataccccaactacacatacaaggagccttaatctaatacaggttttgaaggcacttcttaaagtcatgtcagatgggagacagaagcccaactggcattcgtctggagcttccctgccaccctggccacacctgcctcctggaggtccactctaaagagccttgtaggtagctgcagggcagaagccaaataaggcccagtaggagatctctggtgctactcctatataaatagtggttgccggccaaagaacagttttatctgaccatgttttggctaccttctaagcagctgctctactgtcatagcttcagagttctttttgattaataactcatgagtgttttagagttcacttctaccagttccactggcttcctgaattcccaagggcattttcagttagcattccacagggaactttctggaatacatttggatagcactaatggaagttaatatttctccaagctctatagcccaagattcagaaagggaagggaattttatcagtaattaaccataattttctctgatttatgaaacatagttctctctgtaaacaaatattacttttcatttttcttctatggatctcaagtgcatagaatgtgaaacatcttctttctgtaactgcagaaaagacaggaactcactcataacaaaatttagccagattgctttggctgagtgccgcttgttttctcaacagattgatgagaaagtccgacattaggctgtttttatgttgccatccctcaggggaacatagatgtgtatttgtgctttaaaacaaaaacatcatgaaactagtacaaactattccccctgaatcccttaacctatccctggaatatgtgtaatattgaggggcaaagaattcatcatcactgtggcagtagggaagtaaggtcaactttttgttagactgtaaagcagatacattttttaatcctttagagtttgagggtaggttttgatcgaaataataagataaggaaaatgggccacatagctgaacaatgtttgataatttggcaaaattatattttattgcaattacagggtaagatctagaaaagagaggtaagttattttttatgtacaaaaacatccatctgcaattagggaagccatcatacagaaagtgggatttgagtgatattttcacactctggcatgcttggtgctaccacatgaatatagtgtcagattgaatatgaattagatgactgataaagttatttgaggttcgtcacattaggaattccaaaggaattgtctgggataatctgtaacttagtagtccatcactttaatgcttaaatgggaactttagtcttcatattcagccgtttagatgatttcaagtctttcacacactgagtgttatgccctctgtggtagtcgctttaccacatgactagcatttgcacgtctgcagctttggctctccagagcaatcttaaatctctgtaataggtgtaagatttcatttttatgcttctggtttaagcctgggactttttcctgatgccatctctcttgaaggaatcacatttgccttcttgaggcagaattatgaattcaggagtgcaagacggtcatctcaaagacacttttcttatttgaataacctctccaggttagaagtgccaaagactaaaaatggcaagaaatgacactcttggcaggcatgagagaagaataactcccttgccttatgttctcttcctggtgggcaagggcactcactctgactttattttaaagtgcctggagccaaagagcagctgtcaaaagttaatgatatgttaccgtaagaaagatggattccaaggtgaaactaagtaaattaacgtgtggtctgtgtgctggctgctgccagatcagcaaacacacatccccttcttttcaagggcagggaaaccttgcctgcaataaaatattactcccttctctcttctttcttgctctggtgtgaatttcgaaggattcccatgataatctctcctgtatcttgtgaataccttgtgatcatccctcggtgaccatttccctaaattcagccctttttctactcagtatttgcagaattgattctcatcttacttcccttgtatgtcttcctcagtgccaaagtctcctcacaggagagggccactgatcagatgtccttaaagccagatctagcatcttatttaatgatttatcagtgttttaaaatttatcagtgttaaatttactgttgacatgagtgcaaagatcagcccttttgcttttgtccctttttttccagctttagaaggctgtgtccattcacagtcaacacacataactgaagcagaagccctgtgtgttttttaggcatatatgtggtgtaaacataaattgaaaggcagtaccatcaattatttgtcccattcagtttaatggagcttgagggtttctctctcttttcagattataattgtgtgtgttcatgtgtattaaataaaatggagggggaaaggtaatttataaaattgtgaaatttgaggggtattaaaattcttaaactttttatcttggcaaagcactctgtagaccatccataaggcaaaaatcccttttcttcttaagatgcatgtctgaggttttgaaatcttaaaatctcaactcttggtttttcagttacttggaaattgggtctctatatcaggaccaacatttacaacatacttcattacaaagttaatgataaatccatttcttggtttaaaaaatatcttctaaataagaatttattgagtatagaggcactttctttttgattatcattacctaaaacttcataaaattgcttactattcactaagtcttagaattggtaataaaatagattatttgttaaaaagtgaaggaacaaaaatgaaaaactcacacaaccatgacatatgaattattaagtaaaaattattatgtgatgaggcatattttcatagttaaggacatcagaagcctgtttttattttaagtccactaaaggtcaaaatgagtaacgtaacaaaatgagtaaaggaaattgaccttgacactttttttcccagagaaatatactaaaagtgatttgaaacataggtctagtttacttgtgatctttttctaatggcggttctattagaatttaattacatcacttattatctcttcttgaagagaagcttttttggctccctggaaacttgcaaataagtttaataccttttcctcacagagattttggaggggtcatcgtgatggtggtggatattccctaaaatatggagagatgaatagttttcaggcttactgttaaattttcaagagtaaatttaatatgttgtgtaactttattcagttttcccattgcttttaacagctttgccctcagctttagcttccaattacgcagcattgaaggcatgtttttctttcccatctgttgggaagctttgctcatgtgttcttttgttctattctgggttttatgccagcctggggctgctttaccttgtaaagaagtgaccacagtacgcattgccatctttgtaaaaaattaatttttttttctaatttaaaagcaatttgtgtttcctgctcccatactcactgtataaccgaggataagtttcttaacctctctgagtctgtttcttcatctgtaaaaatctgttagggttgttgtaaggattacatacgctaacacatttaaagcattcagcacagtgctggcacatagaaatattgttttattttatagaatttggaaaactttagagagaaaaaataaaaatcaccccaatttatattactctgacataactaatgatatacattaatttaattcacccttttttttttcctcacacatgaggtatacaaactactttgtaatctccttgtttttgaaaatgtctcaccctgtcactcaggctggagtgcaatggcggcatctcagctcactgcaacctccacctcccggggctcaagcagtccacccacctcagcctcctgagtagctgggaccacaggtgcgtgccatcacgcctggctgtttttttgtatttttagtagagacagggtcttgccatgttgcccaggctggtcttgatctcctcagctcaaatgatccgcccacctcagcctcccaaaatcctaggattacgggagtgagccactgtgtccggacttaatctgctttttattatgaatattttcctacataatttagtactcttttataacacaatttttaattgcttattctgttgatagtttcttttgctgtgtggaaactctgtagtttaattaagtcccatttgtctatattgttgcttttgcccttagggtcttcttaatcaattctttgtctaggccaatgctagaagaatatttcctaggtttttgttttccctttctttcttccttccttccttccttccttccttctttccttccttccttccttccttccttccttccttcctttcctttcctttcctttcctttcctttccctccctccctctctctttctttctctctttcttctttttttgacagagtatcactctgtcatcaggctggagtgcaatggtgcgatctctgctcactgcaacctctgccttccgggttcaagcgattctcctgctttagcctcccgagtagctgggactacaggcatgcaccaccatgcccagctaatttttgtatttttagtagagacagggtttcaccatgttggccaggatagtctcgatctcttgacctcgtgattactgcctgcctcggcctcccaaagtgctgtgattacaggtgtgagctacggtgcccagccttcttttttaaattattttttaaaattggtctttaaattctaccagaattatttcctgattatttttctgtgttccctcctatcttaatttctctccctaaaggctgtttagcacctaacataactcatgcattaaataaatatattaatttatctcgggattcatgcgtatttttgcattactttgtaaaatgtgtttttctagtatttcatgtgtgttttgtttgcatattaaaattgcagtttcctttatggtaaaggcttgttttcccaacagttcaagcctaatatgtattactcagcagacagtcaataaattagaattggctggctaacaagttttcttttttttttttttttgagacagtctcgctctgtcgcccaggttggagtgcagtggtgcaatttcggctcactgcaagctccgcctcctgggttcacgccattctcctgcctcagcctcccgagtagctgggactacaggtgcccgccaccacgtccggataattttttttttgtatttttaatagagacggggtttcaccgtgttagccaggatggtctccatctcctgacctcatgatccgcccgcctcagcctcccaaagtgctgggattacaggcgtgagccaccacgctgggccgagttttctttttaagatgaattgtgaaacatttagcagctcttgaaatatacttttgcaccaccccacctgaattctttaatatgtattagttcttaaagaatataccatataatagtaaatagtattttagcctaatgaccagcatcagcattctacctacatttccagaatttaggttcttaatcattctgcttcttttcatttatccttcttacccactgagttctttttatggagtttactgtaaccctttaatgtcttccagactaacgctagaatgggtaatataaatatatgtaaattctgtaaaaaggcacattcagcaccttttatgccctgccttgtaagtttttagctcatatttttactctagctgttgccgaagtcatcatcttttcaggtctaactggagggaacctgtgaacttttttgcactttcttccctaagatttctcttcagccatttaggatatgtctggctaaacatagagctgaaagtccaggtgtaattaacatcctgcaaggcaacctttaattcaggtgtacagctctgatgtacattgcacgtgattcctcaaagggtccctagaagaatcagtcaaccccattgccaaatgcagaaataaaggcaagaatggagaagatcaaatgattatggagaggaaagcattaaataaagcctcatacagctttaagtgtgaaacacataatttgccattttggcgtgtgaattatgattgggtttgagctgtttacttttctgaaataatggcatgaaagaaaattaaagaccaagaatagttccatttgccagtagaaaaccagacttttattctctatctgaaattgtgaaaggaagatctgtatgcaagaaagaattaggaactgtcaaaacattttttcccaagctatctgaaagtacttgatttttgcatagtgtcaaagtattgagcttctatggtataaagcattgaaccagatgtgggggaacacaatagtgtgtaagatacagtccttatttccaccagttggaggagctaaagtacctatacctgtacaaatacaaaataattggaaagctgttggatgctcttagatgttcaagttaggttaggcaatactaacagtatatacatggcatttgagccagactttgaaagatatgaaggattgactaaaaccaataagagaccagagtatttggttttctgttcctgtgttactttgctaaggataatggcctccagctgcatccataagcctgcaagggacatgatctcatttttttatagctgcatagtattccatggtgaatgtgtactacattttcttaatctagtttatcactgatgggcatttaggttgattccatgtctttgctattgtgaattgtgctgcaatgagcatatgcgagcatgtgtctttataataaaatgatttctattcctttgggtatatacccagtaatgggattgctgagtcaaatggtatttctgtctttaggtctttgaggaatcaccacactgtcttccacaatggctgaactaatttacactcccaccagcagtgtaaaagtcttccttttcctccacaaccttgctagcatctgttattatttgacttttttttttttttttttgagacggagtgtcgctctgtcgcccaggctggagtgcagtggtgcaatggcggctcactgcaagctccgcctcccaggttcacccattctcctgcctcggcctcccaagtagctgggactacaggtgcccgtcaccacgcctggctaattttttgtatttttagtagagacggggtttcaccatgttagccaggatggtcttgatctcctgaccttgtgatccgcccgcctcagcctcctaaagtgctgggattacaggcgtgagccactgcggccggcctctcgttgtgttttaatttgcatttctctaatgatcagtgatgttgagctttttttcatgattgttggctgcatgtatgtgttcttttgaaaagtatctgttcgtgtcctttgcccacttttttatggggttgtctttttcttgtaaatttgtttaaattccttatagacgttgaatattagacctttgtcaggtgcagaattttcaaaaatgttctccagttctgtaggttgtctgtttactctgatgatggtttcttttgctgtgcagaagctctttagattaattagatcctatttgtcaatttttgctttttttgcaattgcttttggtgtcttcagcatgaaatctttggccatgcctatgtcctgaatggtgttgcctaggttatcttccagggtttttatagttttgagttttacattaaagtctttaatccatctcgagttaatttttgtatattgtgtaaggaaggggtccagtttcaatcttctgcatatggctagccaggaatcccatggtgtgctttcaataatatagagtacatcaatatttgtaaaatgtgaattatggaactatttcctgtacctcataggcatttcaaggaaaaaaattaatgacagatattacactgagtaacaaggtagtgtgagtttaaaaacagttattgtgcagtgtgtctcttcattttccagtgtcagggaaaaaatgttattaaattttacaattatatatgttgcacaaatgtgctgagtccatttacattttatggaataatttcatttgttctgcactagctggctggcagagaaattgaacaatgtttggtgatgttaaagttgtaattttgtcagcaacagagttaggaaatataaatataaatctggaactaaaacgtgttgtgttacctttggctactctaggggataaaatataacttttcaccaccacttcccagtggacttttcctgggaagtcagttgtcattgttctggcaagtttcttttcatcctaaattttgttatcatttaaagagaaaatcatgaaggttataaagaaatccattttagggtatctacccaaaggaaaataagttattatataaaaaagacacgtgcatgtgcatgtgtatagcagcacaattcacaattgcaaaaatgtggaaccaacctaaatgcccaccaaccaacaagtggataaagaaaatgtgttgtatatacaccatggtatgctactcagccataaaacagaatgaaataatggcatttgcagcaatttagatggcgttggagaccgttgttctatgtgaagtaactcagaaatggaaaaccaaatatcataaattctcacttataagcgagagctaagctatgaggatgcaaaggcataagaatgatataatggactttggggacataagggggagggtgggaaggggatgagggataaaagactaaatattgggtacagtgtacactgctccagtgatgggtgcaccaaaatctcagaaatcaccactaaagaacttacttatataaccaaaaaccacctgttccccaaaaactactgaaataaaatttttaaaaaccaaatacactttaaagacaattttaaaaaattacaatagtaagaacatggaaacaatacaaaaatgtggaatgtagaaagtattgtctgtgcgtggttgctcacgcctgtaatctcagctttttcggaggctgaggcgggtgcatcacctgaggtcaggagttcaagaccagcctggccaacatggtaaaaccccgtctctactaataatacaaaaaaaattagccgggcatggtggcaggcacttgtagtcctagctactcaggaggctgaggcaggagaatcgtttgaacccaggaggtggaggttgcagtgagccgagatcatgccattgcactccagcctgggcaacaagagtgaaactcagtctcaaaaaaataaaaataaaaaaataaagtgtcttccacagttggagtatattctttcataccttctcctatgcctatatgataatgctaaatacactatatatatatgtgttgcttaattatgctcatatatatgtatatatatgttgtaggatatactgtacctgatattctgtgactttgatttttaacctcaacaatatattatggtattcttcctggtcagtacatatagtcctatctcattttttccaaaggctatagaggatactactctataaatgaaaaaaactgaacctctgttgattagcgtgtatcatatatatatatatatcagtatgtatgtttaatgcatacttattttaagttgtacaattaatagctgtacagaattttaaaaactgatacattgtaactttacatatttatgaggtacagtttgatgtttcaatacatgtatatcttatatagtgttcaaatcaaggtagttagcatatcccttacctcattcatttataatttagttatgttgggaacattcaaaaacctttattctagctattttgtaatatacgacaccttactgataaccatagtcaccctactgtgcaacagaacactatgggtttttcttttttctatgtagatgtgtctttgccttattctaagcaaagattgccccagataccatctttttgtttgtttgtttgttcgttttttagcagttttgtgtgtgtgtgtgtgtgtgtgtgtgtgtgtgtgtgtgtgtgtgaagttttatactggttatgaatataattttgaacaatatatggtggacttcattgattgatttattaaccttagacactatgtgagtaaagcaggactgcactgcaaggagatgctaaacttttgacattcctgagagagaagttttataaatttcagaattcccctgatttatgcatgcctctctgtcacttaattatgctcataaaattctgcttaactagcaatgggattctcaacttggagagaaaagagtatgctaccactgcagcctaccagaagaacatatcagaatctttgggaaaatcttttcaaaatatgcatatcttccttcctacccccatgtggaacgtgcttacctgattgaaaatcactgcatgtaattagttgttactaattggaatgtaactatttgggagtgtgttgtacagatagtgtaaaaacaaaaaacaaacagcaacaacaacaacaacaaacttgtcaaagtaagaattatatatatgtaagctttaaggcatttaagtggtgaagaggtttggttttgtttgtttgtttgtttgtttgtttgttttgccccaggttaaggggcattgtcttaaatctcctcattttctgtttatcccattatttcattatcagccctagcagaggactctcctttataaaattcactttacaagagttcttatgtaaacattaatgagtagagactaataaaacaaagtagggatgtggatgccgtagcatggatggggtcattgctgagatgagtgactgtcttctgcattgtagacaagggcaagtcaaatttgtatccagcaaaatcactgtcaggggccttcagttcactataatagttgaaactctgagcactaaatctgcgaatatctaaccaagtctatcatcttttatacctttaaacctagtagaaaactcttagaggtctgtgattctatttgaagatcaccttactgggtccagtggatactaaaaatgacgatgacaaggacatgcttgtctggagggttggtttcacagtgctttgagctttctctatagcacctgagggtaagtaaaaagtctaaggggagaatttctaatggagttctctctctctgactgttttatctgcagactgcagctgaatatgtaaaatctcgactcccagaggcccttaaacagcatcttcaggactacgagaaagacaaagaaaatagtgtattatcttaccagaccatccttgaacagcagattttgtcaattgaccgagaaatgctagaaaaattgactgtatcctatgatgaagcaggtatgtttgtttttaaaacacacattttttttccttgcaaaaaaaattcattataaaccttgattaaacttggtaaaaggttaagggcaaactagattcaaagttatgtaacatggactaatagtaagtttcttctctgcagttttagtctcaagatggtcagaagattcctaaaaatggatcttaaatatcaaatgcctttaaaattttgctgttttttattgggatttttttggccttttattaactgggtactcctaaagtgttatttcaactttggatagcaactgaaaacttttacatccgagaatccaagaaatgttattcgattcaaatatttgtgttaatattagatattttcttttctaaagaggtatttttttttctcaaactgttaagctaatcattgctttcttttccttagcaactcagacactaccacatcagagacttcatctcactgcctgccataggttcttcccatccaagggagcttattaatgaagtcatggacagaactccttataacattattttaatctattatatggtctgtcagctaagacccaattttaatgaaattagtgtagtattacttggaattatgaaaatctttaataaaattaaacttaagcagcagaaataccctgattaaaattgctatacctctccacctccccctctcaaaaaaattggagaaaaagtacaggaaaaaaggtttctaatggtcaaatgttaatggtattaattcttatattaatgccaagaacttctgcttctatttttacaagtattttttagcatgcatcttattttcttcatcagaatctatgcatgctcgatactttcttaccatttgatttcaagttcaaatagcaaacagaagagcaaataaacaaaacaaaacattatactacattcacctaaccacttaaacaatatttctagttactaagctgcccccatgtatattccaccctctaaccccttcacctccctctcaagcaggatctgtatttccagttttgcccaggacatctctgctttctcttattcttctttgcttttttttttgttttccagacacattggctttcttctgcctagcatttttgttactttcaatattcttctcattggaattcttattcatctcttctctcatccttaatggaataaagttaggttttgatcagtcccaaccaaaataatatttaaatattcatagcatcttatagatcatagaactcatatagtccgcccacttcttgcccctgtgaccattttatggtgagaaaacaaactcatagacttgcctgaaataatgcagttacttacttgtaaaactgggacgccaacttcctaattactaatcaagctatgcttttactacactaatgcaggttctcatttgctcagtaagcaattgttgaatgcacggcaatatactaggttgttgaaggaaagagaaaagcagtgaaaacatgaaaaggaatctgagatgtagaaaatagatcttgcagaaagtcttgctggaggactaaaacatacatgtatgagctttagagaaaaatttctgaggaatttgggactaaatacaccctgtaatatcttcgcgttattaaagttaagatgaaatgtggagccaagaaatagtggaaatggctgaaattttccatgaaattctgtagagggggcattattttaaaccttgaaggacaaatggtgggcatgtatttgtgaagagaagggggatgcattctagtggatgaaggggcacaagtagacatcaaggtgagcatgaacattagctgcaatcacccaccactcaattttttcctgcttcagacataattttccactctcctgcactgttgttgagcagcaacagatcctcagaggtaggcttgcacatggcttttaggggcaaatagtttggcatagaattaatctgtcaataagccctgtagcatgaaacagtagaaataaacacaagattgagagttagaggatctaaggtctaggccttccaccaggttaatactggtgtgatcttcagcaaattaacctcttagaacctatgtttcttcatctgtaaaattgggctaatataatctcacatgataataataaaatattatcatgtttggggaagtccttagagatcatattgcaaatgctagttaatgccactagtgatgaatgagaacagatttggaccttgtctatcccttaaaccagtgtaaagtacagctgacccttgcacaacatgggggttagggatgccaactctctgtgcagtctaaaattagcataaaacgtttgattccccaaaaatcttaactactaatagcctattgttgaccagaagccttactgattacataaacagtcaatcaacacatattttgtatgttatgtgtatttatactgtattcttaagactaagctagagaaaaaaatttatgaaaatcataaaaaagaaaaaatatatttactgtattaaatggaagtggaccatcataaaggtcttcatcctcattgtctttactttgagtaggctgaacagactgctgaagaggagaggaggagctggtcttgctgtctcaggggtgtcagagacagaagaaagtgcacatataaatggacccatgcagttaaacctctgttgtttaagggtcagccgtattctaacttagtcttttcgtggcatacagtgtttgggaaggcagaggggaagtttttaaagtgatcttcagcagctttgaaaagtctagcaacatctatttgataaaacacccgctctgagctcagtttgcctttgctcatctctgcatgaggtgatgcaggacagtggatgtgggagggtaggctatgtgtatgcatgagtgaatgagtgttgctgtgtgttgcaaaaccaaaagttactacctcctcctccataacccatacgttaattatttcaatcaaagaaagaggataaaataagaaaaaacattactatttagcagaaaaatataataatacaaaagaattaggatagaaaattggtagtagtaggctggttgcagcggctcacgcctgtaatcccagcactttgggaggccgaggtgggcggatcatgaggtcaggagatggagaccatactggctaacatggtgaaaccccatctctactaaaaatacaaaaaattagccgggcgtggtggtgggcgcctgtagtcccagctactcgggaggctgaggcaggagaatggcgtgaacccaggaggcggagcttgcagtgagccgagatcgcgccactgcactcaagcctgggcgacagagcctccatctcaaaaaaaaaaagaaaaaagaaaattgctagtagtatccaatatgtgcagatgtaaccatcctacacagaagcttcctgacttcagatggtttaatttagtactttttgactttatgatggtgcaaaagtgatacacattcagtaaaatctgtacttcacatacacccattctgtttttcattttcagtatagtattcactaaattacatgagattcaacactttattccctttattataaaatagactttgtgttagatgactttgtccaactacaggctaatgtaagtgttccgagcatatataagttaggctaaactaagctatgatgttcagtaggttaggtgtattaaatgaattttcaccttaggatattttcaatttacagtgggtttatcaggatgtaatctcattctaagtcgaggagcatctgcactaacatgctcatttgcttcaactgtttagcttctttctattctatcttagttttgacttcctcacattcttgattcagctctcccagttttaggaggtagttaattattagttagaagatatcttggtctctagagaggttaatttgtctttaatgctccttcactgataaatcagcctgagtgacttaatgacaattactgctatttgtagcgtctaaacttctattaataaaaaaacaattaatgaaaaaaacacttagacatttttctaaaatcattgcctcagaattttttcaccctctcctttttctctttctctctctcttcccctttaatacatatataccttaatgccttgcctatccatgaattcagctatctagcaacctggaattcagcaaagaaatgggaagtgagcaaaaaccatgtgtgtgcaaccctaccgtgtcacagaactgtggacaagtccatacaacagaggctttcagttctcacctagaatctatatatttttattttatatagttctgactcattaggttatattttccaatgtggtatttccttttataaaattatctgacttaaaatgttatactttaattgcagaaatgaacagaaatatgtagaacagtataatatgagaataataattgtcagtaatcttactattgtaaacactttggtatattttcctcactctaagcattttaaaaatgtagttgatatctggtagttttattgtgattttatatcctgctttttgcatttaacattattacataagcacttccttatttcattaaagcctcttcatgtgaagataattttaatggctacatcatattctatttgaaagtaccactcactaaatattctcttatgttggacattttcatttttgttttgctcttatgaataatgctgcaagaaatatgggattcatttgtctgcattttatattactctagaggatagacttcagaaaacataagagtttagaattgaaatgagaaggtggggaaggggatgatacttggagcagcatcactgaaaacagtaagtagtgagagcaaagagtaaatccataaaaagcacttagcagattcctgacattgcactacactcaaagtcacattagcattcacagactgtgagttcacattgttgaacttcacaatagtgacttgattcacagagaaaaggttcaataatgttttttatattctgtatataaaagcaggaattatgtaaaccagtgtattaatccagtcagcctgtgatatggtttggctgtgtccccactcaaatctcatcttgaattgtagctcccataatccccatgtgtcataggagggaccaggtgggaggtaattgaatcatgggggtgggtttttcctgtgctgtttttgtggtagtgaataaatcacacaagatctgatggttttataaagggaagttcccctgcacatgctcttctcgtatgccaccatgtaagacatgcctttgctcctctttcaccttctgctatgattgtgaggcctcctcagccatgtggaactgtgaatccattaaacctctttttctttataattacccagtcttgggtatttcttcatagcagtatgaaaatggactaatacaccctgctttaacaaaataccatagactgggtggctgataaactacagaactttatttctcacagttctgtaggctgtgaggtccaaggtcaaggcaccagcagatatggtgtctataagggcctggttcctcatagatggttgtcttttcactgtaaccttacatggcaggagggctgagagatttatctggggcctcttttataagggcactaattccattcacgaggggttcacccctttgatctaatcagcatcccccacctcataataccatcaccatgaggattagttttcaacatatgaattttgggaggacacaaacatttagaccccctttctaacattagtttagaaagtttttcattcaaatggtttatattttgataatttcaagaactgatatgttttgtggtatagttgaaagaaaacttggaaccaaaagatccagattctatttctagtctagctctactgccaaccatatacgtgaccttgagcaagtcacaaaccttcctaaagcccattttcctataaactgatggcatgaacaggacctcatagatgtcttctagttctaaaactatgctttgggtcttatgacaatggaacactcaaatagctataatatctgcaaggcttcctgtagctatggcttttctgctttttctatttgttttcttctttctccttacacagccacataatttgtacctaatttctgaccaaaagaagaccatcactcagctttcatagcatctgctcatgaatattcccaggcatatttttattggtgggatggggagtgagactgtatgagtcaagcaaaagtagattttggaataagaggttctaagctatcattcatggatcctcattaagatagtttagaccttttattgtattagcatgtattaatactaagcaaaatccagagtaacaagtaaggtgtggtttatatttgatctattaatgtttttatttaattgaagtacaagttttcgtacacttcagtagattgggtttaacacagagaagttttcaaggaaagcaatggcataatttgagatgaagagatcaaaatagcattttacactgtccaaagcatcatcaacctaaatatttattatgtgtcatagtgggcaaaagtcaaagggttaaaataccaagagagggaatctttcctcatatttatttttatgctggagtattatttatgtttctgtagctaatctcaaattctgtttttaattatttttgagtttgggcatgaataaatattccctacatattcctttgttaaggatatggtttgtaatgccatgtgtttgagggaattatgaggagagtaggcccatttatttgagagtgatattttctgtcacaggctcaagaaccctaagccatgggagcggaagtctggaaacaggagtgaagagctgcatatttttccctttgggaaaagctgagtacacctgcaatgggtagaatgctcaatggtagcatcttgttgcaggcctcaagatagttgcctaagctgctgcttagatctccttctcagagttctcagaccagcaagggctttctgttcttacagtttggctagaaacctatacagccttccaatgagcacatgcttctgcaatgtggaaaatgcacttacgcgtagaaagtgaaccagatggtgcacatgagggaagaagagagctcagctggctgtttcttgtgttcctttgggtatcagagttgggagcctgcatattcatttataagtgtcaggcagtcacatacagctttcccagaggaggtgagaaaggaggagcagcattaatttctcagcttttgctttatgattccctgatgtagctctacctgcaggtgaaagctacctgtggtgaagacacaccaagcactataatttttggaaaaatagctttttaaaagcgtggaggaatgtgctctaagcagcttaggaagtagctggagggttacctcctattgagctgattttattcttcttaaaatagatggtgcctgaaagttacatctacattttaattgggacattagtgtcatagtaatcagtaatctcaaaagaaaggccatttactgtcatgggggaaaaaattgaacatacatccagcaaccaaacccaggaaagagtgtgttgaattatttagggactttccaggttttctaagaacataaaaaatctagtaaaaggcatttgcaggaagttcttcactccaacaaatagagtgaatttctcagtatatttctcaaacagctcctaagggaagaggtgacactaaggtttccttactttatatcttcaatcaggaccccatttcttagctcaaaagataccctctccagggacttgttgacaagaattggagaatttggaaggaagacaaaaacagagacccaaaagaaactaataaagggaagttcaatattgactgtgcaacctctgacaccaacttcttattttctgtagaaagatttaatctattttatttttccattataaaactaaataaatatactttagaacattttttaaacgtggaaaaaggaagagaaaaagataatctttaattctactacctaaacataatcaacatctttggtgtatttatttcttgccatttttctctgctgagttttaattatttatgccaaattttatatcttttttatttaacatttttaatcatattttatgctgttataaactacctataaaggtcacttgtaataactgcagtactctattgagtggatataccacagttattctcacaaccttttaatatttttaatatggttcctgtcttgtatccatgtttcagttctctttaccacatagaatcccagaatttggtggtctgtttcttatctgtgaaaaaaatgagaatggtagtatgaataacaaaaacataaggcttttgtaatgcagacgattactagccatgtataataacagtaggaagaggggagtaaaatgggtactcaaaatccacttataaactgagaacttatttctggcgataatattaaatttgtttttgaggctacgtaggtgactaatttatcaatctttttaaccaagctgaatattttttttttttttttttttgagatggagtgtcactttgttgcccaggctggagtgcagtggcgcaatcttggctcactgcaacctccgcctcctgggttcaagcaattctcgtgcatcagcctcccaagtagctgggactacaggcatgtgcaaccacgcccagctaatttctttactttttatttttttggtagagatggggtttcaccatgtttgccagttggtctcaaagtcctgacctcaagtgattcacccaccttagcctcccaaagtgctgggattacaggtgtgtgctattgcacctggcctaaccaagctgattttaatttcagttataattttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccctgttagctcagttataattcttacactttccatttagactgtggattttaaaagccaaattatcttttggtgatggggagcagtaactaaacaaagtgactttgacatctacaaaatagaaaactattggccatagttgtttgaaagtaccgaaacatgtaatttacaagccccagcctaggtttttgtctatggtgggacgttgcatctctctgcatggtttcttcaactgtaaaataaaggtattggattagatattttcttaaatctcttccagtcgtaacaatgtgtgatttttgtctgtttatttaacagttattggttcattcatttattcactctgtaaacactgactgaatgagcatctttgagccagacacagtacccaccactagaaatgctcagatgaccacgtggcccttaactccaggtgcacagtgtgtgcatttgtatgtgtgctcatgtgggagggcagagagatagccagtaaaaacagacaactagagtgtagtggaattggtgttataggggacggtagatgtgcagaggaggaagaaattaggtttggaattggtaaagagttcttaaatcagaaaatcatgagagaacccgtaaatcttgtgaactgttcatgttgaactttactgccagttgcgtttttaaagacaggctttgaataatgccttgttttcttctttgcttctgtaactgtggttatatgttggtgccttatacagaccaattcttgccttctgccatggcaacacctaccacattcttttttttattgagacagggtctcaccctgttgcccaggctggagtgccgtggcatgatcttagctctctgcaaccttgaactcctgggctcaagggactctccagcctcagcctccagagtagctgatactacaggtttacaccaccatggctaattgttatttgtaaaatttttctgtagagacgggttcttactgtgttgtccaggctggtctcaaactcctggcctcaagtgatcctcccaccttggcctgttaaagtcctggaattacaggaatgagccaccactcacagactcaccaccacattctaactgcagctctccaactgatattaattagtttattttagtttatattaatatgctatcagcattgcctgtttgcttatgattcctccaatgtagaaaaaatgataattcagacttaatctttttttttattatactttaagttttagggtacatgtgcacaacgtgcaggtttgttacatatgtatacatgtgccatgttggtgtgctgcacccattagctcgtcatttaacattaggtatatctcctaatgctatccctctcccctccccccaccccacaacagtccccagtgtgtgatgttccccttcctgtgtccatgtgttctcattgttcatttcccacctatgagtgagaacatgaggtgtttggttttttgtccttgcgatagtttgctgagaataatggtttccagcttcatccatgtccctacaaaggacatgaactcatcattttttatggctgcatagcattccatggtgtatatgtgccacattttcttaatccagtctatcatcattggacatttgggttggttcaaagtctttgctattgtgaataatgctgcaataaacatacatgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattgtaactggtgtgagatggtatctcactgtggttttgatttgcatttctctgatggccagtgatgatgagcattttttcatgtgttttttggctgcataaatgttcttgtaaaagtggtatgataggaaggtattttaaaaaatcacattccccaacttcatcttacctttctaatagaacacctcatatccactctgaaaatacattgatctaaattttatggtgggcaaaattttaaagaactttgctgagaaaaccagaaaccacaaaggaacactgatatttagaatcaggaagtgccatctctagtgattaaaacatttggactggagctgtatttatctttttaatcaagttgtccttgtttgccacaagggaagtagtgttacttcctgtctctgaagtagtatttgattacaaggactaaaggaaatgtgtatacttcaaagaaaataattggaccaggtggtcatactttagagtacattagctatccagagacaagatgccaatgccatcggtatctcttcctttctgtactatcgggattgtgtaaacaagattttatagaccttgttagaatgtttgtaataaattttaatgacatacacattaatggtaagaccttcagtttatagagaaaaataaaatagtttttaaagtgccaggatttctaatgtattgtgatggtccatttgtagtagtgagaggtaggtaaaatgcatccttggttgactctcagactctgaagatatgtaatcatagacagctgggctgctgtttaatgccattttgcaaatgttatgttcagtctttgggatctactagacactttaagaattcatctggtaaattgccttctgaaaggccctgtttttttttttttttttttttttttttttaaccaagacttgtctttatttttttatttttttttgagaatgattctatctagtttttctttttttttctaatttatttatgtattttttattatactttaagttttagggtacatgtgcacattgtgcaggttagttacatatgtatacatgtgccatgctggtgcgctggacccactaactcgtcatctagcattaggtatatctcccagtgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatctatgtccctacaaaggacatgaactcaacattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagttgtgtgggtgtatatccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgaatttttaatgattgccattgtaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatatcctgaatggtaatgcctagattttcttctagggtttttatggttttaggtctaacatttaagtctttaatccatcttgaattgatttttgtataaggtgtaaggaagggatccagtttcagctttctacgtatggctagccagttttcccagcaccatttattaaatagggaatcctttccccattgctggtttttctcaggtttgtcaaagattagatagttgtagatatgcggcgttatttctgagggctctgttctgttccattgatctatatctctgttttggtaccagtaccatgctcttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaatcatcggtagcttgatggggatggcattgaatctgtaaattgccttgggcagtatggccattttcacgatattgagtcttctgacccatgagcatggaatgttcttccatttgtttgtatccttttttatttccttgagcagtggtttgtagttctccttgaagaggtccttcacatcccttgtaagttggattcctaggtattttattctctttgaagcaattgtgaatgagagttcactcatgatttggctctctgtttgtctgttgttagtgtataagaatgcttgtgattttggtacattgattttgtatcctgagactttgctaaagttgctaatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtggcagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgccactggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactccttttggttggtaagctattgattattgccacaatttcaggtcctgttattggtctattcagagattcaacttcttcctggtttagtcttgggagagtgtatgtgtcaaggaatttatccatttcttctagattttctagtttatttgtatagaggtgtttgtagtattctctgatggtagtttgtatttctgtgggattggtggtgatatcccctttatcattttttattgcgtccatttgattcttctctctttttttctttattagtctgctagcggtctatcagttttgttgatcctttcaaaaaaccagctcctggattcattaattttttgaagggttttttgtgtctgtatttccttcagttccgctctgattttagttatttcttgccttcagctagcttttgaatgtgtttgctcttgcttttctagttcttttaattgtgatgttagggtgtcaattttggatctttcctgctttctgttgtgggcatttagtgctataaatttccctctacacactgctttgaatgcgtcccagagattctggtatgttgtgtctttgttctcgttggtttcaaagaacatctttatttctgtgaaagacactgtttttttaagtcaccttctagtgcccagaggaattatctttgtgtttccttagttgataagtttgtctcaaggctgtgtggcttaggccatttctgatgaagctggtttgataaggagtttctttagtatatacactggaggagctcctggatgtgctctttagttctttaatcaatcctagggaattctaaattgactgtgtagaaattgctaggacatacactgttcattcaacacaaacatttactatgtgccaagttctggctacgtgccgagagtctaagaaatgggtaaagacagatgagttagaagtctgcttccttcgaatttattgctaatctttgacttctgtatctatgaatctattttctagaatttgtttcaaaataacacctgtacttaactgacttattccttacctgagtcactctgatttccattctcctgtcttagtctgcctcattcaaggaaggaagtaacacaaattatatttttattatttatatcccacttcttccctaaaagtttgatttgccattcttataataataatgttacaataaaaatagatcaaagccataaataaggacgaaagcaaatgtactatccataaagaatactaaagtataataatatactttaattaagcatccaatttctcctaagctttctgataaccagagcaaaaagagaaacctaatgacttataaagttctcactgttttaatagataaaataaaagtttttcagtggagacaacttctcttttggcactaaagatcataaagactttatcacaagacttcctgtgtatgggacattgaacaacattgtcttagtctgggttcctcaaatgtagagcctgaagcaaagacttgcttacaattggtttatttaggaatatcaccccaaggaacaggagtgaggggcactgggaatgaaagaggaaacaaggaaacctactatgaggacacttatggagttgggctcatctgaggacaaatgctgcttaagcccaggtaccttctaaggtagcttgtgaatagcatcccagaccatttagctaccagtaccactcccacatttggccaatggtagttccacagacattaacttccctgaatttctggtttatgtaggcctgaaggctgagtgagttctgtgggcatcccatgccttggcatcagggaatctccaggggaggaagcaagcaataaatagtttagtccgaggcagcatctgagcagaactggtctccacagtggtggcggaaataagaggtacgggagcaagagagtatgaaatggtgcccaggagatggcctaggcaagcacaacaaataaaatcttaacttcatagcaaatgcatgtgagcccatcttatggtcatttcttgcataacaaccatctataaaagctgagggccaggcacagtggctcatgcctgtactaccaacactttgggaggcttaagtgggagaattgcttgagcccaggagttcaagatcagcctgggtaacatggtgaaaccccatttctataaaaataagaaaaattagccaggcatggtggtgcatacccatagtcccagttacccaggaggctgatgcaggaagattgcttgagcccaggaagttgaggttgcagtgagccgtgttcatgctactgtactccagcctgggtgacagagcaagacccagttaaacaacaagaaagaaagaaagagagaaagagagagagaaagaaagaaaggaaagaaagtattattcatgtttttttaaagctcttgtattggacaggaaaatgcatctgaatactctctatgttggacatactctatactggaatactctctatattgaacatgtagaatatcgagtgtattcacatgcatttatagaaaaatattgcatatagcagaagatgaaagaaaagatgttttgtttgatgtaacggctcaacaggacaggatcctaactcaaacctaaataatttatcttcacttttatcactaatgaatttaaatacctgggcccttcaacctgagtagcatggtgagatgtaacattcaaattggggtttatttatttgacagtaatttgtattcatttattgattttccaacccacttattccagttcagggttacaggtgtctggaccctatcctgacagctcagggcacaaggtggaaacccaccttggacaggacaccatctcatccccatggtgcactcacacacacccactcagactggaaccatgtagacatgccagttcatctaaggggcacaactctaggatatgggaagaaaccagagtaccttgggagaactcacacagacatgggagaacatacaaattcctcatggacagtggccccagccaggaaacaatttttttttttacatcaatattctagcaaaatgatgttgaatgaaataacattattcaatgacctgctatatgtaaaaattagttaccttccacagataagaaactcacaagagtggttactttgggaatgaggaattgaggaaggagacttactttttcactgagtactcttactatattgtctgaatttttaactttgtccatgtattttgtatttcttaaaatttataaaaataaaactaaacaaaaccttcctaatccatttcccttatcttcagtgctagaaatggaatgtaataccacagaaaatcatacttcttgttttcaataaaacttttcatccttaagtcatatgtatctttggaataagtcgacaaaggaactcagcaacaagaccagacatcatggaactgcagtgccaaggtcagagaaggtcaataataaggtccaaggcatgcctggacaccagggcttctaccataggtgcttggtagcctttctaccctgggccagaactggttccagattccagggtagggctggccttattggaaaaaaaataaaaattcatctgaaagagagcaggattcatcggtagcatgctggtggggatccagcagagtttctgatgtcaatttctgttggttgcctctgcttcatctcagagcttgatcttcttgtgtctgacaagttattagatttgatgctttacttggccttttagtcagatttcttctctcctgaactatggccaaacctctattgcttttctttcaaggcggtgaagtatagtgaaaagagcccaattggcttcatgataattctttgtgatattatacttaatggggctttttatgaagattaaagataatgggccaggcacagtgtctcacgcctgtaatcccagcactttgggaggcgtaggacgggggattgcttgagctcaggagttcaagaccatcctgggcaacatggcaaaaccccgtctctacaaaaattagctggacacggtggcatgcacctgtagtcccagccactcagaaggctgaggtgagaggatcgcttgagccctggaggttgaggctgcagtgagctgtgatcatgcaatagcactccagcctgggtgacagagtgagaccttggaaagaaagaaagaaggaaagaaggaaagagagaaagagagagaaaaaaaaagagagagagagagagaaaaagaaagagaaagaaagaaagagaaggaaagacggaaagaaaaggagagggagggagggaagggagagagggagggagggaaggaaggtagaaggaaggaaagatataatgtgtggaaaatgatggacatgcagtaaacactctaccaatgatagtctttctcttgtttttgctgttacatgacgtagcatgtacttgatgtggtgtacaggggtatttccccaatccccttcatgatggagaggattacctattattatacttggcacaaattaacttcctgtccagagcatgacagaaaccagcaaaatgctgactccataagcctcctcttccttccttgccctgtcctgtatggaaaaatatttcctcaagttaagagtatttgtatgggtttaatatctttatcttttctaatactgtgtattagttacctattgctgcataacaaattactccaaaatttagcagcttaagacaataaatgtttattagctcatataatttctgaggatcaggaatctaggttggttctctcatgtagttgcattcaagctgtcagccaggggagcagtctctgaagatttaactggggctgttctgcttctgaatatactcatgtggctcttggcagaaagcttcatttcctgtctacatgggtttcttcataaggcctcttgccacatggcttccctcagtgtgagtgatgtaagagacagagagcaagggggcacccaagaccaaagccacagtcttttataatgtgaatgtcgaaagtggtataccacagtttctgacagaagctggggttggtcaaacaaaccaaccctaatttggtgtggtagtattcatactaagcaagggtatgaatactaggagatggagatcattgggggcctcttggaggctaactaccatagggtgtattgcaaaaatatctactcttactcttccaactcctccactctctcttctactattatcacctttccttctcattttatttatttatttatttatttatttatttatttatttatttttattgagatggagtctcgctctgtcgctcaggctggagtacaatggcaggatctcagctcactgcagcctctgcctcccaggttcaagtgattctcctgcctcagcctcctgagtaactgggattacaggtgcacaccaccacacccagctaattatttttgtatttttagtagagacggggtttcaccacgttggccagggtggtctcaaactcctgacctgaagtgatccacctgccttggcctcccaaagtgctgggattacaggcataagccactgcgcttggccccctctcgttttctaatcactacctgcatctcatttcttggaagtccaaagctggagtgttgagccctgcacctggatggctttaggattatttagactcagcatcctttccagtaatcacagtgtacatttcatctctccagggtcaatgcctttgatgtatcagtttttaaatattttgactatcacttctgactcctctaattcattaagatatttccttctagagcttcctaacactgtgcctgggcatctcgacagctttgaaatttcagatcagttttttatagcggcatcctaaatgcttcaagattaaggcatgactctctggatagcaagaaaaaaaaatgtctctctcctttatcactccctcctcccttttgtttttctctttgtttccttaactgtgttctaaaatttatcacattttaaattatatctattaaataatttgatcactcattctgttaattttttaaatggatgagtaaagaaccacataaattgcttttatatttcactttaatgttcgacccagcagttgccctcagtacaagtttcctatcccttttttattgctcttggttgccttttgtattgtgtagagaaaaaggaatgcagcaaaaatgaggaagtcactgaggagcttgtctttttctttcactttttactatgccataatttcccttactgtggtcatctattttttcaccaaatctccacctctgattctctgttcctaaagaaaacaacagtaaacatgtaagcctctcattgtatctccattagtggaagaagactgtgatggaactgcaagtaactttcctagggactgctccactgtggctagattttttaaaaatgttatgaggaaagcattattttttaaagaactcatatttttaacttttttctcgtttcaaattgcttttttgatctatggtgaattcaatctgagattaagcattaaagaacttgggaaaaccaaaatgccttcacagaattagagatgcatttgatttttgtactcgagaatcagcttgtgagaagtattggcccctgtaaatagagataaactaagccaaatttgtctgtaggccttgcattttaaaatcacacctgaaagtgttatgagcctgatataattgcatttgcaaataaaatgcaagaaggtctagggctcagagtacaattaaatgtattaaatttttctttttgctgtaatgacagtaactttaggcctcttcagttgactgtacctctttgtaaaccttcccctgcaggataatcagcattccacagccactaaagaaaatgagcttgtctaaaaatagttgcctgtttactagattttagcagattttttggggggtggtgggatagggggtgggtaatatgaaagctttacaaaatgaaatgaggtcaaatatgacagatgtgatcaaatgtacttctaatctgtaaatccctgactagctacagttgtgctatttttaaatgtatactttgaagttatactgaatttatgacattctcagcattttcctatatctacaagcatttgggattactctgttgtattctgtgggttggcgatcagtgcatcattgctggtgcccactggctctttattgggggaacccacccctgataattcttcgtgggttcttttctatttacctaagtgtcagccagtctgagaaataaagggaaagagtacaaagagagaaattttaaagctgggtgtccgggggagacatcacatgtcagcaggttccatgatgtcccccaagccacaaaaccagcaagtttttattagtgattttcaaaaggggagggagtgtacgaatagggtgtgggtcacagagatcacttgctttaagggcaacaaaagatcacaagacaggaggttagggcgagatcacaaggtcagggcaaaactagaatcactaatgaacttccgtgtcccgctgtgtatgcattgtcattgataaacattttaccagagttcaagagcagagaactggtctgactagaatttgccaggctggaatttcctaatcctagcaagccttggggcactgcaggagactagggcatgtttcatccctatctacatctgcataaaggcagacactcccagagcggccatttcagaggccttccctgggaatgcattctttttccagggctgttaattattaatattccttactggggaaagaattcagcgatacttctcttacccatttttggtaataagagaaatatggctctgtcctgcccagcccacaggcagccagactttaaggttatctcccttgttccctgaaaatcgctgttaccctgttcttaaggtgcccagatttgatattgttcaaacacacatgctctacaaacaatttgtgcagttaacacaatcaccacagggtcctgaggcgacatacatcctcctcagtttatgaagatgatgggattaagagattaaagtaaagacaggtataggaaatcacaagagtattgattggggaattgataaatgtccatgaaatcttcacaatttatgttcttctgccgtggcttcagctggtccctctgttcagggtccctgacttcctgcaacaggtcttacttagtagagtgtcaaatgaggtcctgttttgcactgcttttatttgacaggaattattttctaaccaccaaaaataataaaattgatttactatgaactctttcctttacaagcagtggttctctaccagaggcgatatctacctccacccccatgggacatttggcaatgttgggaggcatttttagttgtcacagcttagaaaggggaatgggagggagggctggtggtgtctagtgggtagaacccaaggatgctgctaagtaagcattctataatgcacaggacagcccccaacagcaacatttatctaaccaaaatgtaagtagtgccaaggttgtctttagaacaatagttttcaacctttgtagcatattaaagtcaccttgggaggctaatgcccaggctgcattcagatgaattacactagagtctttgagcagtgggactcaggctttagtatttttattttattaatttttaatttcaataggattttggggaacagatggtgttttgttacatggtgatttccgagattttggtgtacccatcaccccagcagtgtacactgtacccaatgtgtattctcccccaatgactccactgcgtaaccaagattgagaactgttactttagagcaaaattttaaagggtaagactagtttagacatcatcacaaatagttcccttactaaagtagatgaaaggacctcattaacatgtggttggaccaatcaggcatgtcctagtatagtattatagtgaggttcaaatgaacttttaatattctctaaagccagtacttaaaacatgagaaactgctattctcattcccatattggaagtttgttttccttgtttttttctaataagttctttctttttccaagcaagtggtgataaatatttactggtagctttagttagtaaagttctttcaaataacaccttgggtgtttgagcattggtgatttgttttccttgaagatgtcttatgtatctttattacttgaataaatatcatcatgtagttatttacctgaattgataatgctgtgcaaaggagctaaagtatcctctctaaaaatatttttttttcataattttggcctttcattcctttaaccatttcctctcaccaaaaattaaatcttaaaatttatggacagttactctaaacagataaatattctccagggatgattaatgtatgatttttttattttattatagatgcctatattgatggcacagttctcagggaacactctccacccacccaaaaaaaaaaatagcacctcaaagcttttgagagtcagggtagatagaacaatttttaatgatgtattatatagtaaaaactagtccatttataaaaacctgcctagcaaataataaaactgtcttctttcacatctcaacgtctcagtgagagttcaggctgtcgaactatggaaagcatccagcttctttgaagaaatagagtgaggtattactcacagagagccatctggtatcttggtcattaacccacttttgctacccatgcccacatgcttgtcaggagatgctggagaatgaaggaagggaacagattgaggaaggaaatggcagtgattgcagagcccagaggctcccatattggtaagaggttagtcagattcctcagccagggcagagactggcccaggtttcctgaggcctgagttttacacaatttagagaaccctctttaggaaaaaaataaaaaataggtacaaaatgatttctttagaatgagaaaagaaatcacaataaattacaaattgtaaagagttaaccactaccactgaacctagaaaaataacatttgtattaattaattgcctgatatatgctatagtctgacatctgctacagtttttcccacatctttggcagcatgttctttggttacttcttcatagaacagtgagtttgtaacatcatttcctgcagaggggcctgggaagataatttaatcttccctttagcatggttgagcaaaacttgggatttttatcttgctttgttttttaattcatacttcagagtctctttcagcttttcattttgttattcgtaatgtcatacaaatttttagagttgctgccaaatcttggaaaatttatatcaaagtttcttacatattctttctttcttacaataaaagatttcaggtcatttgaagtttccttatacagttactaataaatagtccttgaatttacaacactcattagctgattggttgtcattgtccttgttgtaatggtgaataatgagttttatttgtcttcacttaatgtcgcattattcataagaacctgagctgtaatggagtgagaacatttcaggtcaagggagaacaaaaggtgtgatctggcaaaggcatggtgtccagtttggatggaatatcatgtacaagtagtgtagcagtgggccacaggactagaaaggtatgctggagccagacaggcaagtgggaagggttgtcaatacttggtaggtggctaaaaatagactctatgttgtatcataaagttaagaagcccaaggccatttgtggaccactgagcatatgaaaggcagcatggtgtaatgttaacatcattggccttagaggcagccagattctagtctgaatactagctttccccccaacaggcctgggaagccttgctaacaagaactatacgtgaaaataatggcaaactacatatatatttcactatacccaaacttgatgtatccttgacttaagttcctcttagatcccagccagaggccaatttagcatcagtgtatatacagggaatatgatcaaagggaggtagaagtgaagagacagtgctcttacctgattacttcttacttctccaagtatcttcttcaaattttcggaaacatgacccaggcctttgaaagtgcttgggcaagggaagggctctcaagtttgaagcttcattagcttcaagtaaatctgcaggtggtctaggacttattcttcctctcctatatgacttcagaatcagacaggtgagttttagtgcaatgatttaggcagttattgtcatttctgatagtaatgaacgatatgctctgtgttttaaactaaataataaaatgagtttttaaatcgtcacatagcttcactttgttccttggcttaaattcttgaactagggaagcacattgtatggattggttcttctggtcctatcggctgtggcaaaggggccaggcttatatggcggaattttcctttcctgaccctggaagaggcagattctctaagagttaacgattgagaaggaaataatgggatctctagagtagacactgtcaagagtggcagtcacatgactgccttccacaagaataggggaacctgggcaagagaggaggaatagggcagacgccatgaggtgactgaagctcatgggagacaccccttgtcaacttgtagaaacacttggacaggttctgtcaagagcatgacgtttacgttattaatgtttatatgacatccatgggaaggtgaggtctgcaaacattcaggttaaggagttaggaatgatatgagaaaagaaaaaaaaatcaaccttgttcttgaaatgagaacagacttgaccttaagcaaaatcaaaaaacaatagagccacttcacagttgctatagatttccaccttttagaagcagatgcaaaaaatcagattttcttggcttttggtctgtcagccccagtcaataattaacaacactgagtgaaacatttttcctctgagatcctcaagctgcttaactgatcagcttagcttagctgagcatgttagggtagtaagaaaagggaaaatatggtttcaattttggtgtatgtgccactagagcaggcactaaaaaagaaatagaatgttttctaatcttcctttctgcttgggagatctaattcatggagaagttaagtgattttctcaggatctcagaacaacttaccagaatagaacagccagtctttaactatcaaagccttcctgggagccaccacttaagctctgctaacctgcttcctctgttcagatatagtggtagtgcagttaacagaagatgtctgtacaattctttatgcttaggaggccagggaatgtctatgatttcataaactagttctgtggttctcatgagcaatagattttaaaggctttaacaccctagtaatcagaagaggggaaggcatcaatcttttcatgccttcaaagagatcaaaccatagccagctgatataaaacccaatgtattgattaaagggaatgtgttactcacttctgatgtgaaagggaagaaaggaggaaatagaaacaaataagacaatcctttagaaaaatctgaaaactgaagaatatgagcacttcagtgcttcatgctaaagccctgcgtttcctattaatatttcttaatctgtttccttacttgctcatttctcctcttttaatttttatagtaacatgtcctataaaaccaacatgataattgtcctataataagttcctctgcagtgggaagtttagggaaaaacaatttaagtacctttcctctctaaagtagtaactctaacccttacagaaccaaccagcacttttttaaaaaaataacgattattttatttattatttattattatttaaaacaattttttttttttttgagcagagtttcactcttgttacccaggctggagtgcaatgctgcgatcttggctcactgcaacctctgcctcccaggttccagtgattctcctgcctcagcctcccgagtaactggaattacaggtgccctaccaccatgcccggccaggctggttttgaacccctgacctcaggtgatccacccgtctcagcctcacaaagtgctagggtcacaggcgtgagccaccacgcccagcctatttattaatttttagaaacagagtcttgctctgtcacccatgctggaatgcagtggcgtgatcatagctcatcagagccttgaaatcctgggctcaagtaatcctcccacctcagcctcccaagtggctgggactacaggcataccccactatgcccagctgattattattttttattttttgtacagacagggtatatctttgttgcccagactagtcttgaactcctggtctcaagcaatcctcctgccttggcctcccaaagttccagcattacaggcatgagccagtgcacccagccatagcaacgttgtttttgttttgttttgttttgttttgttttgtttttgagacaagatctcattctgtcacccaggctggaatgcagtggcatgaacacagctcactgcagcctcaacctcctgggttcaagtgatcctcccgcctcagcctaccaagtagctggtactacaggtatgtaccaccactgcagctgatcttttttttgtttgttttttgtaaagacaggagtctcatcacattgcccaggctggtctcaaactcctgggcgcaaatgattctcccacctcagcctcccaaagtgctgggattacaggggtgagccaccatgcccagccaacaactattttttaacattgtttttaccatcctaaaatgaaattcatagataatataatctacctatatgtatacatcatgatttaaaaattcagcaaaatgccctaacataaaggggaaaacaaagggaaaataatatataattatatgtatttcaatatgtaaatattcaagcaccaatacattagaagtcataatggagttgtcagatgtgtgtacacagatgtacaacagctgcaaatgaagactaacagttggattattttgataactccaacacagtaagtagcattgtcattgatgaagtgatttttttaagatagcaattcctctttgtgaagttctaaacaaaacaaagtgaaaggtcccttcatttatacagtagctgcattcctggaaaattcattgtatactaaagcgattcccaaaatactctttgtttacatgtaagacaagttccaagcccatgtgattataaacagattttcacttctactatttgcaagttgtatgggatgtgacgaagtctcttttgtaggactgtctattacattgcagaatctctagtgtccctttcccttgctgaataagtcccagtcatacccacagttattttgacaaccaaaaatgcccccacaaatacccagaacatcctcattcaggatcactgctttgtaggggtgccaatcttttggcttccctgggccacattggaagaagaagaattgtcttgggccacatataaaatacattaatactaatgatagctgatgagctaaaaaaaaaaaaaagaaaaaaatcacaaaaaaatctcacagtgttttaagaaaatttaccaatttgtgttaggccacattcaaagtcgtcctgggctggtgggccacagattggacaagtttggctggaacaaaggtgaagaattaaattcagggaagagacattgagttctttcccaaaccattttgaatgtttttggttccttttctttggatttgagatgttgagagcccctgtttcattttcagttactgaaaacttaagaccccagggtattctcaggaaaaagaaagatggtgatggtgtagttatagcacattaaatttatggctttcatcaaactacttgagttaagaatccccaaggagagtttagttagggaaagaagactctcaattacagatattgattcaaacctaaataccatgctaaggaacctagaaaataggaacagttatacctcaggcaattatgtaactacttgatgaaatttttttaaatgttctttccgggattaatctagagttactataagtctattacagtctcccataagtcatacttattttctgtgaagtccttgaaccctgggccttaactgtattcctaacgactgtggcctaagaaaaagacccactggaggagctacccatgtgccaatgagaacccaatcttcaactggaaattgaccagcctactgtctacaagtgtatgccattcatctcattatactgcattctgtatacatatgatacatctatagtaaattcatgaagacagctcaatctcttggtttccctaggtaacataataataactaataatgataactaataattattgagcacttctatgtgctagatgctgttccaagctcttgatgtgtattaactttttgaattctctcaacaaccctaagatgtaagtattattattatcctcattttacatagggaaactgaagcacagggaggttaagtagcttgcctaaggttgtataactagcaaagccagaattcgaacccaggaaatctatatctccagaacccaaattcccaaccattatactatgcatatttaagaaataacaaggcttagtaaaggatatgggtgggtaactaataatccatgaagaggattaaataccatactgcttccagttctgatcaagctaaatatttgtgggtgataatagttgagaaaattggtagtgctgttacagctttattcttttaagtatctgcagtgttagatgtggtaaaacagaggacacgaacaccattatctctaaaacggagataatgacaagtgtagcttccactcatatcatcaaaattagggcccaagacactctatccaactaacagaaattcaattcaaactagcttatgcaaaatgaaaacaacaacagcaaaaaagaatgtgaagtttagtagttctgtaagtgaagaattcgagggatatacctgattaggaatggtttgacccaggtctcaaatgatgtcaaaagcctttctcttccttactcagctctttctctctttgcatgttaaccatattcttgtccattgcaaacaactttatccttggagccatagaagatgttcacagtttaccaatacagggaaagaaaggaagagaccctctctttcctggtatctgctggacagattttgatccagtttggatcacatgttcttctacaaaccaagaactgtggccaaggagaaagaactctgattggctagcctgagctatgtgctcatctgactcatctctctgaaggaaggtgggcatgcaccatggacctcatggcttggaagacagatcgttctcaaggggaaagggatgatgggcagttaaaaataactgctttaaggagccaaactgagccataacctgactactactatttttataacactaggccgttgaatccctaactcataactgaattgttgatccaggtacggtgtacactggtgttacaacaaggtttttttttttttcttggttttgttttatacatgaggatatagaattatacacagtgcctgatataggttaatcattcagtaattgttagctgatattatatgctaataagtaaaaatgatattcctgctattgcctttataatgaatatctaacaaaaaactttctgcagggtatggcagtctgaggtgatggccagcatcaatattccaaggcatgtcaacaactatatgaattagggagcatcactttctaatctagattagtctcgagtttgataaattatcctgattctctacaggagatttgggagggttgggggaaggaagtcaggtaagaaaacatgggagctgaactacaatctttcatactaaagagtgtccgaacagaagtggtcacaaggtggtaaaaaatagcttcttgcctgctcaggtctggcagttggaaaacattgttctggtgatgcttctaaaccatcagtagccctctgcttgcattgggtgaattggggagctttatagaactagttcatgggcctcagcccttaagaatgttttggtaaatgtggagggaccgagattcccattttcagacccaaggtaagcctgacatgccgctagacatgagaactgcaataagcaatctctataattcaaaaagagaaaacagttgtcatagtaagaacacagagtagcagttcaggcacagccaagttacaaaacttgaaccgacaaatggtatatacagacagacagtgtttataccctgtcccctcttttgatgacaaagccattagttcctttttgtttttctctcctcagggactgataacacaaagcctgctctctccccaactcccatttttcctctttttttttcattgctcagttaatttcactttgttccatttctttctcatgtatgtaagtaaatttatcctgatgccttttctggtctttttgcagattttactcaggatttataggggggtgggggcggatattacttctctctattaattcatgaataaaaattaccttaaatatacttgatgaattattaattcatccagaaaatagtaattgggcacctatttgttatgctgacccttatcaactccagtggggaaggcaccaagttgaagaggctgaagaagaaacctagagccagcaaacaagatatggcttttcccaggggcttacatgcagaggagggagttcagtggcagcagccttggcaggatatctgcatggcccagtggcagcaggctgggcagaagaaccacagctgcttgcaaaaggcatgcagtttaatatggcattttcatttagcaccatttccccagtgatcttcacctggcaatctacattcaacccaaaacctggggcctcgatcccctgtacagcctgtgttccatgggacagcctgggggctcaactgttcctcatagaaatctccaggttggccactcccaagttccctagctcagaacatacattcaggtgcatctgccctacagggttattctcatggtatgcttaagttattgctatcaggtatgtttaccacacactactatgtgcaggcatagtactaagttctggaaattcaactgtgaacaactcacacaagattcctgtcatcatgagatttcagtgtaaggaaggagacaaaataatgaacaaatgactatcagggtgccagatgatgctaagcactatggagaaaaataaagcaggacaagagacaagagcttgacagtatagggaataggagaggctgaggcacaggcagtcagagaaaggcttgaaggaagtgaaaaagtgaccctttccaagatctgcaagaaaggcgctccaggcaagttaccagccaatgcaaggaccctgaggtgggacaaggcagaggatgataggatataaatttgaagagatgatgaggaaggttgtaggacatttcaaatggtgttttaaacagcgttattaaaaggtggtgtaaaacaaaaagcaaaggttgacaattggatttcgtgagatggaggttttcaatgttctcaacaagagcaactataatggcaatgtgagaacaaaagcctctttgaagtggcttagggaaaaattatggaatgtgaggaagtggaaatttcaagtaaatacaagtttgttgggtgttttttcagtccgctatgaagattagcaaagaaatgcaccagtagccagagggtttgtgatacgtaggtagagatttttttttctttttcttttgagacagagtctcactctgtctcccaggctggagtgaaatggcacaatctcgacttactgcaacctccacctcccgggttcaagtgattctcctgcctcagcctcctgagtagctgggattataggtgcctgccaccacacccagctaatttttgtatttttagtagtcacggggttttgccaggttggccaagctggtctcgaactcctgtccccaggtgatccacctgcctcaacctccccaagtgctgggattacaggcatgagccaccatgcctggtccaggtagagactttttttaagatggaagagatgatggcatattgatatgctaatgaattattctaaagaatgagagaaactattgatgcaggggagagaaatataattacaagagcaaaggtcttgaatagatgtgagagataggaacaaggagaaaggaaagcaagaggtttttggttttgtgggttgataaatcgatcatgggaaaacaccttagttttctaatggcatctcttggtaaaataggtgagatcctgcattgagattgaaatagggaaagtggtattggaagtttgagaaaagagggtaagatgtgaaatattcaacttggactgaattaaccaagaagtgggctaaggacatgaatagacaattctcaaaagaagatatacaaatagccaacaagcatgtgaaaaaatgctcaacatcagtagtgatcagggaaatgcaaatcgaaaccacagtgtaataccaccttactcctgcaagaatggccataatcaaaaactcaaaaaataatagatgttggcatggatgtggtgaaaagggaacacttctacactgctggtgggaatgtaaactagtacaaccactatggaaaacagtgtggatattccttaaagaactaaaagtagagctaccattcgatccagcaatcccactactgggtatctacccagaggaaaagaagtcattatacgaaaaagatacttgcacacacattttaatagcagcacaattcacaattgcaaaaatacggaacccacccaaatgtccatcattcaacgagtggataaaaaaaattgtggtatatatatcatgcaatactactcggccatataaaataatttaataatggcattcacagcaacctggatggaattggagaccattattctaagtgaagtaactcagaaatggaaaagcaaacatcatatgttgtcactcataagtgggagctaagctatgtggatgcaaagacataagaatgatacagagggctttggggacctgggggagagggtgagaggggagcaaaggataaaagactacacattgggtacagtgtacactgctctggtgatgggtacactaaaatctcagaaatcaccactaaagaacttaacaccaaacaccacctgttccccaaaaacctattgaaatcataaaaaatattttaaaaattaactagaaaaatacagtaaaaatgcagtgatgagtgaacacatcatgaagattgtgttcacagagcacagatacaaagccaaaagatggttggatttaaccagagttgtggttgttctaggcaaggcaatagcaggaagagcaaaggaggatttcagtggtgggcaggctaggagggataggaggacttaaggtgagtgaggaacagtgaaacagtggtggggctaatggatcagatatcctgttgggctgaagaattattggagtccaaataccagtgtgaatgatctggaaagttaaaaggtagtggttggagagagagatttttcaaacaaagatttctgaggtggttcaaggagtagatggtctatgtggactgtgacaatgtcagtggtatagaaggtgacagagggaattcctagtcattaaatgaatgaggaggtgaaaccaaggggacagtaaatgcttgcaacaaggagcaggagttggataaactgattgcacatgtttgaaaggagctggatatgtgcgggaggtggactctgttcctcaccagttatcaaatgatgaagatatccccaaatatgatatctatccactggaaataacctttgagtttttgacctttagtaaaagggagaaggataacattgttggcagaaatgtggatggtgataggggaaaccagaatgggaaaccatttgttgaatttttttacgagactcaggtatagttatttaagtatgtcataagaaattttggcagttccaagaagtcacattgtcagatgtcaaatggtctggtttaatgactagcttgttgtcctcttaaagataaccttaggtaggataggcctaaataagactaagaaaattccaggtcttggtagctggcctcattctggctctaaaattcttttgaagagtgggtgtggtggggaagggtcagttggacaagcaggaagcaaagaagcacatatagtctgcagttttgtttttcgcattttataaatttcctcctttcttctagattaaataaggacagcctatcactaacaatctcaaaataaaattgtatatgtcctgaagaacctccaaaactttcaatagccaagaaccatatgaagcaggatccaagtaccacatgaagcaggatccaagtcttatacacaagtaaataggtttgaggaaaattttcagaagagcatatcacagaacatatttggaaaatataatagaaggaaaataatatagaactaaaagttcctattatgtaattactttatatatataagtagcttttgcattcaagacaaataacattactggaaaaatttctctcttggaagacatttccacattccaattttcacattaaaaatgacataatgaaagtgccccaagttgtattgaaatgaccacaagcaccatacttaggtataacaggagttcacctgggactcactaatccagttgtttacagccggactctgttctaattgattagcacctgtgtctcactagttgttaatgtttttattaacactcttgctagaatatgtatttacttgtcaagtagcaaaaattatgtacagaaccagaacaaaacacataaaaattagtttatctggtgtggttcttatccatgtcattcttgtccctctctcttccctcccttttttttccctttgcagcaaattgtaaaggtgactttatcattaccttcttcagggtcacagagttcaaaatgactttcctgagggagatttttgacaggcatctttgaaaagatgtctagggagacttggaactactggatgacattttgatgtcatggaaattgaacaagagtaaataaatgtattggcaatattagaaagactgttaaaagtcatttcttcagtgtaaatttttgtgaaggaagaataaatattgaccattaagttatatcactgtaatacaaggtctgtttgttaagcactgtgtgtggaaaatgatatgatcctggtaaacccagaactgagggggttgacctgaaagttatttcataattgtatttattagtaatgagttacaaaggtacatgactttttaataaagaacttgacctggtaaagagaatgggtttcagtttttatgaatcttaaacaaaaaaagaaaagaaaagaaagccggtggtgaaaagaaccatgttttctcagttaaggctactcagaggataacatggttgctaccgcctggcacaataaatgcaattttggtgcaatgttggggaaagtgtaaaaatactaataatagcctacattcttcagcacattctatgtgcctgtactcttttattcattctacatgtaggaactcatttaatcctcacaaccaccctataaagaaggaaccattaatatgtccatttttatagatgaagagactgaggttaagtaacttgctcaaggacacagtacttgaaaacggccgcgtgtggtttctactgcagacagtctgatcccagaccctatactctaataaagcttaagatcatactgtggttgcacttagtaagccatatttcactgccctaatctacctatgactcataacatatatttgtgaattcagatgattgtaccatagatccccacctggccgccagagggaaataagaatctcttacaccccagttatttcttctcagggtaagccttcacttgtgctcagtgttttctttccagcattcttaccttgttgctgtggtttctgctgccacactcttaggaagttactgctgtcaggcgtaaacatgttttcaatgcaaccactttaatgctcctactctgccttcagtaaagacatagcttcctgtaattccccagagttcaactagatcaaccagtgactttcaggagtcctggcacatgccaagtttacaatgccagtatctcagtctgaagcatctataatttgggtcattttactgtattcagaacttcactaggaacaaagcaaaagtacttacctttgactcaccagaagtgtcctcagaatcaagacaggacctacagcttaattctaattactaccctaaaagagacagtatgcatacaacgcttaatgtggcggttattacggctgaaaatcttggatatttttattgtaagtactgatttacaggtatttctccctcccaagactctgagatactgcagagctggaattgtcatgttcacctttgtatccgcagaatccagcacataatagatgttcggtaaatgtttgctttgtgaacaggtgatggcataaaggccacggaaaggaacagctctttgccatcacaagttccattttggacttgtccagtttaagatggtacaacattcaaatacacatgtgctttaagtaattagaggttaggtgatataaatttgataagagcttagaactgcagatacagacactcatattgtctataaagaattcgaagtggaagctgtaattcaaagtagatcttaaagaaaaaagcagtgaaggatgaggaaacaaagaatgacctttcaggagcacacacaaagtttggaagaggaatgtgatccagcagagaagcattcagtgaggaagaagcaattcaagagcatgcatatataagaagctaagaaaaagtaagtttcaaaaagtgaccagtaaaaatacaaacaaaacacataaccagtaagcaaggtcagatatataagagaggccaagaaaaaaacagggagagaaggctgatgaatctggaaaaaaagttattagagacctttagaagtacattttcaatggagtagtttatgtttttcacatttgtgacttatttatattgattgcaatgacttttataacaaaaaatattgcccaatacctagccttttattttgtaagatatactcgagaaatttaccaattagaaattatcatttgatcctgagttcactggaatcattttagaaatttctcctgactagtactgtgtagagaagacattccttagttggttgttggattttctataaatactttacacagctcaaagatatatctgattaaaacctctttaatccttcagtgaccacattaaaagctatactgagtgctttctttcaggaaacagaacaccagatcattgaagatttaattttaattcctaagattcagtttacttcctaagattttaaactcttcctaggcatttaatttcaagaatataacttgagtctacttcaaattattgagatttaagatctgtaaataactaatatttctgattgagtctagtaacaataatcatttgtttctgtcagttattctgttcttctagaaatcacaaactatttaaatttagctaactctcagaggatctatgggctagattgcaaaacaaaacaaaaaacaaaaacaacaacaacaaaacaaacaacaagaaaatacccaaggaactaaaagtctatagttttttgttttttgttcttttgggagagtctcactctgtcgccaggctggagtacagtggtgcaatctctacttactgcaacctccaccttcccgggttcacgtgattcttgtgcctcagcctcccgagtagttgggactacaggtgtgtgccaccatgcccagctaatttttgtatttttagtagagactgggtttttccattggccaggctggtcttggacttctggcctcaagtaattcgccccccaaagtgctggaattacacagttttaaagcaaacaaaactaccttttctcaatgataggaaaatatatgaaactcaatactatatgtttatcaggcccaaccattaaaaaattatttcataaataacacccccagctctttttttcttctatcaaagcttcactagctaccagtgccctcacattctctttcttctccatcctattaggattaggattggaaaagatctgtgatccactcataactaagtatgaatttactacaaaccctccctaaagtgtttacattttaaggatctttcttttttttaattcattattattatactttaggttttagggtacaggtgcacaaggtgcaggttagttacatatgtatacatgtgacatgctggtgcgctgcacccactaactcgtcatctagcattaggtatatctcccaatgctatccctcccccctcccccaaccccacaacagtccccagagtgtgatgttccccttcctatgtccatgtgttctcattgttcaattcccacctatgagtgagaatatgcggtgtttggttttgtgttcttgcgatagtttactgagaatgatgatttccaatttcatccatgtccctacaaacgacgtgaactcatcattttttatggccgcatagtattccatggtgtatatgtgccacattttcttaatccagtctatcattgttggacatttgggttggttccaagtctttgctattgtgaataatgccacaataaacatatatgtgcatgtgtcttcatagcagcatgatttatagtcgtttgggtatatacccagtaatgggatggctgggtcaaatggtatttctagatctagatccctgaggaattgccacactgtcttccacaatggttgaactagtttacagtcccaccaacagcgtaaaagtgttcctatttctccacatcctctccagcacctgttgtttcctgactttttaatgatcgccattgtaactggtgtgagatggtatctcactgtggttttgatttgcatttctctgatagccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccatcttgaattgatttttgtataaagtgtaaggaagggatccagtttcagctttctacatatggctagccagttttcccagcaccatttattaaatagggaatcctttccccattgcttgtttttctcaggtttgtcaaagatcagatagttgtagataggtggcgttatttctgagggctctgttctgttccattgatctatatgtctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaaatagttttttccaattctgtgaagaaaggcattggtagcttgatggggatggcgttgaatctataaattaccttgggcagtatagccattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgatgcaattgtgaatgggagttcactcatgatttggttctctgtttgtctgttgttggtgtataagaaggcttgtgatttttgtacattgattttgtatcctgagaatttgctgaagttgcctatcagcttaaggagattttgggctgagacaatggggttttctagatatacaatcatgtcgtctgcaaacagggacaatttgacttcctcttttcctaattgattaccctttatttccttctcctgcctaattgccctggccagaacttccaacactatgttgaataggagtggtgagagagggcatccctgtcttgtgcccgttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgccgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactccttttggttggtaagctattgattattgccacaatttcaggtcctgttattggtctattcagagattcaacttcttcctggtttagtcttgggagagtgtatgtgtcaaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtatctctatttccttcagttctgctctgattttagtcatttcttgccttctgctagcttttgaatgtgtttgctcttgcttttctagttcttttaattgtgatgttagggtgtcaattttgggtctttcctgctttctgttgtgggcatttagtgctataaatttccctctacacactgctttgaatgcgtcccagagattctggtatgttgtgtctttgttctcattgatttcaaagaacatctttatttctgccttcattttgttattggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctagtttgattgcactgtggatctttctaatttatttattcacccaggaaatatttcttgagttttcagcacagtactagtttctatgaaaaaacaaagtgagttatgtatgaagcctaccttttaaagtggcatgaaatgatgcaattaactatgatctcataaaaaagtgatatgtattatgagaggtacaggttttctggagtttaggaaaaagagatggccatctcaaggtcagagtgggaaggtgttcaagaagtggtatttgataaggtaccacagcataatgattaaatacagaagctctggaaccagccttgcctgcgtttaaattctggctatcacttaccacatgatctcgggcatgttattcagtaagctgccactcagttacctctatgaaatcaaacagtggtatatactttatggatctcttgtgagtattaaatgtgttatgacatgtaaagcacttgaaacacaatataagttttccacaaaggttagctattattctttagactgggctttgaaaaacaggataaataggatttagacatgcaaaaatgagtcagaaattaaatttcagaaggtgcaaagattaaaatataaaaaggttaaaccataaaattattagaagaaatcaggaagaaatcccagggtggggaaggctttcctaggtatgacttcagacccaaaagctataaatatacaattttaaaagatgcattaaaaaaacataaaaaaatacaattttaaaagatgcattaaaaataacataaacaaaaaacacagtctcaacgagatatttttacaactatgctcattgcagcattattcacaagagccatgaggtcaaaacagcccaaatgtccatcaacagatgaataaagaaaatgtgatatatacatacaatggaacattatttagccttaaaaaaagaaatcttgttaaatgctgcaacatggataaatcttgaggacattatgctgagtgaaataagctagacataaaaaagacaaatactgtatgagtctattaatgcaagatatgtacagcagtcaaaatcatggaaacagaaagttaaatgatgggtgccagaggctgagggaagggggaataggcagttgttgtttgatggggatagagtttcagttttgggagatgaaaaaattctaaagatctgttatacaaccatgtgaatatagttaacactaatgaactgtgcacttaaaaatgactaagagggtgaactatatatttttttaccataataaaagataaaaaagttttttttaaagtaaactgaataatgctgaaggtgaggtgaaaaactttttttaataattggttttcctcataatcccatttcttttccctttactctggtgtttaaagcttttatgccatcaaacacttcagaaaacccaccgtctttccttttttttttttttttttttgagacggagtcttgatctgtcgcccaggctggagtgcagtggcgccatcttggcttactgcaagcaccacctcctgcgttcacgccattctcctgcctcagcctcctgagtagctgggaccacaggcacccgccaccacgcccagctaattttttgtagttttagtagagacggggtttcaccttgttagtcaggatggtctcgatctcctgacctcgtgatccacctgcctcagcctcccaaagtgctgggattataggcgtgagccaccgcgcccggccccctaccttctttcctttatgccattaggagaatgtgccacttgtaattacttctcttaccatcccagtcattcattcatttaatatgtatcaagcacatactgtgtgctagatcctgttctagacagtgtggatttagcagtgaacagaattcctacactcaacgacctatattctaatggagggggcacattaaacaacaagtaaacatatagtctgtctgatggtgtcaagggctccagaataaaagatgagcggggcaaggaatgccaggacataagtaggttactattgtgcacagtgcaatcaagggaagcatcatgtaagctgataacttgagtaaatacctgaataaaatggaccatgaaggtggatatccagggaaagtgtgtttcacatagagggaccaccaagggcaaaggcccagaggcaggaacagcttgatgggtttgagggaaagcaaggaggcccatgtagctggaggagagtgaacggacggggagagaaatggaagttgtgtggggagttggtgctaactttttgggtcattatatagaccaagctgttcaacctgcgacctgcagtctgcatgcagcccaggacagctttgaatgtggcccaacacaaattcgtaaactttcttaaaatattatgatttatttatttttttatttttatttttttagctcatcagctttcgttagtgtattttatgtgtggccccagacaattcttcttcctgtgtggcccagggaagccaaaagattggacacccctgaatagactttggtttttactgtgagcaagatgagagccattggggatgctgagcagagtggcacgatgtaacttatgatttagatggtttctctggcagcagggtaggtaataagagggagaagatagaagtagaaagatgagtcaggagagaggtggtggtggctgagaccagatggtattgtcggggctcaaaaatgataccccaacatgaaggcctcagaagcaaacatctatctctatctgaccttttcctgccctcctggctctggcttctcattctccctgaggctagccatagaaagtagaattactcttccccaaggcagttcatagaaaccagaactccttttccccaaagctaaccataaaaccataagtatttttaaatattactctaactttccctccacctttttgtgtaaaaactggccctaaaggaattatctgacctttcttgtttgattttaggccataagaccgccattccagagagggccctgccccatacccaggaggaaggaatgctgcacagagcggccaagaaaaatctgaacagacaagccttgcagggtttccccattcaatctattagaattagatcatatcctttttgtccaatcacatttcttcacagctgtttatactttgttgaatctaagcataaaaatggatagtttcccctgtatctttgggtcttcattctgaaagctccaatgtcacataaaactatgatcgaggacatttatgtgccttttctcctattaatctgccttttgtctgctggttttcagcagccttcagagggcaaagaagtcttctcttcaccttactatagcaatggaggtgtgaaaagtggtcagattctaggtacattgtgaaggctggtggagatttctaatagattggatgtgaagtgtaggaaaaagaacagagtcaaaaatgagtctggagtttttgacccaaacagctgccagaatggagttactgtatactgagacagggaatgctacaagagaagaagatttgctggaatgatattaggagcttagtttgggacatgctaaatcagacatgcaaagttgggtcaagtaggcaattagatatatgagttttacgctcagtggacagatcaaagctgggaataaaagttaggacatcatcagcatagagatggtatttaaagccagtagactagatgagaccagctagagagtaaatgtaattaagaaagagttctgtggaaggagccctggggtgctttagggtggggacatagggaagaagccgcagacagggaagaaaagccagtgccagtgatgtgggagataattgttttctcagaaaatatccctttttgaatgactctgattatcaaataactttttgtttggtcaatgctaatatatatttctacagtgtttttaatcagttgccataatgctgtttactcctggttacatgagctgtgttgatcctggatcactcttgaatggtaaggccaattcactggatagagtgcccacagtgttttccctatagatgctttaaatgtctttttctttttggaatggaacacatgttattatataggcttacatatgaatagttaaaataaggtaatttatcaagaagttttttaaaaaatatgtgaccgtatttagagatgcagtgtttgttttttaataggatgcaaatcaactgtctataatgttttatctcaatgaaaatcatgtataagaatcccagtcatactatatttgttacctaaccttccttttcattcattactcatcctcagcaatcaataacagcctctctgcagcctcttaaaatgcagtgaacctattgatttcacttgttattgcatctccctcccctgccgctggctacaaattactcttaagtcagaaaaggtggtaagatagtaagactatatatagactgtcctcttctgttctctccaaaaagctttttttttctatttaactaggaagtgataaaagcaaagctcaggaccagctgtaagttatatgtcctacagttgaaatcttctgtactttaaaaccaaacattttgacttgctctatactattaattaagcacaggaagcaatgcttactgtgatttatcttttcctaaagatgcattacagaagatattcaaatataatatgtcacttaatggaagtagttgtttcaactccaaattataaaatatccatgttagttgtttttatgtctctattctaatttatacttatactttaagttctagggtacatgtgcacaatgtgcaggtttgttacacatgtatacatgcaccatgtgggtgtgctgcacccattaactcgtcatttacattaggtatatctcataatgctatccctcctcctccccccaccccatgacaggccccaatgtgtgatgttccccttcccgtgtccaagtgttctcattattcaattcccacctatgagtgagaacatgcagtgtttggttttttgtccttgtgctagtttgctgagaatgatggtttccagcttcattcatgtccctacaaaggacatgaactcatcctttttatggctgcatagtattccatttatggctgcatagtattccatggtgtatatgtgccacattttcttaatccagtctatcattgttggacatttgggttggttccaagtctttgctattgtgaatagtgctgcaataaacatacgtgtccatgtgtctttatagcagcatgatttataatcctttgggtatatacccagtaatgggatggctgggtaaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcgcctttctaactggtgtgagatggtatctcattttggttttgatttgcatttctctgatggccagtgatgatgagcattttttcatgtgtctgttggctgcataaatgtcttcttttgagaagtgtctattcatatcctttgcccactttgtaatggggttgttttattcttgcaaatttgagttctttgtagattctggatattagccctttgacacatgagtagattgcaaaaattttctcccattctgtaggttgcctgttcactctgatggtagtttcttttgctgtacagaagctctttagtgtaattagatcccatttgtcaattttggcttttgttgccattgcttttggtgtttcagacgtgaagtccttgcccatgcctatgtcctgaatggtattgcctaggttttcttctagggtttttatggctttaggtctaacatgtaagtctttaatccatcttgaattaatttttgtataaggtgtaaggaaggtatccagtttcagctttctacatatggcaagccagttttcccagcaccgtttattaaatacggaatcctttccccatttcttgtttttgtcaggtttgtcaaagatcagatggttgtagatgtgtggtattatttctgagagctctattctgttccattggtctatatctctcttttggtaccaataccaggctgttttggttactgtagccttgtagtatagtttgaagtcaggtagcgtgatgcctccagctttgttcttttggcttaggattgtcttggcaatgtgggctcttttttggttccataggaactttaaagtagttttttccaattctgtgaagaaagtcgttggtagcttgatggggatggcattgaatctataaattaccttgggcagtatggccattttcacaatattgattcttcctatccatgagcatggaatgttcttccatttgtttgtatcctcttttatttcgttgagcagtggtttatagttctccttgaagaggtccttcacatcccttgtaagttggattcctaggtattttattctctttgatgcaattgtgaatgggagttcactcatgatttggttctctgtttgtctgttgttggtgtataagaaggcttgggatttttgcacattgattttgtatcctgagaacttgctgaagttgcctatcagcttaaggagattttgggctgagacgatggggttttctaaatatacaatcatgtcacctgcaaacatggacaatttgacttcctcttttcctaattgattaccctttatttctttctcctgcctaattgccctggccagaacttccaacactatgttgaataggagtggtgagagagggcatctctgtcttctgcccgttttcaaagggaatgcttccagtttttgcccattcagtgtgatattggctgtgggtttgtcatagatagctcttattattttgaggtacgtcccatcaatacctaatttattgagtgtttgtagcatgaagggctgttgaattttgtcaaaggccttttctgcatctattgagatcatcatgtggtttttgtctttggttctgtttatatgctggattccatttattgatttgcgtatgttgaaccagccttgcatcccagggatgaagcccacttgatcatggtggataagctttttgatgtgccactggattcggtttgctagtattttattgaggatttttgcatcaatgttaatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaatttggctgtgaatccatctggtcctggactccttttggttggtaagctattgattattgccacaatttcagctcctgttattggtctattcagcgattcaacttcttcctggtttagtcttgggagagtgtatgtgttgaggaatttatcaatttcttctagattttctagtttatttgtgtagaggtgtttatatattctctgatggtattttgtatttctgtgggatcggtggtgatatcccctttatcattttttattgcatctatttgattcttctctctttttttctttattagtcttgctagcggtctatcaatattgttgatcctttcaaaaaaccagctcctggattcattgattttttgaagggttttttgtttctctatatctgtctccttcagttctgctctgatcttagttacttcttgccttctgctagcttttgaatgtgtttgctcttgcttctctagttcttttaattgtgatgttagggtgtcaattttagatctttcctgctttctcttgtgggcatttagtgctgtaaatttccctctacacactgttttaaatatgtcccagagattctggtatgttgtgtctttgttctcattggtttcaaagaacatctttatttctgccttcatttcgttatgcacccagtagtcattcaggagcaggttgttcagttcccatgtagttgaatggttttgagtgagtttcttaatcctgagttgtagtttgattgcactgtgatctgagagacagtttgttataatttctgttcttttacatttgctgaggagtgctttacttccaactatgtggtcaattttggaataagtgtgatgtgatgctgagaagaatgtatattctgttgatttggggtggagagttctgtagatgtctattaggtccacttggtgcagagctgagttcaactcctggatatccttgttaactttgtgtctcgttgatctgtctaatgttgacagtggggggttaaagtctcccattattattgtgtgggaatctaagtctctttgtaggtctctaaggacttgctttatgaatctgggtgctcctgtattgagtgcatatatatttaggatagttcggtcttcttgttgaattgatacctttaccattatgtaatgaccttctttgtctcttttgatctttgttggtttaaagtctgttttatcagagactaggatgcaacccctgttttttttgttttccatttgcttggtagatcttcctccatccctttattttgagcctatgtttgtctctgcacatgaaatgggtctcctgaatatggcacactgatggatcttgactctttatccaatttgccagtctgtgtcttttaattggagcatttagcccatttacatttaaggttaatattgttatgcgtgaatttgatcctgtcattgtgatgttagctggttattttgctcattagttgatgcagtttcttcctagcatcaatggtctttacaattttgcatgtttttgcagtggctggtactggttgttcctttccatgtgtagtgcttccttcaggagctcttgtagggcaggcctggtggtgactttatactattaattaagcacaggaaggaatgcttactgtgatttatgcttactgtgatttatcttttcctaaagttgcattacagaagatattcaaatacaatatatcatttaatagaagtagttgtttcaactccaaattataacatatccatgttagttgtttttatatctctattctctaatttagggaatagactgacactgtcagctcatactgccaaatatccctttttttcaagtcaggattttttttttttttttttttagatggagtcttgctctgtcaccaaggctggagtgcagtggcacgatctcagctcactgcaacatccgcctcccaggttcaagcgattctcctgcctcagccccctgagtagctgggattacaggcacacgccaccacgcccagctaacttttatatttttagtagagatggggtttcaccttggtcagccttgtctcaaactcctgacctcatgatccgcctgtctggacctcccaaagtgatgggattataggcgtgagccactgctcctggccaggatttttaagtgtagtagaaactagtataagcactaatgcttcagatttctcagacttgccttcatgttttggtttgggatatttggggatggggggagtcatattgtaacacctccaagcaactgaaatccaccacttacggtgcaaaatcattatgcctgagtttccttggtgctgtatgcaggcaaccacttccatttattggagctggcaaagaatctttgctattaaatgggaaaaggtcacagttgtaaatcaaggagcagtaagtcttttaggtgtgtgtagggcagttggtagggggagtagcaaaggggggtgaatgggagaaatttgtaatggcttctcttaacaccactcacacacatcaaaagcatcataatacacatttctatttggacatattctatttttaaattaataatcatgcgctatccttccttcccctaaaccagctggaaagcttagtagttatttacagggcacctcagtgaaattagcagtagactgaaacatgactgtgccactgatatgtgcaagttcttcataaaacctcattaccagggcctggagataatgcagttgtagtaaaacaaaacaatttgtcaaatgtgatctgaaatcctaaaggggattttccagcagctatattttgttaatgctggtgctgactgagttgatcagaatatgcaaactatatctctaaactggtcattatttacatgcttcagctgcactcactaattaaatccctggagttatttctgacacctaccacctgggacctgtttccagacaaaggctttcctgtggcacacagccgagataggtctgggcccttctgtttcatgtcagaataaatatttcagctctgaggctttttgtttaactggattcagtggttctcttgatttgcgttatttcttttaccaggaatcagtttactaagctagctgttgtttggatgggctaattaaaacctgctcagtgtgtgtgcaggcagcctctaagccaaatattgccctacccagaacttggataaaaacatggcatttgtatttattagaacagatgagccttgtgacttacccctagctaatctgactctagtgtttgcttttttcattgtatgcccttctgaatgtacatcccaccttaaaaagtgaggagtgcccacagttcccagcccttgagaaatcccatggaaaggagagatgtggcctgggtgttcctgagaacagtcctgctgtcaacttcatgggtggcaggtcaccaaaaggtgtgtctatatcacatatgatatttggtctcatgagacacttcggaattagttatttatactatttttatcaaggtttcatgcaaagtggataaccagttatagaagctttgctgatactgccgttcttttgagtggaggcattctatctaggcaactggtaaaaaaaaatccaaatattgtttcagatagttaaatgcattagactatgatctccatctacatcaaacatttattcatttctgtcatattgcatggtcctatattctaggagaggcctatcatattcccctaaggagcttgtagtcttgtgaatgaaacagatatgcaaacaaatatttccagtacaatgtgataaattgtctctcagatttctaaattgggtaagtatgtgtatgatgatgccctaaccaagatatggaacgctgaagaaggaacaggttgaaggaggagagatggagggagatgttaaattggatttcacacgctcacaggacattcaggctgaagtttctagtaggcagttctaaatgcggcttataagatagatgaggaactccttgccagaaaatattatttcatcatgttcctattagagggcgaggcatggtacaaatatattttgataggagaggtgaataaacaaaagattgagagtggaggctaccctggtaggacatcaggttggggaaaagtaagcttttcaagagcagctttcctaattctcaattttatttagagtgtgctctgattataacaatatgtggatggtgtggagactttctgagagattaaccagtgaataagtctttaagagaagaatgcttgctcatcgactgggtattcatttggagaagattgtgttttccagtttcttagaagataatatttggagtattatctgaacaaaacataatgcacttctttttttttcttcttctttatgcttatcttgccaagtcatgaaagagccaatttgaaatatttcaactgatatttctagctagaaatgaatggatttttgaaacatttcattactgtacttagaaagtgtaactgtggatagagatgattcatagtcttctttttcggaggtggatttttagaaaaaagagtggggtgtgtctccagttatcttaagggtgaaattctcccaaatgatctcaaactaaagaacattttaaaatcagtgccatggtgaaatttgaagagggaagaaaatgtcacagaatacaataaatagaaaattatcagaactccaaggaatttgagggagattagatatagagaagtgtcatatttttgtttagaccaattatggagtctgagcatcttgacacaattgattatgttgattggctcttcagtagcattttcatttcttcacaaaacttatccaaaaaccttcaagtttcgagtacctagctgaataaactacctactttttggtgccttaccaagggtccacagtgttctattttctgaagtaaatgccaacctcagaagtaagtgcccattatgcctattgtattacaatttttctaagcccagaattgtcgtgggaggttgaaaacattccagtggtcaaagaaagagagcagttagctcatttaaaccctcttccatatcccattctgtccttggtgaaaaggtgccagcctgtttttataagaataaatctatttgacagacctggggcagttcttgtctgctgctaaggtttccactacaaatacaaggaaaaagtattgccgaggttgagtagggaaatacaggggaaaaacagagtttttgcatcctaaaataaccttggaatctgtaaagcacctgctttactccaatgaagtacctaaaatttgagtttacactagaggttctagaaaatttcccctattaccctaacctgattgaatatagctttaaaagcttaaaattaataacagcaagatacttttaaaagcttaaaattaataacagcaagccaatgactccttaaaaaaaaagaatggggtatacatcttgacattatttaattcagctgtcaatcttaaaagataaatttgcattcagactgtgtatgcatgtgttagcctcctcacagattacgtgctggcaaccccattctgtgcagggactccttaggaaggccatctttatagaattctccatggtggatcacaaagagaggatttgcatttacacataaaagaccataacgcatcaattttagaaagagcttctttcattttacaaataaattggccctaaataagaatatttcatgtagaaatcttgaaatgtattttgtttattcaatagtaataatatcaaatggttttcatatgttctctcttctttctatgaacatgaaaggtagcatagatatttttacaaatggaattccaatattattgctttggaatttttttaaatttgtgtttaagatactataaactacaattgatgataaagatcatttaattagtttaggactagagttaattagcattttaatgaaatggaatcatatctctttaggaattttgtagcatttcaggattatggatattttttcttgtagtataaatatttattatacactttccaattattatgaagctgatataaaatttaaacctaaaaataatgtttctaacaatatcacttaatagtcagaaaaaattttgagaaaacaaattaaccatcttacttgtaggaagctgatgacaagaatcgaagcagaactgcacattttccaaggtatgttccttggcatctcggcattccaggcattctggagggaaaaacatttgggatatgttgcataccatgaccttctttggaattcactatttgacattatattaaaggctttgtaagactgatagatagtttaactggctttaactttgagaacttgttatttccccaacttattgaggcatgaacccttttactgaataacttctatctatattcagctgaattggctatccacagaaaccacttcgggaaacattgaactagaggataagattatttgattaatttggttaattattttagataatactatagatgatgctcaaaattgcaacccaaattaagatacttgtggtcattctgggtttgctgttgttgttgttattgtttcttgttaggaacaaggtctcattctgtcacccagcctggggtgcagtggcataatcatagctcattgcagtctcaaactcctgggttcaagtgattctcccacctcaactccccgagtagctgggactataggcatgcgccaccatgcctggctgatttaaaaaatttttttttgtaaagatagggtctcactatgttgtccaggttggtctcgaactccagatctcaagtgatcctcctatcttggcttgcaaaagtgctgaaattacaggcatgagtcaacatgtctggccaccaattcttttttaactactaaaataaattctggacactttttggtgaggtcaacagctggtttttagctactacaaagatggaaatttgttcagaagtaagatagaatcaaagtaccatttagcagtaagagttttgtatatagaacaaactttcaaataaataaatttgagtgagtttgtgttacctgtcactgctgcatcatcagtcagttagctcagggcatttactgcatgatatatgtccactagggtcacagtaatgcattaacaagatgatatgtcatataattagttggcctttttctctaaaatcataaacgaagctaactataaaatgttgtgctgctgggcatggtggctcatgcctgtaataccaacactttgggaagccaaggcagcggatcaccaggtcaggagatcgagaccatcctgaccaacatggtgaaaaaccccctctctactaaaaatacaaaaaattacctgagtgtggtggcgtgtgcctgtaatcctagctactcaggaggctgaggcatgagaatcacttgaacccaggaggtggaggttgcagtgagccaagatcgtgccactgcactccagcctagcgacagagagagactccacctcaaaaaaaaaaaaaaaaagttgtactaagcctagaaaaaacaagacatctcctaactcaattttatactctaatatatactggcatttcaaaatatttgaacatatatttaagtcctgaaccctcgtgtaggcaaattggttatttatttctacaccaggacatctaaaataataccctgtttcctccctttaaacttataagtaattgagaaataagacataggagacagtcaagtagcaagaagcaaaataacagctttacttctaataaagctgattgaggaaactgaccttaacataagcaaggctcatgtttcagagaagcatttcagagaaggggaaataggaatgtcccttaaatagttgctaaaccttatcaactaactagggaaatgcaagtgaaatcaccataagatactgttttgcccataccatagaattaattggaagtgctccttcctcttgtattttttggaaaagtttgtgaagaattggttggcattaattcttcattgcatgtttgatagaattcactgatgaatccatctgggtcagggtttttctttatgggaagcttttgattactaattcaatctctatacttgttataggtctgttgggatcttctgtttcttcttgagtcaattttatcagtttgtgtttttttaggaacttctaagtttcatctacattatctaattaatctaatttattggtatacattaaattgttcatagtattttcttattatccttttattttattgatataaagttggtaatgatgtcccttcctgtattcccaatcttggtaatctgagtcttctcccctttttttcttcatcaatctagctaaagtttggtcaactttggtgatcttttttaagaacctacttttgtttttgttgtatctctatttttgtatcatttatttatgctctaatctttattattttctttcttctttggggtttagtttgctcttattttctagtttcttagggtggtagcttaggttttttatttgagagctttcttctttaatataggtgtttatagctgtaaaaacactttagctgtatcccataagttttgggtgtatgttcatttccactcatctcaaaatattttctaatttcccttgtgatttctttttttgatacattggttatttaggattgtgttcatgacttctttatatattgttacattttccaaatttattctgctattgatttctaatttcattcgtttgtggtcagagaacatacttagtatgtttctaacccttttaaatttatttaagttttgttttatagtctaacctggagaatgtcctgtgtatacctgataagaatgtataatctgtctttattgggtggagtgttctatacatgtctgttaggtctagtggttttctagtattgttcaagtcttttatttatttatttcctttttaatcttctgcctcgttctatctattagtggaagtgagattttgaagttgtcatctattattgttgaactatctattttcctctttaattctgttagtttttgcctcacgtattttagagctctgttgttatgtgcatatatatttatctccctgatgtattcacccttttattgttttaaaatatccttttttgtctctagtaataatttgtctgaagtatattttttctgatattcgtaaagctactctagttctcttctggttttttttatagcatactttactctttactcttaacatatttgtgccattggatctaaagtattttctagaaagcacatagttggataagatttaaaaatctattttgctaatctctgcctttttattagaatttttaattcatttatgtttaaggtaattacctacaagttaaaagttatgtttactattttactatttgttttttatatgtcttatgtattttgttcctttatcactccattattgcatacttttgtgtagctagatgttttctgttttaattccattttttttttttttacccttagttactttttgaatgactgcttggagactgcaagtaacaccttagcttcaaaatatctagttcatattaattctaaactaatttcgattttaaacaaagactttgctttaatataccactattccctccccattctctgtgctgttgtcaaccaaattatatgcttatacattataatgtcatcaataatttcataattatttctttatgcatttattttttaaattagaagaaaaaagttaacaaataagatcaaattagaacaaaatataattctttttaaattaaaatcctgcttctgtaaaaaaatacatttctattgtctattatatttacttaattattggttacatttgtttatatattcatgtggattcaaatcactgtttagcatccttgtatttcactttgaaggattctattatgaaatcctttttttgttcagggcttcaagtgacaacttttctcagtttttatctgaataacttacttaatttctccttcttttttttttttttttttttttttgagatggagtctcgctctgtcacccaggctggagtgcagtggcacaatcttcgctcactgcaagctccacctcctgggtacacaccattctcctgcctcagcctcccgagtagctgggactacaggcacctgccaccatgaccagctaatttttttgtatttttagtagagatggggtttcactgtgttagccagaatggtctcgatctcctgacctcatgatccgcctgccttggcctcccaaagtgctgggattacaggcatgagccactgtgcccagcctctccttcatttttgaagcacaattttgatggatggagaattctttgttgacactcttttcatgagcacttcgatatgttgtcccactgccttctgatgtccatggtttctgatgagaaatcagctgttagtctcatttgaaactttcttgtacattatgagggtttttttttttttctcttgctgctctcaagattctctttcagtctttggcttttaacagtttgattgtatgtcttggtgtggatttcttagagtttattctacttggaatttgttgaggttctaggatgtatagattaatgtatttcatcccattttgtaagttttggccattatttcttcaaatattcttttgttcctttctctgtctcatctcctttagggaatcctatatatgttgttgcaattcatgatgttccacagattgttaaggctctgctctattaaaattttttaaaattcttttttctatctatttctcaaattaggtaatgtcaattgacctatcttcaagtttgctgattctttattatgcctcctcatatcggctgtaaaatccttctattgaatttttcatttcatttactacgcaaatataaaccagaatttctatttggtaatttggtaattttttcattgatactctccattcaatgagatatcatccttatactttcctttagttcttcagacacagttttctttgattctctaaacatactatgatagtggatttaaagtttttttcttgaaagtctaacatctgggcttacttgggggtagtttctactattagttttttatccctgtgtatgggccgtactttcctgtttctttgcatttcttattttttttcacttcttgcttgtgtagggccataaagtcatctagaggtaataaattagggccttttaaggtcttttctgcacatgcacacagtcttacacatgtatcccaggaatatgttggagcttttcaaattccactgtggacatccatttcccaaatcttccccttaagatttttggggctgggcatggtggctcatgcctgtaatcccaacaccttgggaggcccagacgggcagatcacttgaggtcaggagttcgaggctagcgtggccaacatggtgaaattagctgggcaaaattagccggacatggtggcacacacctgtagtcccagctactcaggaggctaaggcaggagaatctcttgaacctgggaggcagaggttgcagtgagccaagattgtgccactgcactcctgcctgggtgacagggcaagactccgtctcaaaaaaaaaaaaaaaaaagatttttggatagtcttttgtttggctttcacatgactgcagtgttaaataattgccactgattgcttttaaccaataccctggggatagggctttcctacctcggaagctctgaatcagatcaaataagctctggccgggtgcagtggctcatgcctgtaatcccagcactttgggaggcggaggcgggcagatcacctgaggtcgggagttcgagaccagcctgaccaacatggagaaaccccatctctactaaaaatacaaaattagctgagcgtggtggcacatgcctgtaatcccagctactcgggaggctgaggcaggagaatcacttgaacccaggaggcaaaggttgtggtcagctgagatcacgccattacactccagcctgggcaacaagagtgaaactccatctcaaaaaaaaaaaaaaaaggaagctctgcaaatgaggtttttccagtgagctcccagacaggtcagatggtgacagttttctggggatggagctcttcttcagagttccaaacctcctcatccccttttcatgatggttaggctgctaattttcacaaccactgtgaatacaaggctgctagttttcaaggttgccacagagttggctagagaggaatgagaatagggtgagttaaaacaacacaaagctcactcttcttaccaatattcagccattttcttcttaaataagcatgccttagtttgttgaaagcttcaggctaatttctagaattctgaaaaagttgtttttaacaattttttccagtgttctcatagtttcgtggaagagcagacttttggaagtgcttaccctgccattccagaagtctcttatgtataggtgctatggtttgaatgttttctcaccaaaactgaggtgttgcctgtgtgacagtatcaagaggtggggcctttaagaggtgattaggccatgagagcttctccttcatgaataggtataaggcccttataaaagatccttcatgccaggtacagtggcttgcgcttataatcccagctactcagagggctgaggcagaagaatcacttgaggccaggagtttgagaccagcctggaaaacatagtaagaatccacttctaaaaacttaaaaaaaataaataaattagcccggcatggtggcatgtgcctgtagtcccagctactcaggaggctgaggcaggatgatcctttgagttaaggagttcgtggcttcattgagctatgatcacatcactgcaccttagcctggatgacacagcaagacctcatttgtaaatgaaaaaaaaaaaaaaaaagagtctcatgcagcatttggttagcttgcccttctatcttctaccatgtgaggactcagcaagaaggccctcactagaggctggtgccttgatcttggatttcccagcctccagaactgtgagaaaattaatttctgttctttataaattacccagtcactggtattttgttatagcagcacaaataaactaagacgataggttaagcaaaatggaaattaaatataaacaaaaactctttgagattgagtttattttgattcactaggaaattaatagttccatgtattttcttataataatattttaaagatctaaagcaaataaagtaaaatcttaaaagttattaaagttgagtggtaggtacgtgaatatttgttatattttacattttctagttagggaaataataacaaacataaaaaaatctttttaaaagaaatataattaagactagttttgcaatgtagtcctaaggggaagtccaaagaaggaacccagaaaggaggtaagaggtgagggcctaaaagtgccattggctgtagtttacattcaaacattaacagatagttattaactgcttcccagatgcaatggtaagagtttgtactgcccttaagggggtactcactggtgaagggttagacaagcaagcaggtgtgcatggtatagtttcaaaagatagctaagtgctaggtgctaggggaatttccacaaaaggagggcctttaatccacagctgctgaggaagagctgggaagacctctcagaagaggtaacatcttagtcaagctttataaaggatgaataaaagttgacggccgggcgtggtggctcacgcctgtaatcccagccctttgggaggccgaggcaggaggatcacctgaggtcaagagctcaagaccagcctggccaacatggcaaaaccctttctttactaaaaatacaaaaattagctgggcacggtggtgggcgcctgtaatcccagctgctcaggaggctgaggcaggaatccctcacttgaacccaggaggcagaggttacagtgagccgagaccacgccactgcactcctgctggggaaacagagtgagactctgtctcaaaaaaaaaaaaaaagaaaattgacaaggagatagaagtgtcttggtgtcttgtgcaggggaaaatgtacttgccaaactggtttttaatggccagactcaaggaacaaggtaatgggtggtgaacaagaacaattcacataggccatgccaattgttgagtttaaatcctggaggctattgctctttggaagattttaaggtggagaaatagcaggggaagaagggcagtgagtacactggctccagagatgagggctggaatctggtgtcaaattctggctctgaaacttactaccttggatcttggacaagttacgcaaggtctctatgcattggttttctcatctgtaaaatggagataatattgtctacctcacagagctgttctcagctttaaataagctaactgatgttaatcactcagaggtatatctaaccacattgtaaatgcttagcagctactaggaaattcaagcaattttatgtaaagattggatcatgctttagaaagatggctttgacagcactgtggagcagctatgatgggagtggggagattgcaggccaagagacctttagacgattggtgcaatcaaggtgtaggcctaggagcagcagtcagcatcacctggtgtattagtccattttcacactgctgataaagacatacctgacactgggtaatttatacaggaaaaagggtttaatggacgtacagttagttagttccctgtgactggggaagcctcacaatcgtggcagaaggcaaggaggagcaagtcttaccttacatggatggcagcaggcagaaagagagaacttgtatagggaaactccttcttatagaaccatcagatcttgtgagacttattcactgtcacaagaacagcacgggaaagacctgcccccgtgatccaattacctcccaaagggtctctcccacaacacgtgggaattcaagatgcgatttgggtggcaacacagccaaaccatatcacctaggaacttgttacaagtgtagactttctggaatggggcccagcaatctaaggagcaccaaaagtccctccaggtgaatcttatgtacatctaagtttgcaaaaagagaactgaataagtttgcaaaaaaatttgcaaaaagagaactcagctggtcaagctgagaagaaatgagaaactgaataaaacctaaccatatggagggctcctcatggcctaggtactgaacattaactggtttaaacagtaaatcaaaggttatcctcattttatagataaaccaaggcttagaaaatgtggctgaagtccttgttcggcctcatggctggcaagtggtgacactaggaatcagacccaaaacctgtgctcttaaccactaggctcttctcataatcagaaagtgattgaggagaaggggaatttcagaaatcataaagtaatagaattaacaaggcttaccgggtgatttgctatggtcatggagtcattgtggactcccaagtccctggatttggataaatattgatgacattctgtgattcaggctgcatgaatgaaacggcacgtgtaaattctaagaaattttttttaacataaggagtttgaggtccctacaggaaaacagaatgtagagtccctgtagtttggacactcaggctgggaataaaaatttgggaggcctaagtatacaggtggatgcagctgaagatgtgggtgtgagtgagacaatcttaggcaagtatggcaggagaaaagaaagcgggccaagggcagaaccctggggaacaggtagaagaagaagcttctgcaaagtagacagtaaaaagaaccaaacagaggtaaaggagaaaagggaaaggacccagacatccaggagaaaatcagctcaaagtcagctcaaagagaggctgggccagcatggttgttgctgagaatctcagccttactgcaaggcagaatcaaattactatccctctcctaccacccctcccctatgaataaactgggatacatgacaccaacaacaaaaaggctctcccgggtggtagaatgttaggagagggtaccctaggcctgaggcagtcattaataaaagcttatcaggatgctgacagaatgccagtgtacgtgccctctaaaattgtaattagtgagattgtactccttaacatgcaacttggtgtaatagcagtaatcttgatgaactgtggtcagtatggattcagggaggtcatccgtactaataaaagtctaattcatcacagttaatacactttgggtttcatattacactcccagtgcctttaagcacttatggtgagcataatacttattattttccacctcagttctagtgtcagagccagcacatatacaaacaaacaaacaaacgaaacctaactgtatgtatgtagtctaatggccgctcaaatatctgaaagggcagatatggatttgaagtctcacacataaggaaacatttattgagtgcttctggtggccaacattttacataggttatttcattttatcctcataagcaccctctgagatagttacagaaagagccagacttagtgaacaaatgaagttgagttttacagtgctattaactagctaaggtcatacaaatagtaactggagctaagatttgaaacccctgtccatctcattgcaagttcatattattttcattaatgatgccagaatggaattggtattaaatcatcttgcacattttacaagaatgtcatacaattccagtaaataagctgaatgaaaccacttttaaactttgagaagaagaaagcgatatgtaggcaggatattttttatttccaccatgaatatcagaagtagcatctgaaaatataaaagaggcctcaaaataatctctaaaagcacattcttattaatagtttccaaaaagaaaaccttaatctatttccatttttttcttgactttgctgtttatcagtacccccaggagctcatttttatacatactactttatggaaaccacctacccctctactgtcacccttaatatacacagccccatagaatttctcctttccttgctattctactgagccatagagcagaactggcaagagaaaacaaaagagagcaagccgttaacctctctgcctcagtggctgttttataaaatgacatgacttcattatattcctgatatcagaacaactccctgccaccaccaccaccctacagcctccctgaagttttcagcaaccatgaagaaaagactgagcacaagctggcccatggaaacttgggaaacttttttacctcatgcctgcagataccgtgggagtagactttgagctgcttcatgcctgtctcagacaaaattttacagactgtctcctattttccattttacagtttccaaatcagcaactgctatggtctaaacatgcctccccacctgaattcatatgttgaaacttagtcacaaaagttagtactaaaagatagggcctttaggagacgattaaggattagtgaccttatgaaagaggttgaaaggagtgccctcgtgccttttgctcttttatgtcttcgccatgtaaggacacagcattcatccctcttcccccacttttttttgtttgtttgttcgtttattaatttgcccctctgccttttccaccatgagaggatgccataagaaagtggcacttatggatcaggccctccccagatactgaatttgccaggacctagatcttggacttcccggcctctagaactgtaaaaaataattttctgttatctataaatcacctagtctcaggtattttgttatagcagcctaaatggactacgacaacaacctcctcctgtcactattataataatatcaataaccaagagatgccaaagtgggaatttgggtatttcatcatttagaggactaccaattagagtcagacttctagatgggcccaggctcccaatatttttgcttccaaatatgtttttcaaagccatatatctccttccccatagatagcatccatacatcaaaatcctcagttatatgaaataagagaaagaaggcctctaatgtgcctactacattctactcacaacacaggatatagaaacaatctctgttgagaaaaaaaaaggaaagcttccagaagttcttcctttggtatactccaccagaccttaggaaaggaatgggatgtcagagaagacttctaatcaaaataagaggaggaagaaattttagacaaatggacttgatctcaaaaaccacacctaccctccctcttgaaaaggggcccaaaatggttcacctccactttcttttattactttcctttataagctgctgtcacaggctccagaggactggtaagttctcttccagagaaattcagacaggtcagaagattgtatttctgagaagtactgagggctggaagaatcagatgtccttgtctgtttgataaagcaagaggtcagtgcaattatggcagaaaattcatgaagataccacaggcgcaagctggaaagtagtggttatggtggctttgtagattccagtgacctggaaagaaaaccatgggaacaaacaattgttgagcaacaactatgtaccaggatgcatattgctgaaaccaaaagaggtaaggtcatttgcctgagggcatttagctagactgtgaagctaggttgtctgactccaaagcttatgttcttttcatcacactctgtgacagaatagctcttctctgacttgtgaatggcagctatgtattctgtccttttttttttttttttgagagagagtctcactctgtcacccatgctggagtgcagtggtgcgatcatagctcactgcagcctcaaactcctgggctcaaagggtcctcccacctcagcctcctgagtagtaggactataggtgcataccaccatgcctggataattttttaaaatttatatttttgtggagacaggtctcgctgtgttgcccaggctggtctcaaactcctgggctcaagtgatccacctcagcctcccaacgtgctgggattacaggcatgagccaccacaccagacgattctctataccttaaagcagcaacaccagcagtccatgaggaggttttagccaatttaacttacccgctaatgatgctgttcccaaacagctttctataagggccactgagtggaaaatagggcaacaagggttcatagtagcatcttcctctgcctgtgggggaagaaaagagaaagaaagagcaaagtctaacagggctgacctatcaccttcttgtctccttaccacatcccatactccttcagcccattttattttagggcttgaacacaagagaccattttaaaattactcctttgtaatagtagcagtagagataaccaaagggctaaagagatttcaccaaatggttaaagtggagccactttattttcctgtaagtggcagcatgaaattaccttcattctattctgttagggttaggtattccagtatttcaaagagcgatcctaccctcacctttgtccatttctctatcactcaataggtcaccccagaataatttgtgaatactcaaagtgtacgaaaaatgtattacaagggctgtctttacacataaatggagttgctcatcacctacctgatacactttgaaaagcacatggaaggctttcttacttacatatataactcctactagcatatgacatttcctgaaatcccaccattgaggattcctgcccttgtgttagtagatcaattgctattatagaaacttgctattctcaggtgttcaactaacacctaggatcctcaaaccaaggcaacaggaatcctaatgaggggatgggggtgaagagggaggaagtagaggtggcagattttgaaggcttggagcatgcttatgaagaacaaatatgagtacagtgcctcagtacagagaagtcctttttttttttttttgagagataagagtcttactctatagcccaagctggagtgcaatggcatgatctcagctcactgcaacctccgcctcccgggttcaagtgattctcctgcctcagcctcctgagtagctgggattacagatgtgcatcaccacgcctagctaattttgtattttttttttttttttttttttttagtagagatggggtttcaccatgttggtcaggctggtcttgaaatcctgacctgaggtgatccacccacctcgggattacaggcatgagccaccgcccctggcccacagaaaagttgtaaagtattgggtgttaagggatgggtcacatccagggaggagatagagtatcctttgagataagagtcaactcccattcacagtttctacaaagaaaataaagtacctaggaatacaacttacaagggatctgaaggacctcttcaaggagaactacaaaccactgctcaacgaaataagagaggacacaaacaaatggaaaaatgtttcatgctcatggataggaagatcaatatcatgaaaatggccatactacccaaagtaatttatagattcaatgctatccccatcaagctaccattgactttcttcacagaattagaaaaaactgctttaaatttcatatggaaccaaaaaagagcccgtagagccaagagaatcctaagcaaacagaacaaagctggaggcatcatgctacctgacttcaaactatactacaaggctacgataaccaaaacagcatggtactggtaccaaaacagagatatagaccaatggaacagaacagaggcctcagaaaaaaatgtgacacatctacaactatctgatctttgacaaagctgacaaaaacaagcaatggggaaaggattccctatttaataaatggggttgggataactggctagctatatgtagaaaaccgaaaatgcaccccttccttataccttatacaaaaattaactcgagatggattaaagacttcaacgtaagacctaaaaccataaaaaccctagaagaaaacctgggcaataccattcaggacataggcatgggcaaagacttcatgactaaaacaccaaaagcaatggcaacaaaagcccaaactgacaaataagatataattcaactaaagagcttctgcacagcaaaaggaactatcatcagagtgaacaggcaacctacagaatgggagaaaatttttgcaatctgtccatctgacaaagggctaatatccagaatctgcaaggaacttaaacaaatttacaagaaaaaagcaaacaaccccatcaaaaagtgggtgaaggatacgaacagacacttctcaaaagaagacatttatgcagccaacaaacttatgaaaaaaaagctcatcatcactggtcattagagaaatgcaaatcaaaaccacaatgagatactatctcatgccagttagaatggtgatcattaaagtcaggaaacaacagatgctggagaggatgtggagaaataggaacacttttacactgttggtgggagcgtaaattagttcagccattgtggaagacagtgtggcgattcctcaaggatctagaaccagaattaccatttgacccagcaatcccattactgtgtatatactcaaaggatcataaatcatgccactataaagacacatacacgtgtatgtttattgtggcactgttcacaatagcaaagacttggaaccaacccaaatggccatcaatgatagactggataaagaaaatgtggcacatatacaccatataataccatgcagccataaagaaggatgagttcatgtcctttgcagggatgtggatgaagctggaaaccatcaatctcagcaaagtaacacaggaacagaaaaccaaacactgcatgttctcatttataagtgggagtcaaacaatgagaacacatggacacacagaggggaccatcacacactggggcctgtcgggggggtggaggactaggggaggtaggggagggatagcattaggagaaatatctaatgtagatgacgggttgatgggtgcagcaaaccaccatggcacgtgtatacctatgtaacaaacctgcatgttctgcacatgtatcccagaacttaaagtacaataaaaaaataaaagaaaatgtggcacatatacaccatggaatactatgcagccataaaaaagaatgagttcatgtcctttgcagggacatggatgaagctggaagccatcattctcagcaaactaacacaggaacagaaaaccaaacaccacatgttctcactgataagtgagagttgaacaatgagaacatatgggcacagggaggggaacatcacacactgaggcctgtcagggggtggggggcaaggggaaggatagatgactagttgatgagtgcagcaaaccaccacggcacatgtatacttgtgtaacaaacctacacattctccacatgtatcccagaacttaaagtataattaaaaaaaaaaaaaaagagtgagccatcttgcagttttgactgagctttgttctgcttattgaataggtaagtaacccaaacggaaagaagtggtgagcaatgcaggaagtgctcaagcctgatgtaaaacaggaaaacttctgtttcatggtttgtgttgcacagcgcccctcggccaaagaggaaagagctaattttgagataagtaaccattgcttctaattctttagaaagtgcttttgactgtagacagacatgctaaaggctgtgcctcattgtttgaagtccagatacgtacaactactccttgttgttactgtaaaaatagttcctgaaagaatgactaaaaagaataggagatgcaagattaaaataacatgaatgggagaggaagtacaagactaaaacttcctcatgtcagaggtaagattgctttatttcccaactaaataaaatcaggtcatgtatgattgttaatggcaattcttgccaggaacttaaccaaagttaaaataattttacaggttgctctaactttcccagtttctggacattcccaatagatgactttgttattttcaaggacattcttggggtttgaacacattgtttcttttttgcagtgcttttcagcatatgattgaacgtactcaagaagggtcatggttagttcagcaagctgatttcaacatttggtgattgtctccagttaatgagctatacatatgatgtccgcttttattttcatcatcataaaccacagaaaaaaggggaaacagtataccagcaagtcagcaagtccaaatcaagccatgactcagatttcctaagaaagaaaagatcagactctgctttgacatattctatcttaaattttgaaattactttggggacaacattaattatccaggtcagtgtgggggaatagcagttcctccttgatcatcctcttcatatggtataatcactaacttcacagatctgtactgaaaagttgtttacctttggggaaatggctcattataagtatgtatatagggaatagtaatataagaaaaaatcataaagatttgagggtaagtagagaagatcagaccctgtggaagttaatagcatggcccttggaaccagattacctagattcaaatcccatcttctcttcttaatacctctgtgaccttggacaaattacttaccctttttgtgtcttagttcaaccatctgcaagatggggatatgagagtattattagtagattgatgtgaggattatgtgaatgagtgtttgtaaagcacttagaacaatgcttgttacagagtaggtgctcaataaatgtgacctgtaattgttatccttcagtaattggtaaattttatgtctgtagtcatagagtttggttcttaacccaggcccggtgccattcaagacactgcagaacatagtgcatattccttcatgtttatctaggtttttttctcctttttaatgttacctttagtcccatactagtcattatcaacctgtggtcaccagtcagggaagtacattcgtattgattgctgcaaatgcaaaggtgctttcagagcagagatccttgattttaagggactcccattaaggttgaaaagatgggacaagtccgtttttcctgccaagaaagacatggcttccatgaaatcttatttactatatttttgtatctaacaagttctctaggaagcctctcatttttgaatcgtaaaaaaggtctgtattcaaagcaaaaatcctttaaaaaaatctttgataattctgatctctgtgctttgctagcccagatttttattatctgaccctatggtatccataagcatggttttaaaggtatgtccacaagttatttgatacttctctcattgcggtggaacttaattcttctccctttgagtgcagggaggactttatgattcctttgtagtgaatgaatatagcagaagtgatgggataatacttctgagactgggttatataaagactggcttctgactttggtttgctcctttgctctttgtctctggaatcacatgctcagggggaaatcaactgccatgtcatgaagagatgatacttgggcagccagtggagagacctacatggtgaggaactgaggtttgccagaatccatgtgaatgcacttgggaatgtaccctcccctacttgagctttttttttttttttttttgagatggaattttgctcttgttgcccaggctagagtgcaatggtacgatctcagctcaccgcaacctccacctcccaggttcaagtgattctcctgcctcagccttccgagtagctgggattacaggcatgcgccaccatgcccggctaatttttttttttttttttttttggtatttttagtagagacggggtttctccatgttggtcaggctggtcttgaactcccgacctcaggtgatctgcctgcctcagcctcccaaagtgctgggattacgggcgtgagccactgtacccagcccctacttgagcttttgagatgactgacagcttgaccacaagctcatgagagatcctgaggcacaaccaccctactaagcccctcaggattcttgatcctcagaaactctgagataataaatatttgttgtcttaagctgcaattatgttgaatgaatctatcttgtgttcatttcttcagcaagactgggtcacattgcctcataaaaatgtatgacagtggccgggcgcggtggctcacgcctgtaatcccagcactttgggaggccgaggcgggcggatcacgaggtcaggagatcgagaccatcccggctaaaatggtgaaaccccgtctctactaaaaaatacgaaaaattagccgggcgtagtggcgggcgcctgtagtcccagctactcgggaggctgaggcaggagaatggcgtgaacccgggaggcggagcttgcagtgagccgagatcccgccgctgcactccagcctgggcgacagagcgagactccgtctcaaaaaaaaaaaaaaaaaaatgtatgacagagggttggttgtaggttgcaaatatcaataaacatagttaagagttttatttttcttgtattttttagagacagggtctctctctgtcacccaggctggagtacagtggcacaatcatagcccactgcagcctcaaacttctggactcaaccaattctctgacctcagcctcctgagcagctagaactacaagcatgtgccatcatgcctggctaatttttatttatgtgtagaaacgtggtctcactatgttgcccaggctcaaacttctggtctcaagagatcctcttgccttggcctcccaaaatgctgggatttgttttaaaaaaaaaaaaaaaaaaaaaaaaaaagcaaaattgactccatcctgacatctttttcattctttattgtcagcacatctttttggtaaatattatagtctagtctcccctcttaagtgattaatctgaaaatcatgtgaacattcttccatttcctttagtgattctgtcagaggcatgtgaaccagagcaactctatcttaaatgggagctgggaaaaatgagctgaaatctaccgggctgcattcccaggcagttaaggcattctaagtcacaggagagataggaagtcagcaaaaaatacaggtcataaaaaccttgctgataaaacaggttgcagtaaaggagctggccaaaaccagaaccaaaatggtgacgagaatgacctctagtcctcctcactgctaccctcccaccagcaccatgacagtttacaaatggcatggcaacgtcaggaagttaccctatatggttagaaaggggcagcatgaataatccaccccttatttagcataacatcaacaaataaccataaaaatggacaaccagcagcccttggggctgctccgtctatggagtagccattcttttattcctttactttcttaataaactggctttcactttgcactgtggactcgccctgaattctttcctgagcgagatccaagaactctcttttggggtctggactaggacccttttcctgtaacaattttgcctctcaccaattaagaatgagacaattctgaggactctcctttggaaaaatgatcaaggttcttggaactcagccatgttaggaagtaaggtgactgaatggggaagcagtaaggagggggcgtgtattttttcatccgaagctgttctagtgttggaactttcaaggttccagcctcacttggaattttatgaaactcatacctcatattttattttttatgttttattttttgagacagagtctcgctctgtcgcccaggctggagtgcaggggtgcgatctcggctcactgcaagctctgcctcccggtttcatgccattctcctgcctcagcctcccgagtagctgggactacaggtgcccgccaccacacccggctaatttttgtatttttaatagagacgggtttcactgtgttaggatggtctccatctcctgacctcgtgatccgcccgcctcggcctcccaaagtgctgggattacaggcgtgagccactgcgcccggccatacctcatattttaaatgataacaaataacttcttccgtgtggcaaatttagatagaaagcattgaaagaacctgcttcccatctgctgatcaaactggagcctgaatcaaataaacttctccaaataaatgctacaatcctgatttctgcaagcttttggacttttaaaacttggtgttcctatctcaggcaacatatacctctttggaaactgggtataaatctactgggtttggatgtggaatgggttggttatttcatttgtgtgctctctttaaggtcatgagaatttgccatggttcatgatcatagtttaaacaatattagctggctaagtgctggtgcttagtgaaatacactcttttatctttagacacccctttgctttcttctttgatatgaagccatttctctcgagtgacacttcagcatttttttaattgaaattgtaagtacaatacatagtttgatcattctggtctcagagatttaattcttaagtagtgctaagacctcgcccaccttttaaaacctcacctggatgtcattcatccattgtatcgagggactgatataacatgtgtacttaatttaagatccttaagggtgggtattttccattaccattagttaaaatttgcaagtaagagcaacatgttccctgactctacataaagttaaacatgcgaactgaaaatagaatgagagaaaatcgagcatggttatttactttctgcagtgctctaattgggcactatagcatatggccaaaacctttactattaattaatcacaaaaaatccatatggatgatttgtgaacattctaaagtcagagtgggaatttgcttcttttctatgtgaggactaatctctgattttttttttatcttgcccaaattcctatctaaggggtctggggaatcataccctacaaaccataaattctcatcagatgggttttatttaaccctatatattgtgacttattttccaacctgactctggcataacattacaagacaattaagaaaataaaattattttatccccaaaacatgtttatttgccgtatcttgaaatggccctgcaaagctgtcctttgtgggggaaaatttgcatctgtaaagaatctctgttaacatacctagatctgtttcttccaggcctttccaatcctaaagaggttacctaagagtctagcaccttttaaagatctgaacaggaaacatttgtcatctactgtctctaagggcattcactataggacttcaaaggaaccttggcctccacaatcttttatcttaacctggacattttctttctgtcaactccaggtctttagacaaactcaaccaatgacaaactcaaccaactgtcaaccagaaaatgtttaaatttacctatagcctggagatgcctccccccactggccccgccctggctttgagttgtcctgcctttctggaccaaaccaatgtatttcttaaatgtatttgattgatgtctcatgcctccctaaaaggtttaaaaccaagctgcaccctgaccaccttgggcacatgttcgcaggatctcctgagggctgtgtcatggtccatggtcactcatatttggctcagaaaaatattttacagagtttgactcttttttattgatgatgttttctttctaaacacattttttcactttgggaggccaaggcaggcagatcacaaggtcaggagatcgagaccatcctggctaacacagtgaaaccccatctctactaaaaatacaaaaaattagccaggtggtggtgggcgcctgtagtcccagctactcgggaggctgaggcaggagaatggtgtgaacccaggaggcggagcttgcagtgagctgagatcacaccactgcactccagcctggacaacagagtgagactgtgcctcaaaaaacaaacaaacaaaacaaaaaacacacacacaattttcttaaagggtgcctggatctctattaatacttagaatttggtaatgtttaaaagctttgacatttcttaatgtcagaaatttccatattgagatttgacatatatttggactcacattaaatgagacgtactagtcatcatcattgttaaaaaatatttttaaatttttaagtatggaagataaaataaaaacccgttctcattcatttacttattcaactccccaccaccacacatacatatacatactcatacatgcacgcaatacaaaccttcctccccaccacccttggctaactccccattcatcagtcaaaactcagctcaaatagttgctccttgtatcacggcaggctggtttctgtggttggttctgtcaacttcaactgtaatagaaatgttgtttttctattcttccttctttggcctcccattaagctgtcacttctttacctagggaatgcatcttttgtttctgagttcacaacactaccagaatgcctggcatggcagaaagtgcttgttaaatgcctgctgaatgaatgaataacttcagccaccagcctagcaagcagatgagttcagaggttatataaacaacattcataagctcagccagaatcttgtttgagccagagcagcagaagcccagaaagtcagggacaatgccaccctggggcttataagtccttcaggggctacacaaggccagaccaactcaggaaaccacctgcgaaggtgccctccctccccagttccatgccacctggcagttttgtgctgtctatgggcctagaccaactcaaagtgaagaagttctctgaaaaccttttacttattaaagaactccaataagcaaaataggtagacatattttccctggtggagccctaagcaaaattcaattatgtgaatcgtacttaatatttaaaaacattgtgggtttttttggccaggcaccgtggctcacgcctgtaatcccagcactttgggaggctgaggcgggtgaatcacgaggtcaggagttcgagacaagcctggccatcatggtgaaaccccgtctctactaaaaatacaaaaaattagctgggcgtagtggcaggctcctgtaatcccagctactcaggaggctgaggcaggagaattgcttgaactgaggacacggaggttgcagtgagctgagatcacgccagtgcactccagcctggccaacagagtaagattctgtctcaaaaaaaaaaaaaaattgttattttttttttttttcaaatcagtggttgacttcattacatttgcctggaaaatagactggtaacaagtgaaaaactacctgaagaagccagttcaacttagagtgaatccaaaagggcagtggggccatgagaagcttcatttcttagcagtcaaccagagggagtttccaggggtcctgggaggagggtttagataagtgaaagttgtgccccttgcagtgctcttatttttcagtttaaaagatgcctcctgccatccacatgttatgcagttggggatttcaacccacttacagcatagtcttccctatttaatcatagaatctcctcatttttaactgacctggccagcttctttatcaattttgttcacatactgcgggcctcaagtgttcatttaaacgtttgggactgtaactgctaaagctgttttcacatgtggaaaatatgagcctttaagtttcgtttagcagatgctcaagccagcagccagcaatatgccccacttctagggtggtgcccagagtactggactgagcagctgaaatgcagcttaagttctggttttattgcaaatcagccaccaatgttgaattggtttcttagtccctgagtctgttgccttatttgatgaattaaaataagtaatataattcaggacccttgggagaagtgttttatatcactttgctaacactgaagactctccagttctctctctgatgcactggaaacattgcgttctaaataccctaagagccctttcagcagtaaattggtctcagggtgctggagaggatgtatctggtggtgtttcgaaagtgatcaactcctcccactcactttaccccttgggcttgtaactttcttgtttctggcctccaaggaaatcacatcttccagctcagccatgaattaaaaaaacaattaaaaatattttatacctcatttgtatgctgtaccagaaagatttatttgaatatctcatttgtatattgctctgtgtatgtttttttgagacggagtcttgctctgtcacccagggtagagtgcagtggtgcgattttggttcactgcaacctctgcctcctgggttcaagcaattctcctgcctcagcctcccgagtagctgggattacaggcatgtaccaacacgcccagctaatttttgtatttttagtagagatggggtttcaccatgttggccagactggtcttgaactcctgacctcaaatgatccacccaccttggcctcctaaagtgctggggttacagacgtgagccactgcacctggcctgccctgtatttatttatttatttatttatttatttatttatttattttttagtgggagcaaatgcaagttgagcattgaaaattcaaaatctgaagtgttccaaaattcaaaattttctgaggaccagctgggtgcaactctaatcccaagcactttgggaggctgaggcaggcagatcacttgagcccaggagttcaaggtcagtctgggcaacatggtaagatgttgctgagagattttgtcaccaccaggcctgccctacaagagctcctgaaggaagcactacacatggaaaggaacaaccagtaccagccactgcaaaaacatgccaaaatgtaaagaccatcgatgctaagaagaaactgcatcaactaacgagcaaaataaccagctaacatcacaatgacaggatcaacttcacgcataacaatattaaccttaaatgtaaatgagctaaatgctccaattaaaagacacagactgccaaattggataaagagtcaagacccatcagtgtgctatattcagcagacccatctcacgtgcagagacacacataggctcaaaataaagggatggaggaagatctaccaagcaaatggaaaacaaaaaaaggcaggagttgcaatcctagtctctgataaaacagattttaaaccaacaaagatcaaaagagacaaagaaggccattacataatggtaaagggatcaattcaacaggaagagctaaatatcctaaatatatatgcactcaatacaggagcacccagattcataaagcaagtccttagagacctacaaagagacttagattcccacacaataataatgggagactttaaccccccactgtcaacattagacagatcaacgagacacaaagttaacaaggatatccaggaattgaactcagctctgcaccaatggacctgatagacatctacagagcgctccaccacaaatcaacagaatatacattcttctcagcaccacatcgcacttattccaaaattgaccacatagttggaagtaaagcactcctcagcaaatgtaaaagaacagaaattataacaaactgtctctcagaccacagtgcaatcaaactacaactcaggattaagaaacttaatcaaaaccgttcaactacatggaaactgaacaacctgctcctgaatgactactgggtgtataacgaaatgaaggcagaaataaagatgttctttgaaaccaatgagaacaaagacacaacataccagaatctcttggacacatttaaagcagtgtgtagagggaaatttatagcactaaatgcccacaagggaaagcagaaaagatctaacattgacaccctaacattacaattaaaggtactagagaagcaagagcaaacacattcaaaagctagcagaaggcaagaaataactaagatcagagtagaactgaaggagatagatagagacacaaaaaacccttcaaaaaatcaatgagggccaggcgtggtggctcatgcctgtaatcccagcactttgcgaggctgaggtgggtggatcacgaggtcaggagatcgagaccgtcctggctaacacagtgaaaccgtttctctattaaaaatacaaaaaattagccaggcgtggtggcaggtgcctgtagtcccagctactcgggaggctgaggcaggagaatgctatgaacccaggaggcggaggttgcagtgagccgagatcatgccactgcactccagcctgggtgacagagcgagactctgtctcaaaaaaaaaaaaaaaaaaaaaaaatcaatgaatacaggagctggttttttgaaaagatcaacaaaattgatagaccgctagcaagactaataaagaagaaaagagagaagaagcaaatagacacaataaaaaatgataaaggggatatcaccaccgatcccacagaaatacaaactaccatcagagaatactataaacacctctatgcaaataaactagaaaatctagaaaaaattgataaattcttggacacatacaccatcccgagactaaaccaggaagaagttgaatccctgaatagaccaataacaggctctgaaattgaggcaataattaatagcctaccaaccaaaaaaagtccaggaccagacggattcacagccgaattctaccagaggtacaaggaggagctggtaccattccttctgaaactattccaatcaatagaaaaagaaggaatcctccctaactcattttatgaggccagcatcatcctgataccaaagccgggcagagacacaaccaaaaaagagaattttagaccaatatccttgatgaacatcaatgcaaaaatcctcagtaaaatactggcaaaccgaatccagcagcacatcaaaaagtttatccaccatgatcaagtgatcttcatccctgggatgaaaggctggttcaacatacgcaaatcaataaacgtaatccagcatataaacagaaccaaaaacaaaaaccacatgattatctcaatggatgcagaaaaggcctttgacaaaattcaacagcccttcatgctaaaaactctcaataaattcggtattgatgggacgtatctcaaaataataagagctacttatgacaaacccacagccaatatcatactgaatgggcaaaatctggaggcattccctttgaaaactggcacaagacagggacaccctctgtcaccacgcctattcaacatagtgttggaagttctggccagggcaatcaggcaggagaaagaaataaagggtattcagctaagaaaagaggaagtcaaattgtccctgtttgcaggtgacatgattgcatatttagaaaaccccgtcatctcagcccaaaatctccttaagctcataggcaacttcagcaaagtctcagtatacaaaatcaatgtgcaaaaatcacaagcattcttatacaccaataacagacaaacagccaaatcatgagagaactcccattcacaattgcttcaaagagaataaaatacctaggaatccaacttacaagggatgtgaaggacctcttcaaggagaactacaaaccactgctcaacaaaataaaagaggttacaaacaaatggaagaacattccatgctcatgggtaggaagaatcaatattgtgaaaattgccatactgcccaaggtaatttatagattcaatgccatccccatcaagctaccaatgactttcttcacagaattggaaaaaactactttaaagttcatatgtaaccaaaaaagagcccacattgccaagacaatcctaagccaaaagaacaaagctggaggcatcatgctacctgacttcaaactatactacaaggctatagtaaccaaaacagcctggtattgataccaaaacagagatacagaccaatgtaacagaacagagccctcagaaataataccacacatctacaaccatctgatttttgacaaacctgactaaaacaagaaatggggaaaggattccctatttaatgaatggtgttgggaaaactggctagccatatgtagaaagctgaaactggatccctcccttacaccttatacaaaaattaattcaagatggattaaagacttaaatgttagacctaaaaccataaaaaccctagaagaaaacctaggcaataccattcaggacataggcatgggcaaggacttcatgactaaaacaccaaatgcaatggcaacaaaagccaaaattgacaaatgggatctaattaaactaaagagcttctgcacagcaaaagaaactaccatcagagtgaacaggcaacctacagaatgggagaaaatttttgcaatctacttatctgacaaagggctaatatccagaatctacaaagaactcaaacaaatttacaagaaaaaaccccatcacaaagtgggtgaaagatatgaacagacacttctcaaaagaagacatttatgcagtcaacagacacatgataaaaggctcatcatcactggccatcagagaaatgcaaatcaaaaccacaatgcgataccatctcataccagttagaatggcaatcattaaaaagtcaggaaacaacaggtgctggagagaatgtggagaaataggaatacttttacactgttggtgggactgtaaactagtacaaccattgtggaagacagtgtggcgattcctcaaggatctagaactagaaataccatttgacccagccatctcattactgggtatatacccaaaggattatatatcatgctgctgtaaagacacatgcacacgtatgtttattgcggcattattcacaatagcaaagacttggaaccaacccaaatgtccatcaatgatagactgtattaagcaaatgtggcatatatacaccatggaatactatgctgccataaaaaaggatgagttcatgtcctttgtagggacatggatgaagctggaaaccatcattctcagcaaactatcacaaggacaaaaaaccaaacactgcatgttctcacttataagtgggaattgaacaatgagaacacttggacacaggaaggggaacatcacacactggggcctgtcgtggggtggggggaggggggagggatagcattatgagatatacctaatgtaaatgacgagttaatgggtgcagcgcaccaacatggcacatatatacatatgtaacacacctgcaggttgtgaacatgtaccctagaacttaaagtattaaaaaaaaaaaaaaccacggtgagacatcatctctccaaaacatacaaaaattagatggacgtggtagcacatacctctaatcccagctacctgggaagctggggtgggaggatcacttgaggtgaggagatcgaggctgcaatgagccaggattgtgccactgcgctctagcctgggcagcaaagtgagatcctgtctcaaaaaaaaaaccaaaccaaaacaaaacaaaacaaaaaaaccctaaaacaaaaacaagaaactttctgagtaccaacatgatgcttaaaggaaatgctcattcgagcattttggattttggatttttggatttgggatgcccaacctgcataaactttaaagaatccttaaataaagttatatgctgctaaaactaactgcctccttgccacactcctaataaggttctacatcttgcagaaatttttaaaagcctgatttagggtgtcagacctgggttcaaaatcttcgtcttctactcaaaagcaatctgatattggtgagcttcttattccatatctgtagaatgggataggggatggtaataataatcccatgtaccttgcaggatttttgtgaaactggataaggtcaggtatgtgtgaacagcaaatggagtgtctggcccattgtagctgtttagttaataacatttcctgttgtgacttgatatctggtttgagattctggcatcctgtaactcctcctcctcaccagccctgccctccatcagcctggtcccctgtacagtgtgacacctactcagtaattgcccatagcagaaacagactcaccagctgttctagagctggctctccctggtcaaagcttcccatgcagcaagtgtttcataatcagcctgttcctgctgccgtctgccacttttcccccgaccttcctggccatcccttgtcccttcctgggcaaaagcatctaaccatgtggtatggtggtgtcacctgagtgtggtgtcagcaaacccagagctttccaagcctcccatgatgagtctatgacctggcgttccctgttccttctgatactgttttttctttctctggaactacattggccaaaacagaaaacagggagtcagtaaggtttatcaatatttcacttgcatagccgcagtcttaagttactgaaatgacaggttgatccagtgaggaaaatcaaacaactatcaaaaagaccagtcaagtcattgtagaccatgacaaaagaccctcagtaggaaaggaaaaaatgcctaacaccaagaaacatgaaagtaaaaagctctgaatttggtaaaagtgaagtaatttctataaatgagtcatattgtatctaggaaattaggaaaatttcagaaaagtttttttaaaaattcaaatcaactttaaaagctgatatccttttttcttctaatatctttggcatatatttgtatacacatttcaagtatttaaatgaatgaaattggaatttttatatatagttcttttcaagtaaaaatgctaatgtaatatttatttttaaattttataagaagtgttttattttttacttaaaatatgagactttctcatgacaatatatattcttcagaaacactataattaatgtccttgtaatgctttcttgtttggatagttaataatgcattttgtcatactatagctactcattttggctgtcttcattgttttgctactttaagtaattctatgaggtcaatccttgtacataaagctcagttcaaatctctgattatttccttaggataaaatccaagaattggcattattaggtcaaagagcataaacaagtatttttttctattctttgttttgaaagtgaattacaaagaaatcctctcttaaaagttgctcctttcatttggttttattctacagattgcttctttacctccttctttgtgtcaagaaccatattaaactatgtgaattcctctctgttgcatctttaagagagagttgaggtctcacttcctcccagctatcctctccaccacccgccatctcctcagactgagacaagttcccttctctgctatcacccacacccatacatctgggctctcatagtactgtcatagcatttatcatgctgaattctaagtgtctgtttggttttattttggcattagacagtaagtgccttgcgggtaaggactatattttattcatctttatttctccagaaaacaccgagtactttgtacatagtaggcactgaatgagggaacaaggaacacagaaccatttagtcactacacacacacacacacacacacacacacacaaccatcctgtcctatattattaaatacaggagatagaagtgtgagggagaaagagggtcatcttcattcagtaatatgcttgtattttctcagatatagatgtatggatgagatatcactttttgatatgtgtccagataggccagatataactaatatcaggattttatcaggtcattgggaccacagccttcctggaaacatagctttagagtcagttttatagtctgctgagcccaaaacaagctagataattaataatattattggatcaaaatggcccaaaatctgattaggggttatttatcctacatgtacatgatagcatagtctttattttgtccctccaagtgagtttataagtgactgtgttctgtttggatggaaaatatcatctggaaataatttatgagtaactgcagaacctgccaatggcatgctttacaagggcttatttcattcacttccacgtatatcccataatttcctgattttctcaggttcttttgtgtaaataccaaattgaccttatgtttttgtccgccttttccccaggggcgatctaagtgtcaggatggtgttattgacctggcatctgcgggggcgacccagagtttccatgacctgtggttggaaggcccactcattggggcactgaagctcctgagagttactgttctcactcaatgggaggccagcggttctcagcagttttctctgcttcacaccagactgtccagttagcttcttattcagccattgcctttccatactggagcaaaggtttatgatttattaggctattcccaggaaagcaagttctatgtcttctgtgctttgagctccacataattcttggagatcctcacatcaaagactccctcttggttttcctctttgtctcccttgcatcttcctctactcacacccctgctgtctggccagccttacttatcagggagagcaggaagagaggattcatgggcaggaaaactcactgtttgctccatcttcgtagtcctggggtgtggcccaaaaccttggttgatagatttgtaaaaagacctttatcttgagaatattgttgctttgtgaatttccacagtctccttgaaattcaaaagctgagcataactatttctttttctttgcatttcagccatagcaatcctaatagcccctaggacaatgagtgtctcaggctgaatggaagagggtcatatacatgcaaggggatgggaatttaatatctctaaatatcatcctaccaacacatgtatatgtaaatagatttataactatatggtcatttgtataaggataacctaataatatcaaaggacaggttcattttaaattaaaactatagggaagagtgttgattctacaccaataacaaaaaggttaaagaaagtgtaattctcttttaagtaccagatgcttcagactgtgcctctcattttcagccttcttctccccttttcctgtctctgcctttctcctctctgccttttattgaaaggcaaatgccccttgtaataaggttcaatttcagaagttcctgttataccccactcccatagcattcataaaaaaagcagagaccgtagttataatttgctgggaaccctaaaagagaagtgagacaactcactgaagaatcctcaaataacacgaagacgtgaaaaaatatagctggtgcttctctggcttatgtaggaagaatcaaagcaaccatgaaattaattttatttaccattaaaagatactggacttagaattcaggttgtgattatgtaattataaattaatttcagtagcattgtataatctgaaatgccagcaatagttatgagaagtatgttaatgaggatcagaaaagcttgtctgcttgaatgtacctcaaaatagtcatgcccagagagtatatatgaagcctcctgcagcaagtggacccactgtggtttcctaagactctccaatgcatgtgatcagtttactaggaagcagctctctttaatatgttcatacttaacagaaaaggaaggaccagaaggttgcccataggctgcacccaagtgtgaaataaacattattattacagcagttgaaatgtgaagttgaagaacattttaatttcaaaatagtattcatgagaatcagatgacacatctatactttaactctggtgaagtgtgaaaattaaatgaacactccgtcagattctgaaagttgaattatgacccccacctccctcactaaagagatattttttcatatttagggtggcatacctcatttgtggaaaaggtctttctggcactcatcccctgtttctcaatttattgtagccatcttattaatcactgtgtttgctggggaagagccaaagtatacctaaatctagaattaaactatatagcactagggtttaaaataatagaatttgtcatcaagttgactgcctcatattcatccagtgtcaaactcaatagttgatatgtttgcttatgcaaaaatatcagagaggaaaagaaaattttaatttgtaatggatctatttctcataaaatgtcattcctgccgctctgctctttagcacatgatgaggggaagctgaggcagcttctattgtaaaggaagacccaaggaggtgccattttaggggaccttcagtctccacccagttcaggggattcacatgagcctccctgcatatatgggcgtgtcccatcactgcttcttctgcttggaagcccacaaagatggtttgctatcctagtacctcaggtcttgatggaagaaggccttggtgtgttcttaattatatcctttgcctcagatgttttgttgtcagtgtttcactcttcccagtcaggttttagggctgctaccagtctctccatgaaatagaaaccccctaatgtgctgttctgctgaacttcctcattgactgaccttgtactatgatgtctttcttcctggggtcagtgggtacgggataaagcctctaagcagggttgcccatatggttgtgtatgtttggattaccccacagctctggacggcaccattcacactgtggtcattgtcgatttaaatatgtattatggccattttatggagatggtagtaaagggtcttgatgaagacatacctttttctggtttgcacacaaaaaattaaacacaaggtagcaatggcctgccctgatgttgaaagcaagactctggcaacaggctaggtgggttctaccccttactagctgtgtgaccttgggctagtcacataatctcagttttatcatctgtaagatgggaataataatagtacatcataggctattaggattaaagaaattatgtatgccaaggactaagtacagagcctgacgcatggtgaatgctcagtatatggcagctgtcacaatgtggcccatttgtgtccttccatatagatagatcattttccaatttccaattactttctacacatcctctcttaacataaaatgactttcaagcccattactacaagacttattacaggggacctatggacttgtgatttgaatcgtaattagtattaatttaatagtctcttcacagagttagactaatatgtcaggtgacacagtgtcttagcccagccacacacattgatatgactctgatgatggcctgcctctcagtgaagtcagagcagggggtacaaggactcaggcaatagacaagagagaaaagaaagattaaagcttactgtttatagtgttttccacacaaggtatcatccctgacaagtctttctatgccatggcattgattattagaagaaagactcgtaaaaacctctaggcaggtcagattttggcagacttaaagattatgcagacaagagtaggggtcagggagtcttatctgagagctgccgggtactttatgtgtgtttcaggacagggctgaccacagtgttggctgtggaaggtgggggctggaaacctctgctgacagtgatcttatctttcccatgtgatagtttcattaatgactgccttcacctgctctttttccagtatgttgcactccaatgtaatttctgtccgttatcaggccttgatgtcatctatgccctgaaattgtgttattgaactaacactcattgtcaaacctttacgagataaacctattttatttctcctcatcctaaaaatgtgttgattctcctgtgctgtgtataatgaatggccctttggctgttgtaacaccttcactgaaatccttgaagtgtgtgtgtgcctatctctctatgtctcgccccctttcgcctcctccccttcctcaccccttgccaccccttccttaccctccccaatctctctctctctttcctaaagaacaaaaatggcagtttcccttattctcatagaaaagactttatgtcacagaagggagctgctattagcataagcagtctggcattgtgtgggtgagtgtccatgtgcattatcaagcaaggcttataaaccatgttaattccacacaactttctctactccatccagcttccaatccgtaccccacaacataaaaagtgacatcactcacttaagaaaatgttgcagtaaggtggattttcataaaataaggattctcaggactccaatttttaaatcatacctgtgtgcctacagaaaggttggaggggggcaagggagtgaggatcttaattggcacccaaggcagaatgtttgctctgaggagaaggattgagtggcactacttaagagatgcagcaaggcagtgcagggagagcctaaaagcagctgaggctctcaatgtcacccagacactgatggacagtcattgatatttgaatctgaatctgaatgtgtactatcaaaaaggctgctgtcatcattgtcaccactattcctctgagtccttttccatctctaccatcttactctctgtaacgggattgtaagttctatattttgttttatatcttgtatactttgcttgatgcagtaaatatgctactgaaacactgtgaataagtaaaacttcacctgactgcaacatttaaataacattaaattcatctgaatacagaaaaatataaagaagaaaacaaaaaggtctaaaatcctatcaccaagatagccctgttaatatttgttaaaaatataagtatgtgtgtggacatgattagagtgtctatatttgcatagtataaggggtaaattatactagtacaattaataggtataaattgaaaagcacctacatttctttcgctcctaccccaatccttagcccctccctcagcattatgtctgtgcagtgtacaaagcactcttataagaatacagcaatgggccggcacgttggctcacccctgtaatcctagtactttgggaggccgaggtgggtagatcacctgtggtcaggagttcaagaccaacctggacaatatggtgaaaccccgtctctactaaaaatacaaaaattagcctgggcatggtggcgcacgcctgtaatcccagctacttgggaggctgaggcaggagaatcacttgaacctaggaggcggaggttgcagtgagccgagatcgcgccactgcactccagcccgggcaacaagagtgaactccatctcaaaaaaataaaaaagaatacagcaatgactaaggcatctccctggccctaaaagggagtttcagcctaatgggtcaaagaatcataaataaggcatataaatagcatgatatgtgatgtacagtaagttggcagctggcagccatgagatgtgatgccaacattaccctcagctgctacaggtctctgttgtcatcccttccctcctccgcctcacctaactagccacatgaccttaaagaaatacctgaactgtctttacccattttatgcatttataaggtagatgtgataattcctccctgcctgatctgatgagctttgagaatcgagtgccagaatgggtaagaaaacacttcacgactcataaaacagaccagaagtgtaaggtttcattgtcaactttattgttatacaaaggggtactatgaagaatcatagtaatcttgggcgttaatttaatagaaagcccgggagcacagggtcaccaacagcccagatttgaccaacagctgcctttcgcttggcttgtactgctttttaaaagaaaagttgctaacgtttaaaaatcaggagagttcatacaaaaaagacttcccttgaaaaatcggaggaaacattcacagtggacctgcattcctacgcggcagccattttcgttgctgaggaactgctttcccctgagcacgtgttctcccatttgtcacaagcccccccgactcccttttgtagccccaacactgaaacctgatgtcagtttcacttgtcatcatgcttgcccttccttagagccagaaaatgttttagaacccaggttcccatcaaaagtagcagggtaaatagctactccaagaaggccaagatttttcttataccttacctgaaagcattggagtttgcaatttcaatttaagatctgcagaatattcaagctgaaaggggcctggaggttaattaatccaaacgtcttgtttttgagttccagagaggttaagtatataataaaatgtttagcattataataaaatactttagtagggtccatcattttctttccttttttttttttttttttttttttgacgcagagtctcactctgtcagccaggctggagtgcagtggcacgatcttggctcactgcaacctctgtctcgcgggctcaagcaattctcctgcctcagcctccggagtaactgggattacaggcatgtgccactacacctggctaatttttgtatttttagtagagatggggtttcaccatgttggccaggctggtctcgaactcctaacctcaggtaatctgcctgcctcagcctccgaaagtgctgggattacaggcatgagccaccacacccagcccatcattttcattattactaaagtaacaattttggattcccaggttttttagtcatttagtcattcagtacatatgcattgagcaatgtaatcagggataagacacttggggtttcatggaaaagaaactttttatcatagtgctttgtatactatacaaactcataatgctgggggaggggctgaggattggggtgggcgtgaaggataagatatttgaggtttctgagtcccgttttcctcatctgcttagagggagaatacctgccctccccactctgaatgtttgaaaatcaattgcaagtatgtttgtgagccacttagtagagtttatagtactgaacaaatcgttattacaactttgttatgaatttaactgagaaagttttaaaagtatttataactaggaatctaaaagatgtctgagataccccaagttacataaccctcattaggatttacagttttctcaagctctacttgtcaaatgaattaattgtctaatattatctaagcaaaatacttagttaagcttagaataacttttttgtatactgttactttgtctgcattccagaaattaaatcagaggggagaatgttggtttacaggaatagactgatacataatttgcatttgtgtgtcttccctaaggaaaacaataattattagtccaacacaaaaacatgcccattttgctgaagtacatattgagttcagaagtggacacagattgtcctcataatgaccactgtaatgtacctttattgcttcacaaggtgccatggctttggatggtgtggtgaggatggaagccctacccatatgttatttgcactggaccagaatcttggatggaggaaagaactttggacatatctgggccagaagttctctccacctaccaggagtgagcatgggagcatgagctatacatgtacaggagggtcatcgtgttttcatcagggtgtaaagtgtattttgctacatctgatagctctttttatggcaatagctggacaatggtgttgtccattgtgtactgaactgggctgacctgtcagagcaagactttagaagcttagcattatgtcaggtcaggacattatgtgtgaacgcttattcattcatctattaatttgcttatttagcctatgttgggtgcttttaatattctagacatcagcattgtagtgggaaaatccaaaacttctgatacggtttggatctgtgtcccttcccaaatctcatgtcaaattgtaatccccattgttggaggtggggcctggtgggaggcaactggatcctgggggcggtttctcatgaatgatttgtcactgtccttcttggtgctgttcttgtgatagtgagttcttgtgagatctggttgtttaaaagtgtattgcacctccccccacccacttccttctgctccagctatgtgaagtgcctcatgcctcctttgcctcctgccatgattggaagcttcttgaggcctccccagaagcagaagccactatgcttccagtacagcctccagaatcatgagccaattaaacctcttttctgtataaattacccagtctcaggtatttctttatagcagtgtaagaatggactaatatatcttgtgaagtttatattctaaagggaaagactgacactaaataaataaatagtctaaataaataagcaagatatctacataattgtgtgttgtaagggcaataaacaaagaggaaatacaatccctgtcagaaaaggcctctctgaagatgtcacatttgagctacaacatcttcatatgggtcagtcaaccaatgtcaaggacaggagaacaagccaggcagagagaacagcgagtacaaaagcccaaagatgacaaaaaggttggcatgtatgggcaacaggagggaggccttgagcaaggaagggagtggtgtgacatgatattagacaaattagctaggggccaggtcatgcaggacttgccaccattgtttctcacctggactactgaaatagcccgggggctaaaatgacagtggttgggactggagtcaatgctgtgagaacaaactggaagggtttaagagatattttagaggtaagagtaacagaacttaatgatggactgaatgtcaggaaagaggaaaagagaaaaattaaggatgattcttaggttctggcttgagcaatggagtggattatggtgccattttctgaggcttaaaagtcaaataacttgccaaacctcacttagctaggacattgaagtctggtccatgtgaattcgctttttttttttttttaagctttttgggtttttttttaaacccatgagataaggttattaggttaaatttccaagatctctttcagatttgcaattaagttctcatctagattaaattgttaatatggaaatatcctgaggttcagaattaagtaacattgtctggccctggtatttttgataaatatagtgctatgatggaataaatattttatctcagaactaatagccagaattttgcaagtgttttgtctcaagcataaaaagaaaatgattttttcattttctcttgggcataatgtcttttctggagtttcccagcaacaagcagtttgttctgtcaagtaagatgagattgtaaactatctgttataatcctgagctaaaactgcaaagcccaaacagtaagttttttttggtgtcctggtttgtttcagatcattcttaagcctcccaccccagtgctcagcattgctttgcacgtattatttctccagaaccacacaaacctcacccaggataggggcaggtttcctctgtagagacaggaatggagacatttcagtaattcagaataccacctataactcataaccctgccatctggggctcacccattttggccaggtctaagattctgttgctaacataggcaggatagtcctgaaaacttcaccatgaggtagatcttaatttacccatagaaacagtgggatttgtttgtgacaaaggcgggtcatcgatcttaagtatgttcaatagcatgtgagtacagttggctcttcatgtccataggttgtacatttgtggattcaaccaaccacagatcaaaaatatttttaaagcaataaaaaacaatataacatcatacaaattaaaaaacaatataacaactatttacgtagcatttacattatagattataagtaatctagagatgacttaaagtatacaagaggatgtacataggttatatgcaaatactaagccattttatataagggacttggccatccgtggattttgctatctatagggggtctagaaccaatcaccagcagatcccaagggacaactgtgtagctaaacagccacactctaaatctctcatcaaattcagatattacagggaacaacaacaacaaaaaattcaactcaaaaagtctcaaacaagaaaggcatttattgtctcattgaacaaggacagggcagctctaggctggctcagcagttccctgatattctccaggactcaggctctactgtttacctctgtgctctaccatcctgcacttgttgccatgaccctaagggatatcccttcatagctgcaagatggctgccacacttctgggaaacacataggctagcactgggccaaataaacagtcattgtctgttctgtgtctcttttagtggggggggaaaaaaaaaagcctttctcagaagcccccagcagacttttttgagtcctcgtccatggaatgcccagtttctcccatctagatatacgggtattatcctaaacttctcccctcatcctttattctcctcagtttctatgagtgatccattctggtttttaaaaacctgtcacaggagctgggcacagtggctcacacctgtaatcccagcactttaaaaggccagcaggcggatcacttgaggccaggagttcaaaaccagtctaggcaatatagtgagaacccatctctacaaaataaaaaataagaacctatcacctaccctctatccctatatttattacattaattcagatcctcattaattccacctgttctcactgctcccaatttgtctatcttctgcattgcccctggaatcatcttttaaaatatgaatctcattgtgtcactatcctgcttaaaacccttcagtgattcttaatcaaatatgggactaaattttattttatttttctagctgcaagaatgcctccttctcccttttttaaaaagaaatcttgcgtggcagctgacttgttagctgttaacacgtggaagcagagctgtcctagttgaaatgcggctggggaaggggcctttaactcagccagctggattcctccccttccctctcatggaggccctaaagcctttccttggatcccctggagtacaggcaaatggaaacgcctactaggcagttggtgtagacctcaggagtgtcaaccagcctaactgcatagacttagaaagtgtggaagccaaggtcggcgacatgctcacctagaaagtgcagagtgagaagagaagagagtcctatagagagaggactccaagagtgatgctgaagtaatgcctacaagccatgtaatatcccatgaagcaatctttctattttacctttcaaactctaagactgtgccttataggagaatttatgctatgattgtgtaggataatttaattcaatcagatgtttggggacaaagtgaggatatgttgaataccaaaatttcagtttccaatataaaaaaaaaatcaaaaactggtaacaacaatttctaattgtgtggattgtgcttttgcttaattttcattcttatagctttttaaaaattgttttgataatccatgaaattagtcttttttttcccccaaggccttttgtattagaaatcctgtgttaaccaacatttcatgtgtttccatatctgatcaaggcatttttagttaaataagcttaagaatggaatttcaagcagaactataataactgattatattatgatagttattttaattctctctgctcttgatatcaacctgtgtttattctttatgtctatttaagaattcagtgttgttgtttttttttctgttggtgggagtctaaattagttcaaccattgtggaagacagtgtggcaattcctcaaggatctagaaccagaaataccatttgactcagcaatcccattactgggtatatacccaaaggattataaaccattctactataaagacacatacatacatatgtttattgcagcactattcacaatagcaaagacttggaacccatccaaatgtccatcaatgatagactggataaagaaaatgtggcacatatacaccacggaatactatgcagccataaaaaaggatgaattcatgtcctttgcagggacgtggatgaagctggaagccatcattctcagcaaagttacactggaacagaaaaccaaacaccacatgttctcactcgtaagtgggagttgaacaatgagaacatatgggcacagggaggggaacatcacacaccagggtctgtcagggggtgtggggcaaggggagggagagcattaggacaaatacctaatgcatgtagggcttaaaacttagatgacaggttgatgggtacagcaaaccaccatggcacatgtatacctatgtaacaagcctgcacattctgcacgtgtcccagaacttaaagtaaaattaaaaaaaaaaaaaaagaattcagtgttttttttcaagccagcaccatggcatgcacctgtagtcccagctactccagaggctgaggtgggggaattgcttgagccgaggaatttgaggtttcagtgagttatgatcacaacactgctccctagcctagatgacagagcaagaccctatctcttaaaaaaagaaaaaaaaaatcggtcttttttgttgttccatgaaaactaaagagccatttagatacagttgacattcttgttatagaatatgaccttaatgaggaaggaaacgttaatgaagactaattagtgcataattttaacgagggagatatgtttgagtcaagagctgaatgggttgtgcatttcagcaggtatttgcatattgagtgacactgtcaaaaaggaagaggtgaacagaaaggagctggacagggcaggctccaactagaccagaccgttcaactctgtttgcttttatccattcccatgtcaaaaaggatttgagcagagcttgtcctttgtgtcttgtgtgggcttcaggcaagcacgtcttcaatcttgctttcttctgactcgaaccaccctctccctaggcctcagttctgtcaacaccagagctttctctgcttctgtctttatggtctgcctccatcacaccctggagtggacctgtttctggccaccagtctttgctgtcagactttgtataggcaagctcaacctgtcctgacatcagcagcttcctcatgctccacatgattcagctgttggcatttctaggccctcctagaaatgaggagcccaccgcacacccccatccttcccacttccaactgggacttcacagaaactcagcaccaagcagaagccaaaagtgtgtatcagttgactgaaacttcaaacgattttgtttctctcctaatccttttaaatgtgatatgtgtttaagagtagcagagacaaagtgatttaggaaaattataatgttatcctagcctattttagtgacactctaacatggttaagaaaattgactgtcagatttgatcattgttgtcgaagtgaacagccatcattctcagagtggctggagtcaaattctcacccagcagaagcaattttaatgactgaagaatccagttaccacaagaagcaatggaacctgaatgcactgctgacctcccgcgttctctctctcttctatttttcaggcacaacgtgtttgattgctctgctatcagataaagacctcactgtggccaacgtgggtgactcgcgcggggtcctgtgtgacaaagatgggaacgctattcctttgtctcatgatcacaagccttaccagttgaaggaaagaaagaggataaagagagcaggtgagcttgtgaacacctccaagaaatgtctgctgtcttgctggtgaacaaggcggcttgcttggagagctcctggataaaatgtccagttatgcagtattagagaggctgctactgaggtaactgagattgactttgtaacattacctatcaaataaatggccactaaatctgtcttccttcatagccaaagattccaaaagaactaaaaagcccatttccagtttaaaggctaataagatctttgggccccgggttctcacttttctctagcctgttgctatatgctgcttccctcggagccacaactaactactaatcattcctaaaaagaccttgtttctgatacctctgtgcctttgcaagtgctgttctgggtcacaattacttgtcccataaaactcagtttaaggtgttcttttggaagctttccatgtcacactgtggcaagggccttcccattctggggtggatgcccctctgcctttccccagcatcctatgtggacgtcttgggtcaccttttacaatacatggacatacctggctctcctatttgccttgccttcctgtcacctctttgaagacaggaacttggttttgttcatctctatgccttgagcatttggcttagtgcctggtataagtaaatatttcagagcaaggttgggggtagaggggtcccttattcattcattcattggtttattcaatattttaggagctggggataaaacaaaaccccattctcaagctttcatgaaacttacattctgaaattggcatgggggtgaggaatggagtaaatagacattaacaaaaaaaaatagtaaaagtaagtcattcatatagtatattagaagttgataactgctatggaaagacatgaagcaggtaaggggagtgtcagggagttgcagttttaagtagtgtggcctgtgtgggccttgctagagtgatgtttggacaaagactcggaggataattatcagttgattattacattttcataattcgatttcagagaatacctttatacctatgtaagggaagaattctgtaacttttcagactgagagctgcaggatgtatgctcttcatgatgtgccaggcagcaggccagctgtcagaggggagcaagcggggtgctcatgtaccctagtatctgaccaggatgggcccttgctgtctgggttaatctgcacattgactctcgatctctacaggtcagcttctgcccagtgaatgaactgaatgaacctaatcaacattttagttttcacagtagggaaccatactgttaagtcaaaatgtgttgaattttattacaatctcctgcttcagtgactgcttgagttgcaaaatagtttttaatgaaagcattggtcaggttttctgttgatgggatgaaacgaatgatattttaggagcatctatcaagctttgatgacctccaggcagtaggagcaaagttctctggcttcctacttgtaaaacaccatctgcctgtaggagtctgctgtgaaattaagacacagttagctcagtcttgcatcagcatcaggcaaggatgtgtacacaatacacctgcaaatgtcatcttaccattcagtgctctcttttgaaatatcatggccattttatgcttcctcttcttccctgtcatacccactacccacgcctgcaccctatgttgattctttgtagaagcaaatttgcacaccgtctccaaggaggttaatctaacctctctgttcttttacataatttgatcaattgcatattttacacaaggcttaagaaacagtgattggttttaccatcttcatgtgtgttttctctggcctcagcctcttttcaggacatctttccccctcctgcttagcatgacagtaaggtccagccagtctgggccaaatacatgtctttctgtcgccactccttatactgtttccaacaacaacattagctgtcatttattgtgtgcttatcctgtgctggcagcaaagcctagcactttacacatacactttctctttgcctgtcttaagaggttgataatattattctcattttgtagccaacaaactggaacttcacagaggcttatgtgcccaagcacacacagctagtgaatggtgagaccacagctgaaacccaggactgggttttatgctcttgcctactagaccatgcttcctggaatgtcctcctacatatcctgcccatagatgtttcacccatcgctcaaagcccacctttaatgttcattctaccctcatgatcagaactggaaatcatccctcccttctccatctgcctacagcatttagcagacactggtctcgccctgaagaataccactttgtgcttattgtatttaatactttttgtggcttaattctcctgccaggctgtctacttttttaaagaaaggtctggatcttgtataacttcatatcctgcacattgccttccatggagtaggtatttagtaaatatctgacaaatatgtggatgaagaaaaaaataatagatacaattgttaagtgcatattatgttcagggactgtgccaaatgacttatgtggaataagaccttcatttctcaacaacccaataaaatagatactgtctctattttgtagccagggagactgaggatcagagaaagagtttctcatccaaagtgagacatggttagaagagacagagccaggaatcacattcaagtagtctgacctgagcctttaatgactatactagtgtgtgctttttcttaatcttgatcctatttggggggacagagctgttttgagacctatataggcacacttatgagtggcctcaggccaaatgatatatacggtgcctgttcacctgcctttcagcattcctttgccactctcctcaaatccctaccctcatgctctctactgtcaatcactgagccaccacggtgttaagttaaaaaccaatgccctcccccatatgtatccgccaccttcagtactcttattgatatattattgaaatccttcaagatgccaggatgagggtatgaggatcaactggtagagtataaaaccccaggccatgcagtgggtcccaggagtgatggggttaaggggagtgcccacagcccagttcacatgaagtaggtcaccctgttgcgcacgtacctagactatcccaggtaagtgagatatcagctggtcaaactaatgggctcatcctgtctttctaggtggtttcatcagtttcaatggctcctggagggtccagggaatcctggccatgtctcggtccctgggggattatccgctgaaaaatctcaacgtggtcatcccagacccagacatcctgacctttgacctggacaagcttcagcctgagttcatgatcttggcatcagatggtctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctccagctgccagtttttgtgtttttccttgcccctttccaagtggttttcaagtgtcaggcagtgttctgagaagcagcagcctataactgtatgtgtgttccttgaagccaggtgcagagttcccagctactgcagcttgggatttggtgggaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccacca

SEQ ID NO: 959 - DNA, 397906 bp, Homo sapiens
aaagttcaaatcatttgagtaagagtttataaggacacaagtcaacctgaactaaatacatacatacttctgcacaaatgttgtttaccgtatgttgggtaatttggaggaaggtaaagtgattagggtctcaaaattttgtccaaagccttgctttcaagttctctaaaattggagccaatgatgcctcttgtatctgaggcaggcttaggagtctagtcccttctctcacccacacagggagaacacaggcagctcagaaacatttattattaattttttcagtcacagttttcatcttgagaaagtggcaccctcgggagagcgctgggaatgttcagagcctgaatatcatccactctccaagtcccagaaagaactcaacaaagtctcagtcctaatgaagcccaaaccaagtgacctcttagctgggaggctttgtgcattttaaaaaagactatgtaagcttgtttcccagaagctctttctgtctgaccccatctgtcatcccatctttttccctgatctgttgcataatagctgagggaaagttgtgttagagtgtccctccatcgctaggccagctcaactcaatggcgttagtatcctgttcaacacactccattctgtaaagggccatataaaaatgtggcctgtcagattcacaaaagtggtagttgattttattagactagtagttttaaggctagtagtttagccatttaaaatctatttcccaaaagaggggaaaactagtatttttcttctctttttaaaaattcattagccagttgctatcaaaaagcaaccttttgggttggtgaaggcaagagagttcttaaattactccactatgtagttatggccttcagcctaaggagataaggtacatttattgtgctgtctctcatcattggaaattttacaacataccatatacttaaaactagtaggcagacagaatttaaaagactcattttcgcagtatgcattctttccccattcttgcagagtaaaggggtaaagaaaaaaggtaaaaacctgaaaacccaccataacacagcttaatcgttaagagcacacaatatttgtttctatccctaattccgaagggcacatggtccatctttgtccacagacaaggcagcattcttggggatctcctggaaattcctgccacctttttctctccttctcaaccaggctgcaacattgaaagatggactgtactgggaggggcggagggagaggaaaaagggaaagcgatatgttcaaccaagccttctgattctgcctctagactggcataagtccacatgagttatgttcttttaaattagaaataacgccatgaagataagtgccaagtgctcttctgttaccagttcatcatggaatttctgttgagggtcatgaaaaacacttggctacttcctccagatcgcacggatgcaaaaaatacctgtttgaaattaaaaagaagttagttcaactgcatggtcttttcccctcttttcttcaaccgtccatccattttctctcacatgtcctatccttgccatgtgtcaggtcttaagactcaatggcttgtgtttataaagtccctttggatatcgtgcatcctatgtaaaaactcctgcctttattcctaggttgttattattccttattgtggtattggtctccagagatgctgaaggggctatatcttcatttgtaacatctctttgggtgttcactttttaaaagggagtttcatgctaggataacgtgctggatttctggtctaggacccaacaggttctttgttaatttctagaaaggcacagaagcttcccttctctcacccttaaatgacaagaaagtagacttcaggatggaagggaatcccttcaaattctcaaagtcaagggggagttttaggcctactgactatcatacagtttcagatttcagttttttaaatttaagataaaaacattaaatagtgtggtcagatagggcaaggtatttaatgcctactcattttggcatttcaagagttaacgcatggtttctctgctgatggtggcatatcccagggcaaatgagatcatagcattaatgaggagaaccacagtccattaggtctgagtctgttaagtcattttatcaaacaactgacaaacgtgagaaaaatttgggttactgcttgcttgagctgaatgtttaatgttaaagaaccactgccccaggaaagtaatattttgggctatggcctagcccttcagtcagtcaatacctaacttttgttaggtagttgcttttgtcactagtctaaagtctctgctacttcatttctacagcttcttcagaagaatgctaacaacaacttcttagggaggtctctggaaatgcttgacattcacctaatgctgcatatgaaagtaatgctactcttagggtcaatgaatcaaaacggagaaggacagagagggcctatggaaaaccacaatgaagaaaagaaagggctgctcttccctccaagttgtgtgcccctggctgtaaaccttgggttgcagacaactggtgtggccccagcctactcctaagggtgtggcatggcttggaacagccctgctggggtaggttttcaatcggaatgtgggtatccatacccagatcactcctggttttttgattcttagagactgggtgggagctggagttttactaggttatgtttgttttctgggaaatctaaatggctggaaccatctttgccacctgcagctactgtccacccagaccacatcaggtcagagtagtgggccagggttgaatatagtttaggcccacatcaccaggtttggactaagaccaacctgacctttggggaactggggtggacaaagggatatacaaaaattcaacccatcatactgtttttctataggcgtttatgtctgtggctttggggacagcatttctatgttggccacagccacaaaggatgaattcacaaatgcagtatggcttagctactaaaacctcggggttactctacagggagggtaagggagaagcagtactgctgcagaatacccctctgaggtcactgatcatgccagacggacacagccaatttcactggaaaacagttcacctatgacatttcagaagaaacatggctggaatgacacaagacatggcactagttgagtttgtgattgtgcattccttaaggaatgggtgacatttttaaaaagcttatatttctaaacgtcaaatgttttggatttaaaggtgaatataaggtgattggttaggtcttgaaagtgactttgtgaaaagtctaaaagtggaagtataaagttgacccactgtgagatgattaatgatgggccaactgctctaagtgcttaggagaatttggggtgtctgctgagtcatcaaaaggcctttaggccacaaaggtttctaagaggtttacaagaaatttctaaatgtttttatgtagtttttgacatgtgaataatatattgagtgctcacatggatcaaaccaaataatgccatttcaagataatattgattgtttaacacagatgtgattcaaatcagtataaaggaaaatgaaggtttcacaggtacctggtggtctcttaaaatgcaaacactaatgcaaatgttgaaacggatttaccttatcatttctttcacatagaaactttaacctttgagctcgcttatgcataaatactccatccaaatgtcctgtttccactgaccggatctcaatagctttctcgccccagcccattatctgattggaatgaatgtaggctgtcaaaaggaatttccaaaactgcattaaaaacattagatgggcaataactcacagcatctgttcacatcttaaccacaaaaatgacaaacgacttgagataaatggacaaagcaagtcttacaagagttattcacagatttttttttttttttttttgtggaatcaaatggttgtttcacatttcttgattttcgtttcatttggggggtgtaactgctgaaggagataaggaatggttaacctacccacagacgtgggcatttctccccattggagcaccacatccttagttatccggccataggtgtttacatacaccccctcatcctcatagcaaacaagcatttccattccatctgttttaggcaagatgacaatagcatgaggagtgatattgccctgaatctagaagacaaagaaaagccaagcattattcttttaaaaaataaaacaccttgactattcatctctaacaactgcaaaaaagaggtttttgtttattttcattgtcaccctaaagactgaaatttgctttaatttaaccactgacttgtaaaataccctggtaaatcaaacttagtcactagattaaaaattcaatttacctgttcctaaaaagagcatgtaaatctatggcacacctactatgtgccagtcatggggccctttacatatataatttctagtacctacaatagctccccaaggtagatagctttgtttacagatgaggaaactgcatctcagaagggctttgtgtcttaaccaaagttgtgctagtatttgttggtagagttgggatttgtgtatatcttgctgacgttgaaattaatgtgttttctattagcacaaccacttccaaaagaagatgaggagaatgtaagccagctgaatctaatggagatagcttaagtggggtcaaaatgaactaccaaaataatctgtgaaaaaaaaatatatatataggattgtttatccgggtgtctaaatgccagaataattcatggcttggttagaaaaaatatttagaatgaccactcattaaaaaaaatcattattgccgcacacagtggctcatgcctgtaatcccagcactttgggaggccgaggcgggcggatcacgacgtcaggagatcgagaccatcctggctaacacgatgaaaccccgtctctactaaaaatacaaaaaattagccgggcatgatggtgggcacctgtagtcccagctactcgggaggctgaggcaggagaatggtgtgaacccaggagaggcggagcttgcagtgagccgagatcacgccactgtactccagcttgggtgacagagcgagactccgtatccaaaaaaaaaaaaaaaaaaatcactattgaaataagtgtatattaatttgttctaggaaaggaaatgtgatgttgttgtgatcccctagttgagaatgccatggcagcccaacatgtgcttgacagattggactaagagagttgaggattatcatagttacaccttagctgcctcaccaggaatgtgagctgtgagtccttgtgttcacccacatccacatgagttaaaagtggtaataatgcagcaatgaatggcagtcgtgtgtgtgtatgtaatatactgaaacaacttcttttagttattgcgtttcattagaataaagtcttaaaactctcaaaataccagtcagcggtagcttcaaacattcctgataaatagtttctcctgtgtgttagtcttgggattacacacaggacacacactttacactacacttaatcctaataagtgaatccatgtgcagcatttccctttaacagttatgtttcaagcaatatgtcaggatagtaatatgaatattttagggctaataagaagatctacaatttgcagggccctgtaccaactgctttagatccattacctcatttaatactaatgataatcctatgggataagtctttttatccatattttacagatgcgaaagctgaggattggagaggctgcctactgtgtccattactgcaaagctaatacatgctagagccactgtgtctgactccagtgtaccacactgccctcaagctgaagagaggaactaaaaatagcaaaaaaagaattttctccaataaattagtacctgaccattggctttctctaacataaaatgaacgaatttcccttcaaaaactgaatgtggaaacttgtctaccgaatataattcatgcccttgaaagaaatatgtcatattcattttaatctaaagtccaaagagacaacatgtaaatgccaaatgatttctattatgtattccccaattttaggaagtcataaaaattagttaaatttatatattttagttattaaaagcagtatacttaatgaagaacgaaagtccatttgctggttagtaaagtgtgcatgacttctactaaaactatgcaaaacaaatctctttctacatgcaggctgttgtacagagagcccttgaaagtctacttctgagtacttacatgagatggtatgtagatatcataagagtttcctgaatcaacatcaattacatggaaaccagtgtgtgaaccaaaaataacctttaatctttgaccttcttctaccgtgagatcaactagcagaggcttgtgctggagatctgcaaaagactttaaaaatcaccccattagtatccgcatcactcaaagaggcatcttaatttttttcctttagccactgtctagaggaagttaacttctaactttattaaagtgaaaaactagaaaatttctctttcagttttaggtctgttgatattctggccctaggaggaagggtctagcatccatttgtgcccctttctctaccctttgtccttcggggcagtgaagtttaagttggtgcacaggtgtaaattttgatagtggtaatgtatattaaaaacctggtgcctgggtattgctgttttttcctgtttatttctggcctttgtcctctgaagaaggcccagtcacctctctggcccccctctttcccatgtggcaaccaggcccatccacagcaactaccctttcagagacagcctgggagggacagccaaggccggctgttttctcagcctgtttagtattaatgggcatgctctggtttggatttttcttcagtgaatgagtaggcataagattggcactttctcttaatgttggaatctgagacttgggtttgggtggtagagaaagaggtgggagtggaacatcacaagattgatggcttgcattgactatttgggtttaactagaaagcaaaaagagagatcttgccaagtttgtcaaagttctctgtgtttgaatccagagcccaagccccaactaactgtcaagtgttcctctgccattttcctttgctattttttaaccacgctctacctttgggccttgagatctgggagagcatttgtgaaactacaattgccttaactataatgccactgctacctctcagacccttctcttctcatcttttgctaacaccattctgacagcatgggaagctctagcgtcctgtccttgtcctatgggaaggcttggcctcttgccagttccactctttcctgttcaagtctttgcctttgctcttccctctttctgggctggatagggtctgtcagaaagaacattttgcactctctcatgtgtctctgggtcataaaataatggcaataacttcagagcaagaatgggaatgggatgttgattgaaaagcttttgtggagatagattttggcagaacaggagtaccactttggcttttaggagttatcccttgttattagtaacctaatgcattccaatttttttccataaaagtgaggtcatggaggggagcccatttccattaatgaatctattttcttgagcacatcagaagccatctgccctaagggaacaagatagaagtgattcagctctgaagtgggcctacatggtgttccaagggcagttttgcccttcatgagaatgtggcagaaaataataaggagccaaatggagataacagtcataaaggtggggagaaaaagtgagagccaatgagacataaagaagtagacagacataagctgagagagagagagacagagagagatcagagagagagagtgagagaaaacagaagataagttcacttgggctatggataggttatgcggctctgaacacatctgggtgcctgtaagtactggtcctcctggtattcgggtgtcagcttcatgagctggggtcaacaggactagcatatccccatcccactcctggcaaatctcatgagtgaccaatccaaccatggtgggtacagacttagacaaggtaaaaaaatgaaaaggcaatcaaaatagaagaatgcagagaaactaggtcatttctgtaagttagcactggggacatataagcatcacctgagttttagggacttcattcagaaagatttatgaggattaaaagagactcagtttaactctgagattcagtgctgccatttgtctgcctttttcaaacaaaatatcagggaataccctggtttaggtggctttataacaaatgtcattgcataagatcataatcaatgctatgcctactaaccattctaaatgcctcttgaggatgatgattcatagatctcaaggaggagggcatacccaaattttaatctaattttatagcatttacaaatattcagtctttacttttgaaacaataaaccctagagtacctacacttttaaaacaggtttattatctatatgaaaattggtattggtctatatggactattttattaatgggtagaaacggaaaatttttaaaaagcacattttagataatcacatccctgcttaccttaaatgccatgaatttatgatacggtttaggagcccaagcatatatttccacagcattctttaaggcaatcaccaaaaatttgatcctttcatatttaactgtaatagaaaaattatgagtgaaaaagtacatcaatttactcaagttctttgtattaatattaatgaatgtataagcaacaatatgtaaatttaaatattgatgttgggtgtcagcttcatgaaggtgatattcctggtgtgggattttttcatagatactgatttagcttcccttagcgaactttggttggcagaatacttatggcttttgctttatattgaagacttttcatcatccagagatataactgcttaggactgtctttaacactaggtcttgatgttgatattcattgtaataagaatgtgcataatttccttcatgttagcttgcctggcttttacgttcacccatatttaagtagctgagagcagatatggcaagatggtagaaaaattagcaaatgggcagatataaaggctgccatttgcttattatttatatttgaattccaattaccaagtgaaataattgcttatttatgcttctaacgaaaggggggtgttaggagtcttgggttctgttagtggcttaaagggctacgaatactgacaaatccttttactctttagaaagatggaatattaagcattgtaaattctatggacagaagcttagttaaatgattgagtccccacaatgcttttgcctacacaaagtagtactcaataaatgcttattgaatggaaaaatggaagaacagactgttgtctggcattctcttcattactcttacctacgtgtgtgtctctgatagaataataagcaatgtttacggtgatgaccttgagaaattgaacaatcctttaagtgccttctgaatcttttgctgttaagtgtggattctaattcttagagaattcgtaatccacagttggtacacatggcagtcagtttcttggtaaaatatctcaagaaacagaatattctgagtcctaaagaaactaggtaggaaaaattttaatatacttaaatgacattaagtttccagttacttgctttataacttttcatgacataaagtgtttattagactatttttgctgatctcttcatctgaaacctaggaaaagatccacagctcttggcattgaaggaacatacctcaaaataataagagccatatatgacaaacccagagccaacatcatactgaatgggaaaaagctaagagcattccccctaagaactggaacaagacaagaatttccactcttaccactcctatagtattggaagtcctagccagaacagtcaggcaagataaaaaaataaaaagcatccaaattggaaaagaggaagtgaaattatctctgctgatgacaggatcttatgcctagaaaaccctaaagattcctccaaaagactcttagtgctgataacttcagtaaagtttcaggacacaaaattaatgcacaaaaatcagttacatcaataatgctcaagctgagaatcaaatcaagagctcaatcccatttataataacagacacacacacacaccccacacacacccctaggataatacatttaaccaagaaggtgaaagacccctacaaggagaactacaaagcactgatgaagaaaccacagatgacacaaatgaatggaaaaacatcccgtgctcatggataggaagaatcaatattgttaaagtgactatactgccaaaagcagtctacaaattgccaatgttgttttttacagaattagaaaagacaattctaaaattcatatggaaccaaaaaagagcccaaatagccaaagcaatcctaagctaaaagaacaaagttgaaggtatcacattacctgacatcaaactatactgtaagactgtaataaccaaagaagcatgttactgatacaaaaatagacatacagatcaatggaacagaatagagaacccagaaataaagccacatacctacaaccaactgatcttcaacaaagtcaacaaacataaacaatgaggaaaggacaccctgggaaaattggctagccatatgcagaagaatgaaactagatccttatctcttaccatatacaaaaattaactcacgatggattaaagatttaaatgtacccaaaactataataagaaaacctaggaaaaactcttctggatattggcctagacaacatgtttatgactaacacctcaaaagcaaatgcaacaaaaacaaaaaaagacaaatgggacttaattaataagctaatgagcttctgtgtggcaaaataaacaatcaacagagtaaggagacaacctacatgatgggagaaaatatttgcaaactatgcatccaacaaatttctacaaggaatgcaaacaattcaacaagaaaaaatcctattaaaaagtgggcaaaggacatgaacacacatttctcaaaagaggacatataagcagccaaccaacagatgaacaaatgctcaatatcactgaacatcagagaaatgtaaatcaaaaccacaatgagatgccatctcacaccagtcagaatggctaatactaaaaggtcaaaaaaaaaaaaaaaagatggtggtgaggctgcagagaaaagggaatgcttatacactgttggtaggaatgtaagttagttcagtctccttgggaaacagtatggagatttctcaaagaactaaaaatagaactaccattctacctagcagtcccacttctgggtaaatcccaaaggaaaataacttttttttttttttttaaatcaaaagggcacctgcatttgtacatttattgcagcactgttcacaacagcaaggtcatggtatcaagttgtccatcaatggttgattagataaagaaactgttgtatatatacagcatggaatactatgcagccataaaaagaatgaaatcgtgcccttggcagcaacgtggatggagctgtaggccaatctcctagggtaaaataacccagaaacagaaagtcaacacatgttctcacttataagtggaagctaacaatggggtgcacatggacacaaagctggaaataatagacactgaggactctaaaaggggagtggcaggttaagggctgaaaatttacctgttgcgtataatgttcgcaatttggctgatgagttcactggaagcccaagcctcaccattatgcaatatacccatgaaacaaacctgcatatgtaccccctggatctaaaataaattttaaaaagaaaagaaaaaaaaatcccttcagattttgctgattttcagggtgaaagaagaaataaataagtttatatttttaaagaaatttaaaatcatcttgaaaataaaaacttatctaagcacatataggctcagataaatcaagaaatattttaaatgactcttggatatacaatttgcttttcttttttattctcattttatatttttaaaatttcacaagaatttgaacatactagaatactcgtgctacaagaagatgtcagtgctgttgtggctggaatttcataggggaagctaagtggaaactacaagtggttctttggataactaaggcaaacagtgtttctgaaaattaagctggtctcaagttttctgatagagaattaccagatattgctccctggttaaattttactttagatgtgtggatatagatcagcctactgatgttaggacaatgaagggacggcaatgattagaaggaagacgtcagaaatgttagaagggccaacagtagatgtgcaggtcaaataggattcctgtagcctgatgtttttgaaaaacacttgtcaggtatatgcaagagataatattcagaaattttgcattatttcctgcaatgaattttattgctctgtaatcatacagtattagtttatggacacaaaatttgatcactagaaatctttggactaacaaatgccaagtaataaaggcaaaatactcaaaaggaaacagctttgaaattgtttctattgctttcccctgaaaacatgacctgttctcaaagaaagcagctcactattttcaaaagaaaaccaaatatgcatatgaatctgaattctatttggtgtgagaatgatgggatgtatgttttatactttgccaaattatcagattgaggacaagaaaaaattagaattccagggtatccctattagaaagtaccaaataattctgattcctgaacaaaaatgtacagtggagcaaatagcttgcactgctgcccagcctgctatagaaaaacattcccgcatgtggtctggtttatgaataaagctatgtcctttgaacatccattcctttttaaaaaaacaaatacttcttaactgatttccctgggcctggctctgtgctaagtgccggtgagatgtagatgtggctctggccacatacgtttacagacattaaacgttttttttttttccaaaagctgctattttttttttttctttgagatggagtctcgtactgttgcccaggctggagtgcagtggcaccatctcggctcactgcaacctccatctcccaggttcaagtgattctcctgcctcagcctcccgagtagctgggattacaggtgcccatcaccatgcctggctaattttttgtatttttagtagagacagggtttcactatgttggccaggctggtctcaaatacctgacctcacgatccacgtgctttggcctcccaaagtgctgggattacaggcgtgagccactgtgcccggcccaaaggctgctttttatacttatcaatacatacattatctatgttgtaagacatagataatgttgtaaggtcaggggctttttttttttcctttgtaaaactgtgagtgacatgttattaagtgaggaacatgtccttctcaggcaccaaaccttcaggttcactagccagccccaacacttcctaatattgtgtcaaggttatctgggaaggtcacctggaatgaaattagagaaaaggcaggtggagactctgcttcaaaatagagtcccctttctagttggcaaaatgtgatacactgaagttctttctttctgagctcttctttatagcatgccccttctgtttccacattctgtatttgatacacttgattagatttcagccgacattatgtcatcacacatgattggacccacttgactggttaaaatttcaaatgtgtctcatacttttctgagaccacatcatggactcctttgaactgaaggtgtctaaagttcctccgccgctcctttattgtcattctttatgttaaataattaatgtattttatctagtacacattttaaaagcctccacacattttcttatcagctatggattgaacaagtcttacaggtacctattttaaaaagccaaagaactctagggcttatgaaaaccaagtacctgcctccctgctgattcctgctccataaaaacaaccgcttgcaactctttcaactacttctttcagcaatttgtttccagatttctaaataacatgattataatgttattccttgatttttttttttcagtcacagacattatttactgactttgtagtatggaaaggatttaatttctcacatcatttccttctctctctagcttcttctctttcttatgcatatgcacacacgatttacttctgtaaactctaaatatagctgtattttaaatttttggttaaatcaatattgagtgttaaaattattattgttcatgactgaggtatgtagtataccatggttacatttcctttcttgttcccccccccctttttttttatacttgttttctatgtatctctctctaagcacatgtaaactttctgctgataaatgcccttcaacatggtcaaacgcagcaggtcatctatttataccattttatttttcttggaggcatctttcctggaaccctgcattgtcccactctgccaggacttatttctttctaggcctgtggcagacttgtcaccccaggttcccttcaccatcattctgggtattttcgtcatcttcctggactactaggtttagttatttattttggtggaacacatccttcagttgcttcctgagaaatggtgcatgaaaagtaaatttttaagacaggagtaaatcatgtgtgataaagtagactgccctccccaatgtgggtgggccttatgcaatcatttggagaccagactagaacaaaaaggctgagtcttcctgcttggttgagctaggacatcagtcttttctggccttcagacttggactgaagcatcagcgtttcttgggtcttgagcctaccagtgctcatagtggaacaacaccatcagctctcctggttctcaggccttcagatttgaactggacttaaaactttggctctcttgggtctgaatgagcttgttgactgaaaatcttgagacttttcagcctgtatagtatagtcatgtgaaataattcctcataatctctctctctacatatgtatatacacatatatatacatatgtatgtgtatatatgtatgtacatacatatatacagctgtatgtatgtatgtatatgtgtatacacatacacacactcacacatatatatatatctccttaacccttaacacaggagggctataaaatactagttggaaataattctgttgggaatttggaaggccttgctgtattgtcttttaagcttctatattgctgctgagacgtcccaggccacacttattctgggtctattgtatgtaaactgtttgttatttatttacttatattctgacagctttgccagttttgaaggccttctcatttcccaggtattgatatatcatgttgatatgtctttttgtgagtctttctttcatttagtatgctggacactcagtgaatcctcttaatatgggatttcaaggcttttaattctagatacctttcttatattctttcttcaatactttcatttcatattctctaaaactcttattacttagattttgaaccacttggactgatctttttattttcttatattttctctgctttgctttttgttctactctttaggagaattccttatcttctaacacttttattacattttttatttctgccaatacattttagtttgcaaaattttttcttggtctctaaatgactttcccctactttgttctacctttttttttaacagcccttttcttgttttatagaaagaagttttctaatctctgtaaagctattatagtttcttgcttccttcctttctttctttttacattttcttccactccttattatccctgtttcttctaacgtcctttctttctgtttgtttaggtttccttcatatttgtgaatttctccactccttggtatagacaggcttatctttagggtagttaggcagcaagcttttttcatggcacttcaaatgttagtacctgtacatcttttctttctggccatttagtttctccaaagacatttcttacattctcttcccagggagtataggcatggctatttgggagctaagtaggggttagagggatgtgtatgtgtgtgtgttttcacaagtattcccagcatcatattggctgtgcaaacctttcatcttctgttgcagcagaggaaggtagtggcctaattactcagaggtggagactgggttctggaagacttgctgctcatgaattttctaacaattctattttcagtcccaccttacacctccacttccacctgagattcccctggggccttagttcctgggcctttccaggttctgttggattgattttgatcattttcctcactgcagattcagaattcagaatttcctggtattctaggtctttttccagtcactcagctactctttcgattttaccgacatttcttctcttctcttggtcccactgtcctcataggcttatggcatttttattcttttcttgtcattttaatgagtctttggaagaaagtagatataaatgttcaaactggagcctaggactttattctgaatgcactctttcaatttcatcaatctggcttttaaaaaatataaataatgctgaaggttccagcaacatctgaagctggtcacacatgcatcatcaatctgatagaaaaaactaggtgaaacctaactaagtaagtctgattgagtaaacagaccaaacttataattccatgtcttgagacttaccaactttataatgtatacagccttccaagtccccaacagtgatccagccttgtttcttttctacttctgggtcattatgtagtattctgtttcttaaccatgaaagatagtaaactcgtagcttattcttctttcctgttgaaataatagaggtttaatttcaaattgctgtgacagctctcactttttccttccccacctccatttatttctaatttattttatttacgtgtgtgtgtgtgtgtatgaaggcataataaccagtgtccccagcactttgtcattaaaatggtgtttctgccagaacttatggttaaaatagctctacgtgttttagacacatcacagaattacaatgtcttttatcttcaggtggtttcttatttgagcatgtgctcttactctctcttcccaatgcaaagcagtgtctgctgaacttagtaagagctaactcttcaacagagtgatcagagttccagaacattctagatcaatcacatgaagaagtgttggcaactgggcattttggcacctgcctttccttcaccgtataacctaataacaaacaagaggataatatgggttcagaaaattatactgggcaggtttatggtgctgaagtcactgaaaggaatactgaacaaaaataggaaaaaaaggatgcaaacttgaaaacttaaatttccgtttggtaaagtgatcttggaataaagaattcataggatgataaaatatttagacaatattgaagagtacacaagtagcaaaacttgatatactccatttgatgatttgcaccagataaaatgtccattgggatgactcttcctaactaatgataaatttagctctatgggttttattttttggatacttatttttctttatcttaggctttaaaaatgttttatttatttatttatttatttttttttgagacatgagtttcacttttgtcgccaaggccggagtccagtggcatgatctcggctcactgcaacctctgcttcctgggttcaagcgattctcctgcctcagcctcccaagtagctaggattacaggtgccgctcccagcatgctcagctaatttttatatttttagtagagatggggtttcaccatgttggccaggctggtctggaattcctgacctcaaatgatccgcccgcctcggcctctcccaaaaaaaatgttttatattttatagatgaatatataccagcagaagagaacttagtaaagcattacacatgcatttgacaggagagcacattcatcacctaaactaagggaatcattgtgtggtcagtattcaattttgtaaccaaaggcctagaatccacattgatcacagtagctaggatggacacgagagccagtgtttcctcctttctatgccaatatgaatccaaggttagttcaagaatcttttgctcctattttcattttctcctttccctatctgtgcctcatgagaaaaggaaactcttacactgttaagaatgaagatgtgccactaacaacataatgaagtctgaatgtgaattttctggttgcattcccacttttggcagatatgcagttttcattttgatttggtagtatagcaatcaggacagcaattaaccagaacaaaagactacatgggattaaactcaaatggcaatacaaaaggaatttacctggttaaccttatttggggagaataaaaagagatgaaactgagcattcagtggaaaggtaaaagaaagaggaagtttagtgacaagcaaaagcattttgtcaaaatggaagtacagctgaactttgaggaaagttcaaaccagcatccctgtgttgtctcttcgtgaaacaatggctgagcataaatccatgttctcaaacttggctgtacaatggaaacacatcagaaactatgaacgctcctgatgcctaaaccccacccccagagattctgactctggtctgggggtgcagcctagattttcacatctccctaggtgattataaagtgcagtagcaagttggttccatactagatggaatgagaggggaagtgacgggtgttactcgttaaactccttcaaataccaaaaagaaaaaaaactttcaacaaaactaccctcttttaggttgcatttttaacttgttacaaggccttcactttagtctccatctttttttttttttcctatataaggctctttttgggaatcagaaagctacagagcatagcagtaatgattcccacactcaaatctttttgtagacttgatcacccagtgtgccagctgcacctgccaaaacatcagtgggctataagcaagagaatttttgagggaagagaccaagaaatttctgcttactaaatgtccctctaggaagcctgcattttgatattctgtctgtatgtggtaataactggagtgcagaaaccttaaaaacatccgaagatccttgctgagtcctgacagaggtaaagagctataaatatatagcctttgtggtatgtctctgcctaattcagatttaatgcagaggtgagagacttctttttggaggtcagaattcccagtgttacaaaatgtgggcaatctcactctggctatactgctatactttattgtgttgtttgttagctgggaagggcagaactaactgtttctgcagaaatgaggtggatccctttcccgctgtatggacctgggggactcatcatcttagtaacatacctgaaattgtcacaaggacattcagtccctctagcacatccatctgctgaaatcgcctccggttgatcagattatagactttgccttgcccacttcggtccaaaagcatcaggccattttcagtccccaccagaaggtttacacctgtaaatttaagaagcaccctaagactgacttttcatgaactttaatcttctgcatcgagagtccctataaaatttaagaaactgtgacttgtaaatatacactaatgggcaagtaggtaaatataaactaatgaatgtagaagctctgacataataattaaatcattgtacttctggtaatgaaattacagttttcttttataaagttagcagcattcatacatctagttatttactacctaatgcagagagtccttgtcaataggagccttaggcacagatgtgaagctagcataatttgcctttattccctgcctggaaaaaccacttctttcttggctctccctataaatcacttctcttcttccccaagattcacccccacccctatgcagtggtctctagcctacccaccttcaatatacagtggaatttccatttccatactccaatggaagaaaggcccttcctccttcttgaatcaaaatgtaactatcttatgccccataccctcaagtttttgctcttttttagggaaatgataaacccattcaagagaagtgttaatagctggagagtcacagacatactcactttaagggacttctcaggtctctaaatctagtgcagcccaacacccatgcagtaatccctattacagaagcacaggcacataagtggctttgtctgggtagttgtaatcctaaaaatttatggctagggaaatgtatcatccacccctcaacacacacacacattgagaggctcattgtgcagtgtactttattcatgaacatgtaactctctaacttctcttacgtcttgtacttctatcttctgatcaacacaaatgtctgcttttttgtccatatattaatcctttcagtattaaatgtggctatcttgttctcttctgtctcttctccagaggacagagcctctatcatgaaatggttcctaggcttcacactcttccccgctaacatctcaaatgctttcagccttttaaaattatggttccccaatccaagcctagtattttcagtgggtacacaggggacatgtccttccttaatctgtatgagatgtttatagtaacacagaccaagactttgatagaatctcatcatgcctctcctgagtttgaggtcagctaaaacctgcagatctttttcacgagaaaatgcagattgatgttttaaactaaaagggaaagttcattaaattatttgttgttcttttcaagttttatcttgttattgctagggttatgacctttagtaattcacaaaaatactctgggctgatttttcagcttgaaataaaggtttatgccattatttatgctcatattccccttgcaggatgtggtatggatcatggagaatgaacgtggggtatatcacaaagtgccagacacaaatcgcctctgattgatcacattataggctttgctttgcccactcaatgtattcagtggtagctagttctcttgttggctttagcctatcactattgtgtgacaaggttgctctgaatctaatctcgtcttcctggctagtagcgtatcagctatttctacatataaaactccttttggtttctcctgaggtcaagatagtcccaagttaggtctctaatacccaggattcaaccagtgttcttttgatgacaagatccacaggcttttaatgtttgagggtcagttcattaatgagtggttatttaaaaaaaaaaaaaaaaaaagcaccaacataccccacagagctgcacaaagtatttctgagttgaatcgtttcttgtattttctgatttctggtgtgtcgctatgaggccgaatgttggttgggtttacatttaccaccgaaatctttcttgcttcattgagtttggcctgttcttgcctaagaagttcgctagtaaacagagctttgagaaaaagaatcagagaagtcagtgacatcttaaaagataacttatggagatggggcttcaaaacactatgatttctccttgtttggtttgaattatagtaaaggcaaggaaactctgaaactctccttattttacactttttttttgttttagtagaataaagtctaagtcattcatcaaaggaatcttttattcattagaaaaacaggcttatagacactacttgcagagtctagaaagtcccaaattaaatacaccatccccactcttgtatataggcaaaaaagatctactttttaaaattgcagtttatcagttgaaaaactgtcctaagctgactttgatgattaattacttgaagaagattagaaagcaagactcctttaaatcagcctgatctttgtggtgggaagcacacacctagaactcaacacaatgtaccatacacttattaagtgcctaatgtgtgtaaaacattgtacccagaaattgttttggggaaacatttagttatgttcagagatcactgaggaacagcttttcctagggtccctatgtacccctgggtctaccagaaacgaaatagaagagatgggaaaaaaaatggaaagtaatacatttgttttaggagtcctacagaaataataattttaaaaagtcttccttttaagataggacctaagcagtaatcagcttaactactgaactgaggattaatttccttatcaggtcataccagaaaggaagacgaagctgttttttaaacacagggcccttcttgcttacctgcggctgatgattcctcatcctcttcatcttcatcagtgggagacgtctggtatactctggggtccacaaagggggtgaaggaggctttggtgctgctccccatgccatactaatcaataagcaagaagattaagaagagcagataaatactgcaggaataacaatgctaacaatactgtgcttgggctgtaaaacgatcacagattcttcaaggtattcaggtgttcacattctagtgctctagtcagtgcgtgcctgtctccagcttcttctggtattggttactcactagtcattgtgcattcgtaggacttcattaattatcagactgcaagaattgtagtgagaaaattacattttggaccacatgtggcaccttaaaatctgtaagatcactgtggtgacagagcttacctctccctttcagtaaaagcaacctcctatattgactacttgatcaatatgaaaagctgacataattggcaataaactaagtaaggaagcctatacagcagtactttatcctgaacagagtcaaaccaaggggctttctcttggggaggagagctttgagcccttctactctggcctggtgatgcaagtgaattggtgttggctccaaaagctttaaaatcctcaattcagggatgattttatgctggaattgaagatatttccttcccacgatagtttccttaaaagaataattacatttacatccttatttagggacttcatgaggatattacgtttgtgagcaatgtaccttgaaggcttactttaaaaaatgaatcttgggcttgaatggcaccatgaaaacatgatgtcagaaggagatgagggaacagtaaactcaatatcagggttttatgtcacaatattctaaatttgagttttgctgaataagctgcaatgtcagtcatgtccatttcttctattcttgtcctttaacatcataaacacatctgtattcaacataataagcacatcttttttggataaatatctttaactaaaggttatttcactttagttttactgttaggtttttatttaaaaataaaaccaccatccaagacctctaaacatataaggagaaaaccacaaagatctaatctgatttaattcaagattttctttccatcctatgaaatcaaaaccatttcatcctcctcaaggttgaattccccctaccaaatagaacactttcacgtacatgttctcttttgatctttggaagatgtctgtgaaagaggtagggcaggcactaacatttccacatagagctggggcagcagcagaatttgaaccagggttcaatcttatggtgtcctccttggtaccaagagaggtgttcaggcagaaaatgcccacacagcatgaaattacaataggatgctgtgctttgcagtatatcactgtgttcttttccttggggtatgcaaagctcatctactctataactttagaattcaaagggtgcatcataaaaacttagtgtgtggacaatgtcaaaaataatagtacatgtgctttataaacacatttagggccttacgtgtgattgacaagactgttaatgaaacaagactacacactgtgaactcatccaactggtgtcagtcatcagcgtctatgggcactacctacagattgtgtttattcagacttttcgctggggctgtttctctacaggaaaggtaatgcttggtttctttcttctcacacaattttgaatttatgaaagatgaacactctaagaacttatctatttattaaattttatttttcataaacaaatcatttaaacttcattttacttaagtcatacttagtttgactaaattaacacaaatataaacctcaactgttggccttgaaatctgtgtagcctgaagtttccatcagaactggaggtcccagttctggtcttagatctgtcacaaaccagctgtgtgtcttggacaagtcattcaacctctgtgaacctcagtacactcatctgtagaaacaggtattggttcagatgatatctgagaacttttcactgctctgcttccatgatttctctatttgagtatctgcataagtagctctatggtagaaaccaaccaaacaagtttcaaggagcttggcgaagcctcattcttgaagagatcatggttttagaaccccaggaaggacagcagaactgtcatgtcagctgttgcccagcacctacttcagtcccagagtccatctcctgggaatgggttgagacgcgccccagtccctcagtcggggttccagctggagaatggctctgctgcaccaggtcagggaggttgatgtggccagcaaagccattgctgtcactgtggccagatcgcttcttctctccagacgtctgagggagcacagcacgtgggaggagttagagaggggggaaaaaggccacagagtgacatcagccctcacacagcataggcatacggggctccaaatcaacccactagggcatgagaaggtgatattcacatttctattttacttaagaaaacaaaaaagaaattaagctttgccaatatttagtttatggattgagcctgaagccttacgttcctgcatgaggtacagacagtggtcacatatggcatgggagtcccatgtacagagggagacgctacaaaaagggagggactgagcagggcccacacttgtaaactcttttgtagtacttgtgctgtatgcacctgccacttatatatatttacagatcatattaccaggttacaatgaaacaaacccacacaacagataaacgacctaaagtgttgctgaaaagaagcagtgtgtgtggagtactccaagaaagggcagagaccatacttaactcacagggctctttgtcattcacaaggtcaaaacaatgattaatcagatctgacaggagttccaaatatattgacatgatctagaatactatttgaaaatatggatttacaactatcataaatgtttatgtctcaataaataactatggtgctttgtgatgtaggcagtaacaaagtcataactagcaaagcatttgaaacatcacctctaatatccctttttaatgtcctttaaaggtttttcttttttttttttttgagatggactcttcactctgttgcccaggctggagtgcagtggcgcgatcttggctcactgcaacctctgcatcccaggttcaagcaattctcctgcctcagtctcctgagtagctgggattacaggcatgtgctaccacacccggctaatttttgtgtatttagtagagatggggtttcaccatgttggtcaggctggtgtcgaattcctgaccttgtgatccacccaccttggcctcccaaagtgctgggatgacacgtgtgaaccaccatgcccggccaaaggtattttataatgtatataatgtcagtgcagtagaaaaaaatgtatgacttgtgaataaatacactgtattaggtgacacgctgtacagtttttactgataggattacgtgatgtaacaagtttggaagccattgctctggagagcagtctctgccaaaaaaaccccagggaggaaaggcaagattaaaagacaactctggtttccaaaagccagtgcccacattgtaggcctgactagtgttgcactttttaacttttatgcaactggctcattgaggattcttagagcagatctgattaagtgatgatttccctctctgccttttctttcattcattcatcaacacagtattttttagttcctactaagtgtaaagcattctactggcatgtgcaaggtttcatgctgtttctttgaccatctcaccagcctagctttttacttctggagcttgtcatggatttgcaattacagctctctgcacctgcctctggctggaagtgaaaggaggcacttcttttcttttttcttgtttagatgaaacagactcccaagctcctgtaatggtgcatgtaattgatgtttccaggaagcttgagagataactggaaagcctagtgtcctttgtgtttcttggcaacctgctcctggactacgagctgtcctggagaggaacattttctggattcattttgtcacagtggccatcagtagcgtgtattagtgcctattctcagagttgagcatttccttttctaaatgacatttaggaaattcagtcctaatacatcttattgtgtgctactttatgtatactgggcagtttctcctttcttttaacttctgttcaaatactgaaaagcttttaaacattttccccaaacctctctttagcataaatcacatgtcatctctttggaattttttggcctctcttgtatcagcagcactctttctcaagccaaaaactgatgcagacacactggttatcaaagagagactcagagaggctaacaaggggaagtggctcagatagtgagaagcttaaaggaatccagtagtatgctctgaatctgcccacttctgagtcatcacccttttgttcactccaccagcaccttcttattaaacactttctgtgtgccaagtactgtactggaaacacaaagacagatgtacaacagccttaagaacctcattaacagaacctcaataatatctcgtctttatctctcaccattcccgtggggattggcacaaagatgttctgtgtaccaccacatgccaagtactgtgctaaacactttatatatgacattccatcaattatcttgccctgagtgacacgggttctaagtggtttgaacccagctgtcctatggcagagcccaggtgctctgggctgcactgttgtattagggggcctactcctggtcacagctgattgaatcaggggtggatgcctgagccaagagggaccagattcccactggaatttaatattaagcccaagagacatggatcagtttctgctggcagttgaactgggatgtggtgagtatcttgcaatggaggaagtggagaggtgaaagcaggagcatgcagagggagagaaagctcctctacaaagagagagaagagcaaaggagaaatgtggaagaaagcagagattagggtaaggagagacaggcagcaagagagccagagacctgcacatgagaagctgcctgagctcctgtctgttccagtccttcaaagaggctcagctcacttttacctttgggttccttccatgaaataccctaaatcttcctttactcctctatttctgatacctaccctctcccgacttaaaaaatgttcttttttttctttcttttctttctttcttttttttttttttgcttactctgtattaagtgggttcttttactcattacttgtaacccaaagagccttcatgatgacaagctagtgttctggttcagtgaggaggatcaacgctgaaaagataccaggaaggtgctgtgtacaaaggtccatggagtcccagtagaggcttgtaggagataaggaagattgagaacagggaccttcttttggtgaagtgtgggtagcagtggataatacaaaatacctcttccagcagatgagcttccatggacaaatggcagctcacagctggtgtggtgtattctagaaccgagtaaaaagtggtcctgtggggctataggacagggataggtagaaccacagggataagggtatgcactacaaggggaaatttgtgcatctgacaggatcatgagtgttagagtggtatgttcttatagaaccatctagtccactccacaagatgacaagttgggtgagttctcctaaagttcatcttggagaactgtactaatagcaccctataagctaaatcttattataatgagtttttattttatgttcttattttgtcagggataaactttaacctgcatttatcttgtttaaacatgtacttttagtaattttcagctcaaggtttgatgatggttaattttatgtgtcaacttgactagaccatggggtgcctcggttaaacattttttctggtatgtctgtaagtgtttctggaagcaattagcatttaattggtagactcagtaaagtagattgccctttccaagtgggatgggcatcatctaatctgctggggacctgaacaaaacaaaaggcagaggaagaaggaattttctccctctttttcttctccgctggttgaagtgggacatttcatctcatcttcacccagcttccaactaggatttataccaacagcttccctgggtctccagcttgcatatggcagatcatgggacttctcagcctccatatcatatgagctacatcctcataatgaagcagtctctcggccgggcgtggtagctcacgcctgtaatcctagcgttttgggaggtcaaggcgggcagattgcctgagctcaggagtttgagaccagcctgggcaacacagtgaaaccccatctctactaaaatacaaaaatttagctgggcgtgcacccgtagtctcagctacttgggaggctgaggcaggggaatcgcctgaacccaggaggtggaggttgcagtgagccgagattgcaccactgcactccagcctgggtgacagagcgagactccatctccaaaaataataataataataataaagcagtctctctctctctacatatgtaaatactctctttctctggagaaccccaactaatacagtttgttatttaaaaaacccacattgaggaaggcagaattggaaattgagaggacaaaaatattttgggttccttaatagatcaaattcctataagacactggcaaatgctattttctttctttctttctttctttttttttttttaagacagagtctcgttctgtcgcccaggctggagtgcagtggcacgatctccactcactgcaacctctgcctcccgggttcacgccattctcctgcctcagcctcctgagtagctgggactacaggcgcccgccacgacgcctggctaatttttttatttttagtagagacgggatttcactgtgttagccaggatggtctcgatctcctgatctcgtgatcctcccacctcggcctcccaaagtgctgggattacaggcacgagccaccgcgcccggctgcaaatgctgttttcaaagtgacaggttgtggtcatagaatactggagtgctataaataacatggagccatttggatgtggctggcaatgaactgaaaatgtggctccaaatgtctacttggaggtattgactctgtcataaagactcaagcaaattttaagccacattagaaatcggagtccttttatctggagtcaaacagcaactcactccagaacgttctccctcatgttttcctaagtggtaagttatagggatagaagccttctacacttccattgaaattatccattaaccacatgaagagatttatatgccagcactacacaatgtcaatttcagcagccaagtccatttttcatttcaggcatatgtgaaaggactctttaaaggctacttgaaagattcaacaaggacataaaatgaaattctagcaagttgctttgtgaactagtcttccagttatagccccactgctaattattatttcaaaggccttattcatctcaaaactacagttcctttctttcttacgaaagtgagatgccctttgcctttttggagagcaaagtctgctattagagtttcccaactctgtcctggctgaagaggaaaaacagatgacatatgtttatgtttcagagggaggactggatggtgataacaagtaaaaggagaattcatttccgaggagagagtgaaataaaatagttaacatttattgaatgcttaatttactaactcaatattctcaaccatcttataagttgtatgctattatttataaaattttatagatggatgcagggagaggtcaggtaacatttgcccaatgttctcagccatttctttccttccaagtaaatatctgcactcaaacttgcatggtgatgatgaagtgaaaaagaggaaaagacggatttcaatttgtcagggtctttctggttagcatggacacagtggggagttactgcatgtcagaaggacagatgaaagggaacatgtgccaccccccaaatgaaatgatgttcctagagtttaaaaaaaaattcaaccaaagttccaaggtacatttttgaagtagatctgcctatttctttgttatttcaataaaataacttaacggttgttttaatgttaatttaacaagataagatgatatcatcatttcttggaactattgagcattttttatacgaaatccactaagataaaaccatggggagaagagacataacaaggccagtgatgctattcagagagaccattcatttctgttttcctgttgtaggaaacatctaagtttgcaattttatatcctcaggcccaaattctatattctgatttgcatagctcctgctgaagaatttggaataatataattaagtcacactgccagagcttagaagaatacaggaaagaaggcagcagacaattaaaatcactcaactatttggaagcacaggtcctccctcccccaagaattccccatacttaaaatacatgccataggcattctctgtgaaagctttaatgtaaaaaccactgaagaaatggcatttcctctacacagtttttataccaacttacctctctaatcatcaaggttccttctcttgaaatactgccgctgaaactgtccgcatgagaggtctccagcccatgcgtccccaccattcccacattgtactgctcgttgctgcctggagctcctgttggtctgagatgagaaggaacaacattcatggcaatgtatctttaggaaatatctgtttcctgtccatattcattatttttgttatggtaaaatatacatattaataacataaaatttaccattgtaccaattttaagtgtacatgtcagtggtcttaagtacatctcatattaatttttttttttttgagaaggagtctcgccttgtcgcccaggctggagtgcagtggcgcgatcttgactcactgcaagctctgcctcccaggttcacgccattctcctgcctcagcctcccgagtagctgggactacaggcgcccaccaccacgcccagctaattttttttgtatttttagtagagacggggtttcaacatgttagccaggatggtctcgatctcctgacctcgtgatttgcccgtcttggcctcccaaagtgctgggattataggcgtgagccaccgcgccctgccaatctcatattaattttaatgtgtgttgatgtctggactggccccacttttgcagcatcccctcttgacctattctctgcccagtagccagactgagcaagtgtttggctttacctggaaaaaacactgaagttggcaccaggagtcaccaggctctgcatgatctcccctgacccctgccctccttctttgggcagcagacaacctgacctgcttttacacatgctgttccctctgcctggaaagttctttccactctggccttggttggttccctctcattcatcctacatgatgctttctgtgagaagtctgctcttatcacctatgtcttgtcccaacagcccctcttcttttctcttcaccctttttccttcatagttctcatcacaatttgcaattatcttatcttttgaattctccctttctccttccctctcattgcttgtgatggcagagtccttgtctctttgttcattattattacccagtacccagcctagagttgtcacatactaggaatgcaaaaaatgattattagatccatgggctttatgcttctataaagaagaaatatctactaagaacattctggcttattggggcatccataaactaggaggtttaacttaaacagcactcagcctctgtaatcatcctgcatggtggtatatttattttcagttcttttcttgctatcatgtttacagtataatgagagaaggtaacaggatctcagcatactccttgagaacacagactgatgtttcctgtgtcctgtagcacagagcacagtgccagggctcaaaaagtgatgactgactgctcatagtgagcttcactctatcaggagtgcctcatttgcatgacacagaatttctctggtttaggagctcaggggatttgagaaccacacaccacaggttgaggttggtacaacatggcttctggaagaaggattttggttgttaatgcgatacttgttgttctcctattttagcatctgcctctcttttaaagtgggttttctaaaaataggaaagttatcaaggcttatttctctctaggcatattaattgcaactttaatcatttttttcttttattttcattgtttcttatatatttaaaaatatctctggcctcttggatcttatgaaagtccaaagaattactggaaacttccatctaagaaacaagaaatacaccagatttatgatgtctctggggcagagaaagacatatttcaaggatttttatccaaaacagacaggtgaaaaaatgacagggggagtccagacgagaaaatgtatagtaagaagcttccattgcaattactaaactggagcagtggattgaatgaatctaaatgtgggctagaactgatgtgtttgggaagaaattccaaagaggcattttcattttcaacatgtcattcctagaaaggagcttttaatagtgttcagagacatggaaaaaaaaattgaattcctggcattttgatagattggtaaatcagttttcaaaatatcatttcttcactcatttgtttatcttgtgtgtatcttccatttttttttcttgctcttctttcttcctttgtgccgtaagtacttgtttgggacaaaatgatataaagccaataaatcaatgaagtacttatcaagagtcttccatgagggcagccacttttcttatttatcagaaaggggttctttgctattgtcaggggctcagttggcctggtggcatctgccaggctgatgcttgtacaatcaagttctcctgtcctagtcagacctgcttcctctgttacctgaataacagttttcttggtggccaccccgtcttcagtcctttccccctcatatccactcctcacagctgtgaaagtgagccctccaaaacacaaatctgaccaagtccgaatcactcttctactttcaatcttcagtagctccctgtcaaccacaggataaacttgaagctccttactgtggcttacaagctctccattatctagttcttgcctgtctcactaacctaattttttttaacaaaatcctgccccaactcctaactctaccagcatttaacttataaaagtttcctatgtacattatgctagaaaatccctggtgactttagcctgccctctttacctggaagattcttttctattctctgcctccctctggctaactcattctttaagcctcactggaatggtttaggtggctcttcactctgcctccacattgccctttgtgcatctctaccactgcattcaatacacagtcctgcaatgatcagatctcattaatgttggtattttcagtgccaagcatggtgcctggaatgcaggtagcacataataaatgtttattaaatcgctgaagatcttgggtcaagggctttgtttaatgtctaacagagatttcattcagatttattgtaaaaatatagctcttctgtgaattgataagtaattggctatcaggatattatttggatatttaaaatatcttgagcaatcaatgttaagttttacaattttatgaagttgggtttactaggatgtgccaaaataattttcttataattgggtggttatcatagaataacaaaaaatctattcagatatatcatagaactttacaggaaaaagagttaaacttaatgtatataaattttaaaaaatcattgaggagatcagaagctcccaggaaagaatgttaaaaactgtgataagagaatctcaccatattacaaatgtatgaacaacttcagtgaggagaaatgtggcaaaaaggcattgatctaagtaaccttggaaatgagtggagtctgtaatactaaaggcaagaggaactgagcaataaacagtgtacattctagttgagaaagttgtttcccatgaggttacaggttaacaaatttgatactactatacaaaaatactggatgtgcacaattaagtaaatgggtggttgatatggtgtggccatgtccctacccaaatctcatcttgaattgtaacttccataatcccacgacatgggagtgacccggtgggaggtaattgaatcatggaggtgggtttttcctctgctgttcttgtgatagtgaataaatctcaggacatctgatggttttataaagggcagttcccctgcacatgctctcttgcctgctgccatgtaagacatgcctttgctcctcattcaccttccaccatgattgtgaggcccccctagccatgtggaactgtgagtccattaaacctctttttctttataactttatacactctcaggtatttcttcatagcagtacgaaaatggactaatacagtagttgatggcagaagccaggtttctgactgttggaatgggaatttacaaacaagcaaggggaggtggaggcatgtcagtcaaagaggcacaggagctaactgaaagagctcccaaggtcaaaactggaaaatttgagcaacaaaataaagattatatccatgaatctatactgatataaatgatggaataaattaataaatagaggagacaaatctgtgcagaagaattctaaataaattatgtagctattctaccctacaggagggaacgcatgattccccactcctcaagtgtgggctgtgcatagtggcttccttccaaaggtatagcatagaaaaaagcggaaataaaagagtcattttacagtggagaaatcttccctactggagcatttgctggtatttgagggaagacactaatacctaaggttgcctctttggcttgcttgatgtgatgcaaatcaaattaaatgcctttccttccattctttttattctataaagcttttatttttttcctgattataaagtagtacatgcccatcatataattggggatatacataaaataaaaatctcccataattatattacccagaggtaatcacttttataattttggtgtatttccctccactcgttatttttctatgcatgaggaattgggaaatactgcaactggttagttggggaatacaaacttagttaagtgcactctcataagttatatcttgtaaaataaatgcaaaaccagcacagtgcatagaaaaaagctattgttttaaacatcagaaaccacagctgtttgtcaaaatggctggtgctccatttctgagaagcttctctgtgtttacttcatggtgggcactgagctacaatatatttttgttttctgctttaaaaatatatggcacaaaatatagaggtttaccttaacaaaaaataaaggtaataagaatgtatataaaaggcactctggcccccaaatactcaattcctaaatattgttttataatgaacttttaatagtatgaaatttctcaggcatgcaatcatcacattgtagaacagactgtgtatattttatatgcaatataaaaatacatatatttacaaattgaagtaaacatacacacatacatttgtacccttcgtacccttattttctcacatacataatcacatattttaaatgttcttaaacaatcatttccatctatctaaagtttaccaatcccttaagaaccatgtcaagtcttgcctccaccatcagcattccatgatagcctcagttcattatttcttatgcagattatagtaatagcgcctctgaattgctttaccagtctccagtctgttcccttttcaaatcgtcttgctgaaataatctccctcaaatataacactgaactcaagatacgttcaatggtttccaatggctacatataaagagcacacttcttggtctgatttcactagtccagactcccctccaccgtatacaccatacattcccaccaaagtcaactttctgtgtctttacttcaactcttccccctgcttgggattctaatattacctcaggatttttttttttttaatcttgctgacagttatttgtatagaattggctatacactcttcaaagtcagaacttgcaatttcaaattcagtgcaattaaatgtaaattatagtcactgaagacccactgtattccagacaccatggaacgtgttaagagcaagagagatgagtaaggcataacccttaccctgaaagatatcatagtccagaaaaggagacaaagacctaacaaacaatcctgattcaaggcactacatgaagatgcaggaatacacacaacatacagcggtagcacagaagagggggcaggctctacctatgcaggcggggctgtgagtaggtgatttctaaaggaacaggaaatgccagacagaagtgaagcgtggtctattcaggaaattttagaaaggtgggtgtttctacagtggggagtaagtcctagatttgcctttaaaggtaggagggtgaacaccattaatagccttgcaaaatatgataggggacctaaaacccaaatgctaatgaacatctttggttgttcctccaaatgtttatattagcctgcagttttccatgtgtaattttgtcattctccaactagcatataaacttttggaagacaaaatccaagtacgaacttatcagatctcttaaagccttcagcagggctatcacatagtgagagttttagcaaccttttaatttcataatcttctctcatcctgatgcttgcatgctcagtgcttaaaaggagttcaaaacatctgtcagaagaattaagcaattctgagtcaagacaaaaactaaaagggccagcatgttttgcagaaatgttctggattagtgattttgcctctagaacaattttatttacttttaaaaaggcaatttaatgcaatttgtttcaaaatgtcatattttagcatatttagagctgtcagcaactgggtcatcaacagcaaaataaccagtatggatttttcagctacgttaattagatttgcctcttagaatcgcttgtatgtaatgatgttaatcagtgaatgacattccctttagactggccagccctgcctctccagtccctgctgaagtggacaataatttgtggcctgaaatggcttcttttttatatagagtgagtgtgaactgataatcaatgctagtagctgagccaaagaaatagaggtgattgaagtgtgaagatggaaaaattagcatctcattctatcaaagttgtaggagaccagggcacaaacaccttgtgcttactaggtggaggaactggggaagcaacaggggataagggtaggttctttcacgggatccactccaataagaaaaaaaaaaaatgaactttctcctcaccttgaaaaaaaaaaaaaaaagaaaaaggctacaattactaaagaaaatgtaggtacatataaatatacatgtaaatacataaaaagagaactgcaaagagactgacagtatgtggcaaagacacagaccacagaaaaatggatccagaaaaagaagccatgaagggaataaagtagaaaatcataacggggtatattttggaactttctctgcatgattatctgagtcctgattcttttgctgggatggtaacgcatgctggcttgtgcatttctccttgcttgttggtggcagtggtggtaatgaaatacatgttttatgttgttaattttaatccctaaatgtcattgcccatgatttcagtgtttcagttttagaggggaaggcacgtatcaatggtctggttgtcgatattgtttgcccttaagatgaaaagaacaagaaagagtcgccgaaaggatagtcaatccattggcaatggataggtaaagtgtatgcagtccaaaaatgctacatattctaagtgattgtgtccatagatagagataattatagaactatgctccaacaaaaacccaagtcccgaaagtcaatttatcttgccacagacccatatacaatcttacatttaactcatatttttttgtccttttattttggaaacctagtcccctcccggtctacactttaaaagtagttctcttacatcagtctgggtatgtcgctgacagccactgtcccatcatgggtctcgctctctccatcttcctcctcttcctcgctactttctgactcctcactggaggaggagtaatcagtcaccttcttcattgggcggtttgtttcttcaatccggagttctcttagttctttggctaatgccgtcagatcctatgaaagaaaaatttgttcagcatatgagtggtagatacgaccaaagctacatctctcagcaagtcagtgctccagcttaagcaacaagaaaaaaaaaagctctatatagaactgtgacaaacatagttactgcatggaactaagaaaatgatgtttgtagcgtgtagaagctagaaaagaaagatgaaatcaatttaaactttttcaaaaccaatagctagactgagactgttcagtcctgaatatatatgtgtacatatgtgtatgtacacatatatacaaacattgggttctcattttgttttggaaaggtgaagctggtcacccccagagttaatgggaaaatatgtgggattagaaattgtgccccagtattctgggactcctgcccaagccacagtgatggcttttcccctcttatgattgctgctgtactgaaatttaccatcagtcagccatagaacagagcaactcccaaggttccagctactacagtgactcatttggtgtgtcatcattccctggagaatggaggtaccacatcaaatcatggcccatcctaaagtctagtgccactgaaatttacagccacagaactgaattaatcaagaggaacaacaacaacaagagttctcttccaaaatgataggtgtttcattttcttttgttttaaattccagtcatctggcagaaatcctggtgaagaacactaaaatgaatgtgcaaataccaaaaggaagagataattttgagttttccatgagtatgatgaaacctttagccttatggatgtgatgatgtggtatttaatcaccaggcatactgcaggcagtgtgctgaatatccgactaccttttattttacatgctttcagagtaatgcagagggaagcagttctgcaaaagcatggccgctctaatttgcatgggttaaactgcccatggcacacagcatgcaaatggggaaaaagcaatttgacatcagtcttaccatttctccctatattagtgacccatgtgggaatcagagcattcagtgagagacaggggattagggagaaagaaactcattgaaaaatactaaatcccacagttttctatggccatattctctctttatttcaatccagaaatgtatgcatccaattcacctgatgtaggattagagcaacctgggtgatgacattgggtaatccatcctaatcggttaaaagaaaagctgtgataaatgtgtatagttaaattataattttattttgagaatacaacaaaacattgtttctctactgccacctgtatgtcaggcattactattttggttcacactaggaaaggaaacactttaggtgttttacgtggtctagaaatttaggcaattcatagtgttaactgaagggtcatttctttctaatttcatagaaatcaaagggaaagcaaaatggcttttaaatttgtcttgatgacacctgatttgaaacccttagaatatggaagctgctaaaaattcaacctttgcattacatacagaaacacacttggctagggcttttgcacacatgcacatttgcacatttgcacatgcctcaatctcggtgaatgtatttgctccatctgtgaaagtgaaaatagaattgtatttagaaggccaactctgtttaaatgtaatgcatattataaaaagaagaggaaaaccataacataggtataatgttatgcaaatttctggtttctttggcaattagccaaaataggaaaagctaatatctgaatttcaacttttacttcttatttcctcctggcaattgtcaatgcttatctttatcaaatgaagaagaaagtgaagggtatgctattcttgagtaccatgggaaaataaagtctagatatttgttaaggctatgaaagaaaaggatattatcatcctccaaaccagtgaaataatgaaaaattagataaatttattttgtattctgacatctatatattaggactgtgttaagtctcatcaaagaatacagctagcatttaaaatgttacttgttattaagaattacattttatataatttaaagagagaatatggtttaaaagagtttatctctattgttaataattctgagtaaaatataatactcttggctatggtttaattaatgatacattttccccagaggtttattttccttttctctgacatttcaaaacgagacaaaagaaattctaaaaaatcaaaattattttagaaatatttagtccacaggctactgatttaaaaaaactttcacttgttaaaatgacatacatttttctaaacattgtatttagaaacactttaaagttctgaactgcttaataattttgcttttaattagaattttttgcttctgtgttactaaaaagctctctgccctgaaacattagaaataacaattaaacttaaaggaaattttcaattaacagtttggaggcgagacatataccagaatccctatgaaaaggtaaaaataatgaataattccaaagtaatacctgtagtcaaagaaaattaatcttccattgctaagaacctatgtgtttagctgaagttttgtttcttatccgtccagtattgaaaaatttataatagcaaagttataggaaataaacacaatctaatattaacaccattgggttcaattctattttcatatattttattctttgacaatacaaattttctccatataatgagccttcttggtaatttattacttggctgtcacaagcctggagctaaaaagtatttaaaaaacaaaataagtgctatttagcatgaaaatatttgagaatatatagctaaaaaagaaatatggcaagatggtaagattttttgactacagagtaaatgtgaagatagctacgaggcttaacagtttttagaatcaactagatataatttttcattcaacaaaggttaactattatgcacatcttgactaaaaaggcgctcttttaggtccctttttagaaacaatatagtttattcaaataaatattagttcaatttttgaactattgtttaaaaatttttagcttttttttctctttgtattaaactattttctttttaggaactctaaagatatgacattgggcaagccacttagtttcaatatcctcatctgagggaaaagggggttgaacccctagttattgttcaccttccatccaatctaaattgatgtgctttgaaatttttgatgcccacatactaataaaaaacagcggtaaaaacagtgttttcttacgtgtataatctttgtgtcacatatttaattgtgccaacagagaaaacccatttattttcaaagactatattcaaagactatattaaatagactatgctgcaaaatctcatattccattagaaagcaatgtcacattaatgtacactcccccaaattaatttttataaaaagttaaatcattagcaataacaagcgacaatatttcaaaagtgattttcagatttttcatttcaatcccagttatctaaattgcaaaaacagtcgttgagagggaagccctaccaaaacctatgaatggagaagggagaaaggtgtagttcaaagtttctcaattatggccctgttgacattttgggccagataattctttattgtagggagttctctgtgcaccacgggatgtttggcagcagcacccctctgctctatccacaagatgccagtaccactgcctgctactctgaagtggtgacaaccaaaactgtctccagattttgccaaatgtctcctaagggaagaggagtggaggaatcagccgtggttgagagccactgggttaggtagaaccgctttattttagtggtttggatcagtgatactcaagagatcaggatagtcacctggagggcttttccaaccatacatggctccagagattttagtatgcagctcacaccccctcaattatttgtaattacgtatacctccattgccccctctcatctctgtccagtgtggtgcagtacaccaaaaaaaagtagagcaatttttcaaagcctaaaatattctgggttaatcagatgaaatctgtgagagccttttccttaatgacggcccctccaagccaatttctgaactcatgtaattcctcttgagttctgcacatgcacagccattttattggcaactgtagcaccagaacttcactgtctttctttacctgttctgggagaaaactgacaaaagttgtgataatccctgcccttctcactattatgagagagaggggcaagcaaggccacggcacagagcaattaaaaacacactctcctcttccctttctataaatgccatccacacaccgcaaacatgcggagtctcattcttttataagcaacaatccttcaactatgatcataactgtctcgtcactctgggtggtgaggtggccataagtctgaaaaagtgaggctcttcggtgaagaccagatacatggaaacatgcttctcctacctgccaaaatagctccatgcctctggcccaaaccttaatcaaacccttggctttctgcagcaatgttacacataaaatgctttcacacacattaccttaaatgatcctaaacaatcttgtaagtgggatggggaggtgtttttattctcattttatggatgaggaaactctggcccagtgaggttatgagactagtctcagccagttatttactgggggagccaagatttgaatgcagcttgctgacctcaaagccagtgctttttccattaaatttcacaaaagtagtgctcagcagagctacagctttaaagccatgatggtagtctttagattccatgcatttaggactctttgcaaggcctggatcttaaaaaaacaaattctactctgctgtattcatgcaggtctgacaaatagcagtaaggcagtcatccttcttagcaagctacctacaactgacaaagccatatatttttctaatggaaaacgtctccacagacaaggaaataaagtcacttaactttccaggattcattaactaaagctgatgttgcttctgatgctgttgttaatgtcccacaaaattaatctaacaatacctactaactccttgttcacaaatcacacactctaaatttggagtgtcctagaatgatgtctcttttcttgttagtaaaactgctgagagccattccctagcaaggctggcaagtacaggtttgctattggaagatactggaaggagaaactgccattaataaagcatgaatacttgtcattagccagactggaacattggaaaagtgacattttagcttagaaggaaggtctctgaagctatatgggtaggtttgagggtcttaaagttggcttccatttgaaggggcactcctcccagcagattgctacaaatctcctcccagctgattgctcccattggccacctttctgaatgtcaacattaggaaataagtttaatatttacattttgtgaaagcatgaccaagaaaaggtaatactaacctcatctatagcttttttgtagctctgaaatgagaggaacccaatccagaagaatccacagaaggaggaaaagccagcagaaaggcagcagattagacacaaaattgtaattgttagtacgcaactgataaatacaaaagggcgaagagaatgtcaatccagaatgatgcaaatcccttcattattactctcggtatacgtcgttactttaagatgttaaaaaagagtaaaccaaaaagcttcacgttcattttacagaaaagattctcaagagatttaaatagaaaaaatggatagtaattcatcccaaattaattttcaactttcaaattttagcctccatactcctctttaaggctacctgggggtctatcatgttacagcagtgaagctggatgctaagttgttacgacgcctgttggaccctgcttaaaaagtttggtccagaaaatatagtcctggaggcatgaaaaatagcagaaaaactgtaatattaattcatgtggaaaataatatggggaaagagtagaagagattagagaagttcatagaaagtacccaagtctctttaactgctactttcaacatctttttgccaaagttgctgagtagaaattatggaatgataggagttgtttctcttcctgttttatagttaaaggactgctaatgatcagcaaatagccaaaggcagaggagtcaatccaagatctcttcggttctttcctaatcaggtatgactttcttcgggatgtttctagcatccgttcttactaatctcaacaatttttgtttgcatcatgagtgtatccccaactacttaatcctgtgggttctctggtaaattaagagttcaaaactcttggagagaaaagcactcacagctggtcgactgggccgggtaatgtccctggattcttctggtttcaccttcgcaggctcatgggggagcacaggtgatccttctgacttactgttggctagaggaaaaaaacagaggaccaagaaagagatggccatcaaaaagtgctggctcaagttctgaatgaattatctgtgatgtgtcatcacattgagattactcagtggacacgtcattcacctgggcaaatcctcaagaaacatccatgaaaaatataatgttcaggcaaacacatttaggcttgtgacctggaaatcactagtaacaattaaaaaaaaaagaaatgtagcaagtactatcaccactagagcacttcttatgtgtcaggcatagtgctaaatgctttccatgtcaattatctcatttaatcctcactccaacccaatgatatggcactattctcctattttacagaacacagatttacaaagatgacacaactgtccggaggtcacactgaaattatagacagagctggagttctgatttctgaaagtcctattctcagtcactatgctaaatgagcctctaaggttctatgcttgttttcttcttttatcatttgtccaatcaggataggttattttgttgaaattttgtgagggaaaaaaaatttattttatttggtggaacggtttttaattggagatgggagtggtctcagccctttaaaaataaaagaatgaggtgagggcaagaagggggttgttataggagaagggccctaggctggaggtacagagcaaggtcaaggggaccctgacagctgcagagtgaatagcatctttgcagtctatgagcttacagatagagaagatgcaatttagggtaggagaggtggtttttatttcttaaaaagtagtctttcttggacagggacataccagggatacaacagcccttttaatccggaagaacgaggggctgaaggaaataaaaagtaagcctgaaccagaccagagaattaaaatggtatgcgtttaagtttggtttatttaaatatttgctctaagaatatgaagttgcctataaatagaaaaaagataacagaatggctgttttctttctttaggtgttttagagatggggctctgtcacctaggctggagcgcagtggggccatcatagctcactgcagccttgaactcctgagcttaagcaattcttctacctcggccttccgggtacctaggactacaggcgtaagccactacatctggtagttttctaaattaaggaaatttatatttcgatcaaggcaacaaagacatacagtagatacttctgagatgtgccactaatcagaagaatgcatatagaggcagctgttggctagtccatatcccaatccagagacgtgaacatcaatcacatgttagatatcaagctttttaaaatggaaatagagtgatttatttaaaaccctgaaagggtgttaggagataaactaagggtattaggaggtggtatgtaataaagagtctaagaaagaaaaaagaactgaaggttctcatgaggctttcatcagacagagaaacttataagtatgttaatatttgtcaaattgcaattaaagtactggtcttcatcacttagaagcaaaattatcttctgaagaagttgattcagaaggagtgaattttaactagctagaaacaatgtattattatgtatcagcacctggaaataataatgtttttcataggcctccccattactggaaactaaacaatgatgaataatttgaattaaatatttagagaggctaatttttacttaataggaataaccagaggagtcaacaattttttttttttttgatggagtttcattcttgttgccaaggctggagtacaatggcgtgatcttggctcaccacaacctctgcctcctgggttcaagcgattctcctgcctcagcctcccgagtagctgggattacaggcatgcaccaccacgccaggctaattttttgtatttttagtagcgatggggtttctccatgttagtcaggctgatcttggaactcccgaccttaggtgatctgcctgccttggcctccctaagtgctgggattacaggcgtgagccaccacactcggcctaaatatgctttttaagtcaaagattttattccttccttcaagtgtattctacattagtctttactgaatttcattttgagaaatacatggtattctgaactgtgtatatgaactatgttcagaatactaaacaggacaattggtgcaatgcgttcaggacatttgtgggtacatgaaactctaaaaaccggcaatcaaacagaaacagaaattcaggtgactggtaagtgactgtattttcaaataagactgatatttggtgatctccctggaaaacactggtatctgagattagaaaggattttgtccatactgatggcacacacacaattagggacagtggcccactcccgaggagactggggttgagagcagttgacaggctcttcaggatcacacagtggtggccatgcctggactagagtcaggaagtaactaacctttttccctgtccacagctttcctcccaggcagtattgccaggtaaaggtaagagaaagttttacctcgaactctggtgcgttcactggatcctgcttgtgatccaggctgggagcctccttgggagctgggctgggagctaggggtgctggagctggaggaactgccactgctggtcctctgcaaggggctctccaagatgggctcagttctccggagatcagggttgctgtgtgagtgacagagcacactggttacactctccagaccttgccagttttgcagatcacatatctgataaggtttaatacccaaaatatgtaaggaactcaaaacagctcaatagcaagaaaacgaataacccaattaaaaatggggaaaggacctgaatagacatttcttaaaaggagacatgcagatagccaataggaatatgaaaaaaatgatcagcatcactaatcatcagggaaatgcaaattaaaaccacaatgagccaggcacagtggctgtcacctataaccccagcactttggaaggctcaggtgggaggatcacttgaggccaggagttcaagaccagcctgggcaacatagtgagatcccatctccacaaaaaaattagctgggcatagtggcatgtgcctgtcctcccacttacatgagaggctgaggtgggagggtcacttgaccccaggaggtcaaggcttcagtgagccatgatcacgccactgcactccagcctgggcaacagagtgagaccatgtctcaaaaaataaaaacataaatttaaaaaccccaccaaaccacaatgagatatgacctcatacctattagaatggctgttttcaaaagacaaaagataatgagtgttggtgaggatgcagagaagagggaacccttgtaccctgttggtgagaatgtaaaatagtacagccagtacggaaaacagtatgaaggttccgcaaaagactaaaaatagaattatcataggatccagagattccacttctggatatatatccaaaggaaatgaaatcagtacattgaagaggtagctgtactcccatgctcagtgcagcactattcacagtagccacaatatggaatcaacctaagtgtgtgtccactgaagaatgaatggataaagaaaatgtgatatatctctctctcaaaaagacaaatactacatgatctcacttataggtggaatctacaaataccgaactcatagaaacagagagtagaatgatagttgccaggggatctaggaaggagagagaatgggaagatgttggtcaaaggttacagtttcacttggacagcatgagtaacttttggaaatctactgtacaccatggtgagtacagatcataacgaggtatacttgaaaattgcgaagatagtagatcttaaatgtcatcagaaaaaaatgataactatgtgaggtgatggatatattgattaacttgattttagtaatcatttcacagtgtatacatatatcaaaacatcatgttatacactgtaaatagatatactttttatttgtcaatcatacctcagtaaagctaggggggacaaaatcttgccattggtagacacaagcatagtcccgtccccagtgcaaggaagtaaaaagagcacttacaagaccttgagaggaaggggtcaacagaagatgacagtcatgccttcctctgtagagttcctgaccagctactggatgtgtacaggatgaactcttgttcatcacattgaaaatactagctctggatggtgaatcttcaaagaaagctttcttacaaacatttttttctgtgctcattgtaaaaagtcttgaaaaatattaaaagggaaaaaataaggaaggaacacacataatctctgcaccaggagatactcaactatattttactattgtacatgatctcacttatgcgtggaatctacaaacatcaaactcacagaaacaatagaatgagagttgctggggtttttttcttttgtatctatctatagaagcatactgcatattcagttttttttttcctttttatatatggaagcatagtgtatattcagttttgcatcttgcttttttcccttaactgcattgtgagcatattcttatgctgtgtaatagcttcattaattgtctattatatagatgagttacttgaccatttctctgctgttaaatattaaggtgcttccaatacattgctgtgacacataacagtgaaacaataatctccctgtacacaaatagccaatcacatttctatttcctgagattagaattcttgggtgaaaaggcctaagtttggggtgtgtgcatgtgtgtgtgcatatgtatgagtgtataaaggtatgacagattttcactgaagtaaatgtgatggtccatttcactccatacaaggttttatactaaattgtatctcattatttaggtacagttttaaaaagtgactactgaggtagaagaatttttattcatatttgtttgccatttgtaatttctcttctgtgaattgcttaattaaatcctttgttcatgtagcttgtggagtctttgtatttttttttattatcttcttgcaggaagtctttatatgcttaggctattaccgacgggtagacgatttttggataattattataaaatgctaattcggccaggcacggtggctcacgcctgtaatcccatcactttgggaggccaaggcaggcagatcacgaggtcaggagatcgagaccatcctggctaacacagtgaaaccccatctctactaaaaatacaaaaaaattagctgggcgtggtggcaggtgcctgtattctcagctagttgagaggctgaggcaggagaatggcgtgaatccaggaggcagagcttgcagtgagcggagatcgcgctactgcactctagcctgggagacagagcgagactctgtctgtctcgaaaaaaaaaaaaagcaaattcaagaccaaatttgttggtaggctactactcccattaaaaatatatatatatattactgtatttgtcttcatatatttattcccaccaaaaaaagcagtattcattcactcagttattctataccaggcactgggtcaagcatttgagatatgataatgaacgggacacagcctgtgccctctgtgagcttagctggatatacacagcccatttcaacatgctttgcctgcgttgagcacagagccatatggaagcatgaggcaggaccacctaggccaattttggccatcaggggagctgtacccaaacaggagacatctaagcagtggtgctgggaggcagctgctgaggattttacgattttgttaaaaaaaaaaaaaaaaaaagcagcattctcaaggcttctataaagctctttctttgaaatttataactcataggcttttttttattttatttttctgttagatttacacaatgctgggcatggataatttagggagacctgaaactcagagctcaaatctatcgccttccagatgctgagaagagaaacatctgatgtcagcttcctctctgttcctaacatcttcagttccccaaacagactttgttaacagttatcatacagctatgattttaatgccgtgagatattatattaaaatgtaattttatgctttaactttgctctgcccagtttaagagtaccaagtatgtatcaggcactctgtactgtgttggatgttagatgtttctcccataaatttggatatgaccccttcctttgagatacttttagtttagtctaccagtaacccagtcacaatggcaactttataagcagcaattaaaccaactaatttctttctgaaaactcaagaatcttgctttgtggtaatgtatctgtcaaaaacatttgattgagtagaaatagaccatgactgtggaaaaatgcagtgaaaaacgtatgtacaaataaatatgttctcatgattcattaatatgatcatataaatgtagaccctaatcatattatctttgaaacttttgtggtaaaagggttgctaagtcaacttaacagtaaaatcagttgcagagtgatcattggtaaacttaagaaaaacttccaataatggcattcctttgtgaagtaactatttttatgacaattgttcatatcaaattgactaaaatagatttggatccatactggaaatacccttcatttagaaaatgtctaaaatgataaatgtgtaatagctctgaaataatctacatttcaaatttttcattttttaaaataaataatctcttttaattcccaaatagcgaattcttccacactgccctgttttattaaacaatagtggtcaaaaattattatgcataattaaataattccaaaaaaacttgctctaaaaaatgtactgctcaccaactgtattacagatttaagaatgatgagcatgttaaggtttcttggagttgctctcattttgtggaacggtaatgtagtattctttgtattacaaaaaaataaataaaaaatctcttgagaggagggtagctggtgataaatgctctgagttttcttccctggtggttgtggtgtggtagcaggatagagctacttgttctaatgtagcactcctttgattatttagccaaaacctttgtgttaagcaccaactttgtgaaacttaccggaccaggattagggatggaggagaagcacaagccacagggcatacagtcaagttacaacacaatcatggagatgagacttatgcagaggggacaatagggagcatggcaaaactgtatgttgtgtatgaaagagactaagtattgttggagtttggggaaccattagtgcagactggtatggttgatggcagtgttatgaaggagcaagaacttgactgggtgttgtagcaggaaggctggggaacagtcggagcagacatagggctgggttgtttttcctgatgcatgtgggtgcagagatgacactggccaaatcaagtaccaaatctgtattaggaaacactgggagagtggagtgatcagaagaaaagggtgagttgtataaccatggcctttaaagcctagaggagaatgtgtacctcccacagtacacgtgaacgactgaccaggagagaggcaggcagactagttaggaggctgctgccaagtcagatgatgaggcctgggcagtgatgtcctgtgtgaaaaagagcatgggcattagcagaagcagctgggatgagcctacatcctgactgggctcagagtctcatcctgtgtgaagctaattggatcccatgggcattaaatccctgaccagggcctcattagtacaagttctcctcaccagagctaaccagtgtgggtgctgatcttaataggttgctatttttgctgctggagactgaaagaagtatttagtctctatgttaccacacatagaaatagggaaaactttacaatgccttttctaccttttcttttggtaaaacatgagtagtttgagaaaatgtcatgctgttcacatttttctctccttcattatgtattaaatgatctggccttggggctgtggggtctgagatgaatgctcttaagaggatcaatttcagaagaatcccatgaaataatagatatcccttgttcacatcttaactgagcctattcagatccgaatgtgtaaaaacctgaaaacatccaaatggatttctttaaatgctaacttttagttcagacatttgccatcctgcagataatgctgctaggtctataaaactcacagtaaagtgaaaatgtggcaattattccattcatttgaatcataaaaagtcaaaacagaaaattgggattacaaagtaattttgtggcccaaatacttgggccaagtctttaattaactggccaactgccaaatttcactttactttgttctttgatgacacagccaatgagaagaaatgagtcataagaaaataggtttgggatgggacagagaattattttttgaaattaatcatttagtcattgggtttgactgggtatttctgacttaatttgaatcttattcagaatgtaattgtttgatcaaattttaatttgctttagaaagaatacatacatcaatgttaagtatgaaagtacctgatttttaaaaacagtattttaaaatggtccaatcaaattttgatttgaacttaactgatcaccttcacagcatgaggcatttaggagtttacatagcaggtgagaattgcctattgatattgcagtctgagcaattcccagctacatatgcatgagaaggaaggacaaggaacagttgcatggggtcaggatgactgtgctatctcccagactttagccatctaggaagggaactataaaaagcatgtgatgacactagttctagctccagaagggaagtgtttgcaatataaatgggtctcatgagacaacaacttcgaaaaggtagtaaatatcgcaacataagggtaaataacaataggatcaagaggagctgttaacagactcactgaagcacatggtgagaaaggtggggacaaaatggtgctgtgtcagtcaagaaatcaagggctcttttgccttgggaaaaaatgaggcagcaaagcaagctgcacccatgctaaacaaattagcacagaatggtgcttaagaatgtagactttggtgcaaggttatcagagctcaaatcttggctctaccacttactacttttgtcaccttggacacatgttaatttcaatttctccttctgtaaaatggtggtgattacagtcaacacctcacagagttgttacactgcttaaattagtaaatacatatatatgagacatatgtgtatgtgtgctccagagatgttcattaaatacagaaataaataataaattgccctgaatcaggcaaaaggcaaggaactgcaggcattgcccaataacacttttttgaccaactgatgcctgcatagctgtacctgctcaataatgtatatagttaaaaatatgttctctggccgggcgcggtggctcacacctgtaatcccagcactttgggaggccgagacaggtggatcacgaggtcaggagatcgagatcatcctggctaacagggtgaaaccccgtctctactaaaaatacaaaaaattagctgggcttggtggtgggcccctgtagtcccagctacttgggaggctgatgcaggagaatcgcctgaacctgggaggtggaggttgcagtgagccacgatcgcgccactgcactccagcctgggtgacagagcaagactccgtctcaaaaaaaaattaggataagaggaagtcaaattgtccctgtttgcagatgacatgattgtatatctagaaagccccatcgtctcagccccaaatctccttaagctgataagcaacttcagcaaagtctcaggatacaaaatcaatgtgcaaaaatcacaaacattcttatacaccaataacagacagagagacaaatcatgagtgaactcccattcacaattgcttcaaagagaataaaatacctaggaatccaacttacaagggacgtgaaggacctcttcaaggagaactacaaaccactgctcaacgaaataaaagaggatacaaagaaatggaagagcatttcatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagctcacattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaatgatgccacatatctataactatctgatctttgataaacctgacaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacagccaaccagagtgaacagaatgggagaaaatttttgcaatctacttatctgacaaagggctaatatccagaatctacaaagaactcaaacaaatttataagaaaaaaacaaccccatcaacaagtgggcaaaggatatgaacagacacttctcaaaagaagatatttatgcagccaaaagacacatgaaaaaatgcatcatcatcactggccatcagagaaatgcaaatcaaaaccacaatgagataccatctcacaccagtgaatggcgatcattaaaaagtcaggaaacaacacgtcctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagcagcacacatgcacacgtatgtttattgaggcactattcacaatgacaaagacttggaaccaacccaaatgtccaacaatgatagactggattaagaaaatgtggcacatatacaccatggaatactatgcagccataaaaaatgataagttcatgtcctttgtagggacatgtatgaagctggaaaccatcattctcagcaaactatcgcaaggacaaaaaaaaacaaacactgcatgttctcactcataggtgggaattgaacaatgagaacacatggacacagtaaggggaacatcacataccggggcctgttgtggggttggggggagggaggagggatagcattaggagatatagctaatgtaaatgatgagttaatgggtgcagcacaccaacatggcacatgtatacatatgtaacaaacctgcacgttgtgcacatgtaccctaaaacttaaagtatataaaaaaagtgttctccatagggctcttttggatttggtatggtgcatacagacagtggaagagtgacataatagggagttatttgggggagaaggaaggatattcaaaatagtaaaagctttacttttgtcctcaagttacaggtataccgttgcatactgatcattttaattcaagagtcttctcttcagggtactaaatagtttactgatttaaacatatgtgtcccaaatgatcaaaaaacatcaaacattctgcagttactagaaaacatcttgcacttagtaactggagttcattactactaagtgcaggaagcaaaaactgaccgtttttgcttaaccgttaggctctgccttgtttttcttttttctttctttttttttttttttgagatggagtcttgctctgttgcccaggctggagtgcaggggtgtgatctcggctcactgcaagctccgcttcccggattcgcgccattctcctgcctcagcctcccaagtagctgggactacaggcgcctgccaccatgctcgactaatttttgtatttttagtagagacggggtttcaccgtgttagccaggatggtctcgatctcctgacctcgtgatccacctgtctcggcctcccaaagtgctgggattacaggtgtgagccaccgcgcccggcctctttttttaaaaaattgatttagcacaacagtggtttatttctcactcacatcataatatacagaggtagaactggtctccttgatggttctctaagtggtgacttgggggtccaggttccttctgggttgagacactgttgtcttaaaattgtggtccctaagtttgccacagaagaagagagaggttctgcctcttttagttaattcaaagcaaaataagaaagtgaggcaagaaatataattttgcccctactagtacccgtagtcccagagagcagcaggtatattacgacccctgcgccctggagtcaggcggttttggtttgagtcactgggtcccagggccacatgcagcttcagtatatatttgctgaacttagcaaatgaattaaaaactgatagtaacaaaacatcctgaatctgtcccttattagctgtgtactttttactgcatccattttaactttgctaattttctagtcacccttgggaatcacttcaaagaaaagactaggaggaaaaacagaatattgaccaagtacaggaaagcttggaagcactgtaaaggacaggttatttaaaagcaacaccttttaaagtggctttatggatggatggttgtctgataaatggcacaaaaagaactatacggacttcattaggaccaacagagagtaggagaggtctgtgtcacagtaatggcccctggcaaatcacatctcccagtgtccatgcccctgtgtagttccttcccatactgactcagggcttagccaagtgacttgtgatggctaatgggttatcagcaaagatgatgcaagcaaaggcttcaaaagtactagtgcattggagctttctctcttgagatgctcttctgagatcaccaaagggtaaagaagcccagaatggaagaccacgtggagcaagaggtacagcagaaccatctgctcagtgcaactgcacgagtgagcccaggcgagagcagctgaactccttagccaacccacagcatcatgagaaatattaaactgttattcttttaggtcactaaacttatggtgattatattgtgcagcaaaggtgaactaaagctgtggctctcactgtaaataaaacaaatcttgaagcttttaaaaatgcaatccaatctagaaccgcaaatctgatttacaccttaaatgctggccacatggagatacatgatagcataaaaaggggtgttctgtaggactgtcctacatgcagagaagaggcttcttcaccccccacccccaatctctgtctttcattataggaaggaactatgacctcttaactcacttcctcccttcctctctaaatagaaaaatgttagctgtctctcacaaagtcagcattctttggataaagtataatatccaagtggttccaagagaaaaggctcattattttgtaaaccactgaccatcaaataccaattatcttaggccttaatgtcactaaaatagcacttcagagggaatggaaatggctttttatttgactatatgatggtaattctctttttggttgacagaaggaaaaatacttaaagttgaaataatacttgatctaaagaaactaaaattctaagcaaccgatccaatgaacagagcccccgggggcagggttcaaaggaagcaggagcactgataattggggatttatcactgcttgaagaggggcactgataaagttcaggctggcgatccagcactaacgttcccttggctgcctggtcacagtggctctagtcttcctcagtgctgcttagctgcttagcaataccagctcagtgtgaatcagacaagtcactggaaaaaaaatggctcattcagagcctcttgcaattggtaattccacacagaatgggctagcatctttgccctaaaggaattcatgttcttagtatagtttcatgttattgctgggctgaccccttccctaaggcttttcatgtgaagaggaaaattaaaactttatgatttaaagcattccatattttaaagatatgtgcatgtaatcataagcttcatttccagtcattctctcttactagcaaaggagggtccttttattatgaacacaatgaagaagaaaacagcctgcccaatcacatcctttttatagccttagcagaggccatttgctatttcagttgatcctaaaaagtgatgtattcatcatgaaaaatctgagggaagcttgatgaactataacagcaaacagcatctgttaccacaaaaaatttgctcagacactaaagatactgtttactttccagcttcttgagacctctacaccaaccagtggaagtggatgcaactttctgactgtaggaatgtacattattgataggaaattctggaaggaggacacagagcaagagtggaagcataactgtatttcagtgacctttgtaatgccaaagaggcaacttcctcgtaagagctagttcttctataactgccaagctagagaagctctgaagatggtcactatttccatggtaattgctttgtaatgtctcaatggttcccagggcatgtttcttgacctgatgctaaaaatcacctcgaaatgggccataacaggtcattttgttctgctgactctaaactgatctctgaagtaatgctttagggcattgcaaccagatccatatttgcaaattttactctcagattttaaaaactgtccgctaaggtacatctgattggtttctgggttgccccattaattaatttattcatgagccccccactgaatactgatttctctgaaaagctactgaagaaataaaaggcatgtgttctggaccatcaacgtttatagtgcacatggaaagtcaacctgcctctgaagagaaaaaagaacacaggcatttctaggaaagcaataatgacaatggtgggtaggagtttcttcttttaccataaccaccttcctttcttaccttgctctgatgggttgagatcctagtctgggtcccagagcactaccattcccaggagaattctttctggctaatgctggggatatagaagttgttctttgaggcacctggaagaaaccagaattcagaaatattttccataaagtagcttccatagcctgttgtcagaaaatcctcctttccaatgatttgccagaagccacagaaactatccgaaacagtaaagaactatctttcattcattcctcgaagaaatattaaactccctaaacaaaatcaaacaaaggtctactggcaaaaaacaatgagcaaatttgggaaccattaaagagggtcatcctcaatcttaaaaacaaatttaaagataggtaaagctaataattttgatacactgagctaaaaataattgacctctcttggttgggcaaaagtggtaaataccaggaatttctttagggtatcattaactcattggaagttgcatcagctgagagccacccagatgaagcaagttccacttttagcttacatcacaataaacagataaggaaatcatgaaatctggtgagaaactagaatatcaggatagagcttaagacataagtcatatgttggtgagctcagagaacctaccacagtagatcttgaatgtttctactttctaattgatttgcaattacctactaaaaccaaaaaccaaaagcactgtgtcttggtcaattagtgaacataatagaacataatacaaagcagaattaatactgaaaatactggaaggatcttcaaaaaggctgtgtaagtaccaataagacttgaggaaaatgtattattagcttatctggcagaaacctaaggtagaattgaagtatgtcccaatttataaaacagacattttaaaatgaaattaaatattttaagtgtaccaaaggagtccgttatttaaaagaatcatattatgaatcctagtatagaaaattactttcagtgtaaagtgtcatcctttgttttgaaaatttaatttttattattcattttaacataaagatgagtcagtaaagtaaagcagaatgaccaaatcaatgctactacctgttcaaattaattattactattttttcttttccttaccataaatgtacatagttgtagagacagaagagcctaacgaattcttaaaacctaagtttttgaattcatctaaaattttctcccaggttcatgcatgtatgcctgcgtatttttagagagtggaccaataaattcagttttcagcttttccatctattgtgtctgctcctttgcccactttatttttcatattgacttttgctccctatgtacccttttttttctgatggcatttctgcttccacaaagaatctcaaaaaattatcagctttttttattttcaaaataatgggactcttgttataatatccttttaagaggaagatgaggaaatgtatttgtaattgagtaaaagcttctttttcttctggaattaacagtggcattttctgcaaattgtggaacattccatttgtcacagcctctatgctaatctcaggaaaagggggattcctgagccaggaagaatccgatgcaaaaaatgtctctagtattttgaaatacttccaggttgtttgtagctagatgcacacagccacattctagaacatttcttggaatgagtaatgacttggtataggaaaacaaaagaacccaaactcagggctgttctgtccagtggaatggctggtcattttaccctaaggtttttcctcagtagttaattaaagatggaaataaattatgacttggcctagaaagagctttccttaaaatggggccaactaaaatatcctaagaacaatactatcttctgaacccctgaaatctggcttcacttttgtgttgttaaaaataggaatacatggattttctactttttatctggaagttttcaattgtcttgatgtagattcagtcatcaatgaaatatccattactttatttgttaatatggatagcaaaatgacagtttggaatacttggtgttgagagttctaactttggacgtaggatctgtgcttcaatctacctgacttcagttttcttgcgggggaaataaaggtcagacatggtaaatggcaatccaagtcttagccagggaatgaagagggaccaaaacaaacatgagaaggggaagtgctttggcatgatcacattctccactactacgaaaggtctggaatagtggtaataaaaatcatcagtgatgctggtgattaaaaaaaacaccccagtaaatattacctttggtggaatgtcttcttcctgtcgtaaccaagagcttcggtcaaacttttcaatgcgagtggggagaggaggattttccgaggtgggatctgagttctggcgtggcatctccacgcggtgggaggtcacgttcagagcctcctgaaacccagagaggccctttgtgggctgctcgtgcactgactgggaggcggtcaaggcaggtccctgggattttacagctaccagatgtgggatctaagcatcaaaacaacatgaaaacagcactattagaagaaaaaagagatcagccagtacctcagtgagctgaaggaaaaaaaaaaaaaagttcaagggcacaaaaattggactatagagagtctatcacaactatatatagcatgttttttaacagctcttcaaaattttccattggaacgatatgtagggttggcacaaagttaaatgatttacttgggaacgctaagtcagtggaatgtgtgaaataataacaataactactgtatatttagtgaatatttattgaccagcaatgcaatgtattttataagcacttctctgctaatattatgaaattcctcctttaaaacccctaacttttacattagagggtgttgctctgtaaaacaaaaactgctctaaatatcttacttgttatgaactcactgagtccatcctgaggtggatacagtcatttccctcattttacaccggagcaatgtaaggtgtagagaggtttagcaataccctagattgcacagataacacctgctggagcatggactggaccaggcattctacacccatagctcataaacctaacctctatgatattctactttctcctgtgctggctcttaccatctatgctgtcgtattatctcttgacaccaggatgtaactttttgagttaagtatctcaactaggccaactgggcatgtggtgatactgttcacgcagggaagacaggcagtctttcagcgaagttgtggctcttaaagacaaatcattaaaatccagagtgcagggcaccactttgccatagcactgctcacacctcatagttagtgcttatctaagcgtgtctcctattacttcacgaaggtgagctccctagagagaggcactatgtctgtcatgctcatcgtcatatcccctaggctagctctgtgcctggcatggggaaggtgtcccataaatcctggttggggaaaaaatctacagtgccttctaaattacactgttaattcaacaaacattagtttaatatctgttttgtgcaaggacctgtcaaatcctctttggttttaaatttaagtgctggaatgttattaatgacagttcagaggaaatcttcaaagcccagtttagctgaatgttaagcttcaaccagaatagaacctactggatttatattaatgttaaatatcattaaataaataataatattaaaacaaagcccatttaaaaaaatatctagtataaaacacaaacccactttaaaagagccaaaaaataaaaaaataaaaaaaaccacaccacacaacccccaaactgaagcacctgaagaaagcttaagtgaattaactgtcacaaaatatctacattttcactctggttgttctcatcaagtacattttccctctcttctccccttttaaaggccaaagtaccttccaaggtcaacgttaggggttttaaaagaggatatttgtacattaaaatagaaattcctgtaaaaaaatgtatctttttgagggttaggcatgaaagaattatatacaaattaaaaacagccaagaggaagatatgccaagctgcctggtgctgaaaaatcttggactttatttactaaaggcaaactgaaaacacaaagaatacttgattttatcactactcttttaaactccagttcaaacagcattacatatttcaaaggtgaccttaaaatatttcgtggaagtcttaacacaggtggatgcctggaagaaatttaagacatttggcagaagaaactacattatttttcatggaattccttaatctatttcacttcatatttcatttttggcatatataacttaaaagtcctgcagaacttccagaaaccccctcctttcctaaaagtggagtaatcttttttctttaccctatagcttttaatagttgttctcaaactctaaagtacattagaatcacttagaggtcttgttaaatcacagactgccaggcctcccccacccccagagttgctgatcagttggtctgaagtgggcccaataatctgcatttctatcaagttcctgggtgatggttgatgctgctggtccagtgatttacactttgagaaccactggcttagaagacgtaattttacttaaccaagtctatttaattttttcagtttcaggctcatgccaaagtcccaagaaaacaaaaaatatataatgcacacacatacacacacctcaaagtttctatgaattctagttttggcaattgcaactaaaagaatgcttgttctcaccttgcaggaactcctatgggtccccagagaggccaatttaaatagaagtgagtttgtggttgactcaagtttaagggtgatgcttttttctttctcacctgttcttctactcttaaaaatcagtggggccacctattttactataaattctatattaagggtcataatttgatcctgtgcctgaatccatgttacaattccctaggcttttaataataggttttcttgtgcaacttattggaatgcctgatggaatggaggcagactgtacctggggatcgactggtctgagcatggggggtgttcgagcaggctgaactccactaatgctgaaggactccgaccttgggggcaggttggggtcagatatcctgttggcaaccttgtgaggcatggcaggggaactttgccggttgagccttgaccgttcttctacctacaacccaaaaaaaaaaaaaaaaaaaagacagcctcaatgtatagaagtagatcaccttctagcaaggattttctgtagtcacctgcacagccatttgaatcctctgatcaactgattttaagaagacaaaactctgtgctgcatcaagagtttgcaaagagcaaacactagcaacagcaacaacaaaatagaacacccaagccatcactcttccattacccattatctagtgttattcggttagcagggaattcgtgacctgctaagagtttatcttgtattgattgtgatattatcttactgattggtcgcaatgccatggggtcagtgaggaagacagtttgcactctagacaatcaaagggaatggtagcatgcatttagatggcttggggaacatagaaaattgctttgggttgactcatggaacatgagaggaagaacaagaggatgaagctgagtgcatgcaccctgcatttcttcacgtgtcctactgatagacaagtgggtgttccaggctgcctgcttaatgcgcgtggcgtgtttcaaataggcttcctgtatcactttctttttctctctttaggggtctttctttccagttgtctttcctgcttcctcaaatacactgccccatctcattctttcatgtccagcttggactccactgtcttgctctcccctttcttcctccctgtttctacacatgtggtgttcattcttgcttctcctcctttctcttcccctctaaccctgtcttctctcaggctgtttcatttccttgtcattccctttcttccagggtctctttcagcccaaagcagataacagatcccaagggcttcacgggaaatgctgagccagtgaatgccctttctaaacaggtcatcattacctttagtacatatttacagcagaaagactgcctcggagggcaattttaaagagaaacttagataaacaaggtgcgcactctaagatatggcttaagatcttagacaacttcaagaagcctatgacttttcttccagatctactgtgtcctgtcctttatttcttcaggaccaacttgactgttgtgcttcccaaagccaccaggacaatgcaaccattctccccacactgatggcctttacagtgagcccttaattctcttctgctgactcactgagcattttaagaacccacgtgcagatgttcaatattcatgtctgtttgcatattttttatgtagcagctaaaagtctttattcattttactgcctgatttgaaataaaaacttgaaagagctattttcccccatcctccctatcccattttgaatctttctagaggcagactcaatcaaatatacaaagtaagtctgtttttaaactcatactaacctcacatattttaacacaataagataagctacagaatgaaaaacagccctcctgcctctagtgaggagtaatttgaacatctcttcccccaccatggctgtgcagggtacatacaattggctttggttttgaaatcccgtgtcccagaagcttaccacacaccaaatgagatttgctgcaaaaagccaggaatataaaccagaacatgtgtactttgtgtgtgcatgtgtgcgaagtattacatcagcaataattatttggctattgcattgagcaaaagaacaaagccagctttgagataagaccacaaagaagaaaaagtcccacaaagacagcaatagataaactgagatcaaggcatgcaatatatcacttttccaaatgccagactctttgaaagaaggttaatatttctagaccactggaattggtcaaatattatccattttcttattttcagggtagatcattaatagataagtcatacataagcatccttcagtgtctgaattcccactatccaaaccacttgtcacccaaaattcaggaacaaaatatatgcagagtgaggaatacttgtaattattatttttggctctaaaatacactgatagctttaaatgtacattaagggacagcacattaaaaacaatagtagaaaagtttgcccccaaagactctatcttgggcaaagaaaccatttttgagataaagaaagaattcttttgggaagtgtcagcaacaaggccccagtctaagcatccctgctgctaataggatcacaggccacagggggccctaaagctatcattagaaattaacagggcattgggaggccgaggcgggcggatcacgaggtcaggagatcgagaccatcctggctaacacggtgaaaccccgtctctactaaaaatacaaaaaattagccgggcgtggtagcgggcgccggtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaaaaaaagaaatgaacagggcagaaactagggtactggttttcacaggcaatgaatggatttgattagtcatgtatagatgttgctaatgtacttctagtaaaaatttcttatgctttctaacagtttacatattaaattctatcattagtatatttcagtcggtaccattctaaaaatatatggcataagtaattgttacactttgaaaattatttcaggaaggctccagtgtactgaaatttcctgggttgaagtttgtccaaagaaaattgaaaatctaagaaaagggtgtaacgatgaggcatctcattacgtactttgtctcaagaaaacctagtcctgaagtctttaggaagataatgccgcccaagtgtctttacactgcagaatcaccttaagaactggagcaaaggatcaaatcaaacattggaagtggcacttctcctaataataccttcagatggacagagagaaagctggatggggtatctaggcaggcccttttcattattttcatactagacaaaggcctgttccctggtttatcacaacttatgtctgctgactgaacaggagataaatatgtgagacaaaaaaagaaagtctccctccaaaacctctcccatctagaagaaagatacatgtgattaaaaactgggaacaacaagatatgtttcaatgcctgaggatgttcaaaaaagtctaggagccaagtttctgctccaactgcctgcttccaagaagacataaaatgccaggagcaccaattagaaagtgttccagtaccatcaggtatggagtgtgaaggtgctagaccataacaacaaaagatacctgttataaatgatttcacagtagaaggaattatcagaaatacagagaaggttagcacagactgatcaacttcactataaaagtatttttttcttattaaaaaatcgtttcaacatgaaaactaaaataactttggagaagtttggatcacctctgcaaaaatgctatactatttactatagcattatatagagagaaaaaaaataactgtggtctcagaaataaaattctgctctagacaggtctgtgttatccactgcctaggataggagtaatgtctatggcctctgctatatataaaggctatacaaatatagacaacttaaaaataaatttgttaatttcaggatttccaaaacaatttcaaaataaattttttaaaaagttaaaacataataaagagaaacactgtatcaatgtcaattgtcaaattgttttttatattttaaaacaatttgtaggttacagtgtctcactttacaataatgaataacatctactgagaatttcaaaacatttatagaagtaattttaaaactgttgacagcaaatatatatttactatgtcatatgggtgcattctaataatattttataatatgtagagtccacggggtttaggaaggtctcagaaggctttacttaagaattaatacatggtgaattcaacacaatcatatgggtattctctttttttccccaactggacaaaacagtttggtttttgtgtttattggcaatgctggagaaagagaaagaagccagtaagtaacttttaagtgctccttagatactttgaccctgtactcactagtcacataaagagctgagtaatatcgttgggcaaaaccacatgggcagatggttactgagcaagtttgaggatgcccctgctccgggtcacctctgagaacgggggagactctcattcataaggaatgcttaagatgcaatcttgtctgactctaagggcctggactattttcccagatcaacttcttactaatattccagaaaaacgtatagatccctgtgtgaatggagcacatacttaaaagtaatgaagcaaaatcttagaaagttgatataggaaataaagaagtgcttatctatcacctgggagaggtgggtgaagagataggcgacgccagtgaattggtcatatgaaatccagaccaaaacaagagacagaacacttgttcctcatgagctacaacagtcttggaaacaaaataggaatatgttgaataccatatttcatttgaatttgtgtagtatgtaactttaaatggcacgtgcatattcattattgcccatgagcttcccaattgtgaggcagatgtgcggatgaggaagctgcatctcaggaaggcaggagacacgccctaggtcaggcaggcaggaagtggaagaacttgaactcaaacatactccttactatttccttccaggtctctcctatatttaatcataagagagatatgcagaaatggaggaaagatataaactctctaaatgctagtttgggaactttatatataaactaactaatataaaaggaaaaagaaatcacttaggtatagagcagagaaatccggatggagaaggagtttttatacacagtgatttcaaagtccagtgaactaatggaaataaagagatattttggcccttatcagattgatgtttgcaaacaaacactccaggactggcatatatcacagaaagagaacacgatggagtgctaaaaaaattaaaatacaatctcatgcaatactcatgtaaacaaagcattctttcactgctgagctttggtacaattttttttttaagtatgtgggatggaaaaggaaggggagcccacacagttattgccaggcccagaaaatcacatgccatttaaggagcagaagaaagaaaaaggaatctccatcatccaaaaagtgaggaagaagaccttcaaattctgccgatgttcaacagaacatcatactgatattttcacagtacatacctgacatccatctcaactcagaaatggcagataatttgaaagcagtgagaatgcccccaacctgtctatttatttatgtatttatttgaaacagggtctcactctttgcccaggctggagtgcagtggtgcaatcatgactcactgcagtctcaacctcccaggctcaagtcccaccctcagcctttggtgtagctgggaccataggcatgcaccaccatgcccagctaatttttattattatctgtagagacacggtttcactgtgttgcccaggctggtctctaactactcctgggttccagagatcctcctgcttttgcctcccaaagtgctgggattatagacgtgagccaccgtgcctggctccaagctgtctttttaatgcagagacattcatattcttttaaatcaaggccaatgtgacatccaggacagaaagaatactcagtaaaaggagggagagaagagctcaacaagatttgcaaatgactgagcattttcacttgctctacaatatccaacatattaatcagaaaggtactcagaaatgcagtgatcacttgtgttttacaaaatgaagaaacaagaacagagagaacaaagcagtataagagcattacattgctgataaaggactatcgatttggaatgaggaagaggagaagtagatggaaaagtaagcaaagaagaagaaaaaaaaacttgatgagacggcatagagctgagttacaaaacaaatgctggaacagattacagaagaggttgcagtaggtggaagagagctaggtgataccttcagtggcacatggggcaaaatagtccagaccctacacaacaggagacggtggcatgggcacagagggtgcatttgaaaaaaagaaaatggcatccttttattttacttccagagggtttaacccaggttttcttataacttgatagttaagatactgataagctatgttcatatttaaagttttgaaacgtgtattactacttggtcactttgagcccctgccttcctaatatgagaaaagacatctgtaaataatgctttacataaaaagttcatacactgctgatgagaagcattaaaagatcaagaatgtaaagatccttgcactgatttttattcctactaagaagtgggtgttaaaaatgatgactcaaaccaaggcagacaattatttgttcttatttgtacatcgattgctccagtcctaaatttagcactgtcactctccttctatcaactaaatgtttcatctttcttctaaaatatgatcacccactctaagacttgggaactgtttcatgaacagacaacggttagttggaagctggattatgttaaccacacccaggagcagaggactaaatatgaaatccccaaagaatgttcccatatatctgtggaaatgcgtgaagcccaaaggaagcacaccagatgccaggaagccagggaccttggaagatgtcacccaccagagatggcccagacttatggtgactgggaaacctcacatcaggagtgcttgatgactcaggcatgttgtttgcatgctcaaatgctgtgtttcttttactgctaggagcctgaccaggaagcatgagggaattaagaggtctagaaaagtgccttgatgacatctgcaaagatctgcccccaggaatgccatgtctcctgaaagcttgggagctatgaactagttctgaatagagaggacagaccagtaaatttagtgatgaggacaaatagcaactggaaaacagtgaagtcaaggtagacaagttcaaatcacaaggtgctgggtagaggctgaatgaaggaggtgaaaactgtttcatgcttttccccctcttctggtacatttgtgcatgagggagctgtctaggggaaagaagaaattctggaatggtttgcacaacataatgatcttttccaatgggatctgtaggtgtccctctcctaaactcatgcttggggctgggaacactgaaagccaagtggtcatgcatcaaggggaggtcgcttagcgatgcagcatttcttagaaaagtagaagcacttgtaaagatgcatgagttcatgctcttcctgccccaaggtctacatgaatctctaaggccctcctgaattgcagtaatggacaactcggggcttgtcactttggagacgttgggagaagacacacaaatgaccttagatcctaactctcgagttgggctacatccttgggagtgagagtgccttggagatctcactatggtcctcaagacttcctgaggcttcatttgttcttccaaaccaagtctaataggacaagctcgtccatctttctcccatgggtgatgctcaagcaggagtcttggtctggaatcattaattcctgcaggtgctactgacattagctttgtagaggctagtttttcagtggtctgaacacctgccatggtcaggagctgtgggtctggcttagctgaggatttcaacttggcatggctaggaaatggtttagcagtagaggaaggtggtgcatgcctgccagccaagaagcatgtcagctgctgtttagcagcatagtgattttgcttagctggaagaacaggtggattattaaggggtcgatgctgtacctgggagtaggatcacaaaattgaattactgatctaagagaaagaggcagatgttagagacataggtaaatatggatcatgtttacagatgtaagggaaagtgataaaaaattcttcatcacaaatcaaaacaatttttccacacacttagtttaacttttaaaagaaaaaagttattttcacaaaaaaatacatgatcactctaaaggatttaaacaatatgtaaaagtacaaaaaagtttttaaaaatcctttttttttttttttttttttttttactttctgctcccataaaccactatcattaacattaggacaacattatgtcaagtattttctgtacatatgtcagataggttagacaaatacaaagaattattttcataaaaataggatcttatgtaagaaatctggttctagtaatattgcattctagataacttgaaaaaagcgtgagctatcaatatctaaagattctagataaaaatacaaaataactccaaaacatccttttaaatgaccagctatgatcaccataaaataaaggaaatcactagatgccagaaataatgattgaactgaaaaccagcgtgttatgcacatgacctcacacagtgactccctggaaaggttgctgatttggttggggttattttgtttgtttgctttacctgtctggctatcacccttttttccctcccatccaagcagtttttattaaaatagctcaacatagtgctaagttcctgaaaatcctttcttagtctagtagttaagcaaatgaaggaagtatgtgtagaagaaacactaatgacctctgatcttaaaagtgaataccaccaccacaagtctgaggtcaactgtgcatctgctggtagtatcacagtgaacaaagttatgttagtgacaatgttaatgatcagcaacagggtccaggcatggacaggaactgattcttcctagaattctataaatccttaatcacattattcaacaaaaaggtcactaaaaatcctccatgccacaaattcaattggatgagtaacagaaaaaaggttttttctatcttctgttatttcctataaaagtccattgcaaccacaaagatatacaaaaaaaaaaaaaaaacaaaaacaaaacctcacaaatgaaggaaggtatcttgccatttctctacagaaataatgttatagttcttgcaaaagcaaagcatgtgtcttatgatgaattgttttccaactttgcagcactgggttaactctccacttctatcacacaaactcattagagtcaaaagcctggccaacagggtgaggctacccttgcttacttacctccttggcccatgctggcttctcactaggactcattccttctttgtaatggtacagtggcttcttctccacaggcctctgctcctgccgctgatgctgaagggaaactaagtagtctctttcttgctttagctgcctctgcagtctttctgcttgtctctgttcttccaattgtttgcgcttatattcctgtccagatcaggaaagaggagcaaagaaaaggccaaattatcacatagaaatcatcggccagtaccagataagcatgcaatggaggcaaaataatgctaaataacaaaggatcttaataccaacagaatgacagaaggatgtcaggatgtgccacagaaataagctactgccttgtgttagtatctacacaagaatgtgtcatttaatgaaaacgctattgctttaaaatggcaatccctaccgaaccccatcaattacaaaatgacttgtccctgatgaattacaagtgacaaaatggcaataatgaggacatttaaatggtcggcatacaactcctagaaaaagtcacccacttcctgatctagtaattaaaccactcaaacatgtacaattaagtacaaactaagcagccaaagatagtgcctaaatcatctttcatttaataaaacttggacctacaaaggccattagcaagcttatgtacaggctaaaaaacatcagaatgccattaaataaaaagttcagttttaaaaaatacaccaaaaagcccatctggagagcagtgctataataataaaaaagtactgtacttcaagtggaagctgcatgagcaagggacacaaaatgttcccatcgtaagggtaaagctaatagtctgtaaatgaaatatgactgtagagctgatgggttcttatgggagaggtgcattttgctgtgattgtattccagcatgtcgcaaatggccttaaaaattactctgcaataaacacagtaggtctcaaaagcagtttgtacttataataaggctggatttatattcaagttgtacaaataaatggagttaataaagaatgcataacaactgtattaaatatattaggactcagcaaaatcaatcagaaaatgtattaagtttctatgaggtttttgaggtccctgaggcttagaagatcccctcttctggactggtatgttagaaggacacacgcacgcgcgcacacacacacacacacacacacacacacacacacaaacacttgcaagatgaacacagagcaggtcagctggttcttggctttctcattaccagaagtagagcttgttcatgcagtagctgctgctgcaagatctctaactgtctctgctcctcctctaactgtcgcctgatgtattcctggagaggtaggcagcagagaattcagaggaacagaaagaaagagagaaatgaaccagtaatttcaaaggcgacaagagccgctaagtaaagtgtagaaggaaggaggggaaaaatacccaaataccttcttacaaagcaggaagagtatgtcacatggaagcaaatgcatttcaacataatgaaaagcacaagcccctctacctgcaacagctgactgcgatgtctcggcattttactgctactacttggttttaataagcccagctacatgttaaagcttttcattacaggttcctctctttatggactacctggaattaacaatgctataaagttcagaggctcctgtgcaagcagcaggaataagacaactgttgaatgccatcgtgcactgtctttgtaatggaaccatcctgcagagtttcactatgctgtaagaatgtgattctagcaaagagagatgggcctgcatcaatgactcaaagtcataaagaccagagatggcatgagtagaaaagctcttctgaagcagtgaaagagtgggacttggctgatttttcatgcttcagtgctaccttcaaatcagataccgagggttgggagaatcggaagatccgggtatgtcagggaactctgtctgggtagaaagcaaggctgaataggtgggcattgccaaggttgtacatttgacttcttgaataggtgagcataattgcttgaggaagagtaaaaacccatgtaaactgagcattcctcagaaaaggtgacccacaccccagagaaggctggtgctggggtccccggggggccatcagtggggctcctggtcccagctgtacctgttcatgctccgcacgcctcctctcctcctcccggcgcatctgctcctcatagtgccggcgctgctccctctcctgctgcttccgcagctccttctctcgcctttgttgctgtggggcaacaagcagacaaccatgaaggcaacaggccccggtggggggtgtcagggagccagcaggaaaagctgttgaaccccagacatgaacttttaatgagatatgcctaaatgctccaaggttcttctctccggggctgttggagggtacactggcagggagcgggtgagagagagagattcagtgtcacgcataacatacttccatttaccatgtaagtagactctcaccaagacgttcctgttaagtgtgttctccccacagctggtgagggttttcaagtcaggcgtagaaaacaccaatgcaaaacaggttatttattacatatcatcaagttgtttatgaaattacttcacaatgcttaagtcattcaatctgtttaacaccatgtaacacaaaaatttcatagatatgtaaaaatcagagcggtgaagtgacatattcaaagccatacagaattgatggcagagggtgctttaggatttactgactcccacctagtctgctaccttttctcatatatcatgctgcctgtctgtgttttctggagtattcattattaagtgtcaatttcaagttcttgctcgaataagacccttatgcttgggagccatcatcatcatcatcgtcatcgtcaatcatcgtcatcacctcatacaattaccatgcctccaacagtggacagtgtgataaacagcttacatgctttatttcatttcatcttcacaaaaataagtggatgtcactattatctccattttatctgagaaaactgaggtacggagagattaagtaattgttcaaggtcacacccagtaaatggcagagcttgatttcatagccagacgatgtgactccagcatctgagctcaatcattaaggaagtccaagaagccagaggaatgatagaaagatcacaaagtatctggctcttcattatactctcaggaaaggagaacattttagaagttagaactaggccaagcagttacaggagccagtggttctcaagtaggagcagtgccattacccctctctggagcatttgcaactatctaaggacatgtgaggagtatttttgctggttctgatgactgaggagcatgactggcatttaccatgagaggctagtgatgccaaacatcctgtgcaaggcacaggattgtcacatattaccaagtcttttcccatacatcatggcattagtgcaccttttgagagaggcggctggccctttgtgtcagatcctttattggctttgggatttctttttcctcatatatgaagttcagaggggacataccagggggaccatttccttgtcacattctcaacaagacttcattgcatagcttaggaaacatgaggtacccagagtggaataaattgtgactgtctcacactgataagttagctctacacaaccagggagatagttttttacacaagttctgtgtctcagccccagctaaaccaaccacagatattcagaatgccagagaagcccatgtggaaaccttcccgatggagctcctgcagcaatcctccggacctgctgtcttccaataacctctgagtcttgggagataagctgcgtctcttaagactcagtttctgtcacttccagatcaacaatgatttttccatcttggattgcaggcgaaggagagctattggaggacttcatgcagccaaatgacttgatcagacttgcattttcaaaaggcctccccatcatccatgaaaaggggcaagactagaagctgaaaagcagtgcaaggccattctgtggatctaggtataaaatgatagggcatcgatgatttcagcaaaggcgggatgagagtccatgtttataatcactgctgaggatggagacacagccaagaggaataaagactaacaactatacaggttgctggtcattctaataggacttcagtggacaccaatttagaaacagaaattagaattaggccaaaataaaataggcaggatttggtgacgacaggttgtaggagggcaggtgaagtccccggccaaggggcacagtggacgatgggatagagaagagcaggaaaagtaggagtggggtgggtaccagcatgaggcaagtcccagacatgcaagtatttgttttacagaaaaataatacaggaagatgcgagtagaaaacatcagcataggcactgactgaataatttggattacagacccaaaacagagacatttccaatactcaaccaaagtgaatcagtgccagcacagagaataaaataattatgtgtacagatctggatcctggcaggaaatagcactaatttagctaatatttcaaatttcttactccaaccatccgtctctttcttaaggaaaggaaaataatcaagccctttgaagagttagctgatctttatgtgaaggatttgtacattttgaacccctttgccaggaatcaatactgttttataattacatgccactcaggtccctgtgcaaggtgtatacagtattgattgcaactcaagagcgtctgggcttcccaagtactctgtagtttctgagaaagacactcaaaagtaactaataattaataatgatctcactcggatcagcagccgctaacacatggaggcatctgccagggctttggttcctgtggtgaggttggaaaaataaatcgctttcccaaccttctgagggcaccctgccaatttccagctgctgtgtctcaatgttaatgccattcttgaaaaaatatttgctttctctcctcctgtgcatggagccgtatgagggaggggatataaaaaaaacatatcaatgcaagaccaagtccctggcctcaggcagacacctttacaaagctctgatgactcttgctagaagcagctctctgagggcaaggccagtgcttgatttctgctgtaccccaacccctcagacgggggcctggcacctggcaggtgcacctaagagtttgttgcgctgaacatagtaagaaacttgagggaaaagacaacacagtatcctcttaaatttctttgtagaatttttcctcctgtcaatactgacggtatggctacctttccataccttatagtatggctatttgagtatatcttaccaactttgcaatctagattgaaagccgtgtgtgggcaagatctctgttccacttgtttttatctcccattgtttccatatcaggccagccaccagtgatatttgttgtgttgaatactgcaaactggctaagtaatagaagaggggagagccctgcagagctttgtaccagacctttactctttgatgcccttcttaagtagctcttattggctggaacattcttttatattgaacacagacagaactggagaatgttcttctaaaaagagccacctacagttggcactggaatgtacctgtttgccatcttagagaaaggcatgaaaaataagggaataagagtctaaactggaaaaaaagggaaaggggagaatcaaatagcattcctagatcttattcaaattatacataatgaagatagtggtcctgctatcagaaaagaatggctgaaaccaactactctaaaactgttggcagattctccacctatattgaactgcctagaagtatattttcatccatgtcttcttgtaggcattgctaaaagttatattccttaaaattggacattcagttgcttcttataagtttcttaattttttttccggtggggagatgatggatagaacctactgttaaagttttccaggccctaacaattgttgccttactctatggagtagataatcagggacttcatgtcccttttgtcttctgttgatgttcgccaaggatgatttctttttaggacaattcctttttatttttattttaagatattttaaatttcttattttagacattagagaaaggcatgaaatatttaaaagttcttattttaaatatttatgattgacatgtaataattggacatatttatggggtacaatgtgatgtttacatacatgtataaattatgtaatgatcaagtcagtgtaattagcatatctaccatcttaaacacttaccattgctttgtgacgagagtattcaaaaaccttttatagctattttgaaatatgtaatacattgtgaatttcagccatcctcttatgcaatagaacaccagcacttattcctctcgtctatagctttgcacccattgaccagtctctcaccactgccccctgccaatcctctggtaaccactgttctactctttctttctatgagagtgacatcttagattccaccagtgagtgagatcatatggtatttgtctttctgtgcctggaatctttcacttgatataatgtcttccaggttcatctacgttgctgcaaacaacagaatctcacttttttatggatgaatagtacttcattgtatgtaagtaccacattttctttattcacgcatccactgatggacacttgggttcattccatatctggtctattgtgaatagtgctgcaataaacaaaggagcacagctatctctctcttttttttttttttttgagatggagtcttgctctgtcgcccaggctggagtacagtggtgcaatctcagctcgcttcaagctccacctcccgggttcacgccattctcctgcctcagcctcccgagtagctgggactacaggcgcccgccaccacgcctggctaattttttggatttttagtagagacggggtatcaccgtgttagccaggatggtctcgatctcctgacctcatgatccgcccgcctcggcctcccaaagtgctgggattacaggtgtgagccaccgcacccggccacagctatctcttgaacacacagacttcccttcctctggctatacacccagtggtgggattgctggatctggggatctattgggggcagttttgatcctccctatgaatgctcccctcacgctacctctaggtggaggctgtgtggctgcactttcaagcatgtgaatttgttagttaattttaatgagggaatagtaattttgtcccacctgttcagggggccctcaaaggtaatgcatttatcccaaattggctatgtagaatttttgctgtttaaattctttgcagagaatatcacctcaacccttaaattctgaattgtcattagaggtctagttttaagagataatcctcatgcatattcctcacaagggctgtggagtcagtctttcctttttttttttttttttgtttaaatgctcttcttagattactttagataagcagaaaagtacgcacctacaccagggtgttctagctctcatagaagtgactttgatgaactgcaatgccataaaattgcattttatgatgtcttcaaaatagctgaataaagctaaccactgcatttatgccaggaatattgcctcagacattattcattgcactacttactaggcaagtgtatagttttcagtgtgatctcagaaagcttgtctgagtaactggtttactcttatctgatggacaacatgaatctcaaccacttcacatctgtctcttttctcatgtgtcaggcctcagagcagattggtgaccgccctgggcaacagcgctggatgccatgttgtgcaggcattctgtgcactgaccccgctcctgcctgcatcttctttctccgttctactttatgttcccttctacattgtcttcttgtttattttacttttaattgctgtattaatctctttaagccaccttaactcctccttttggaatgaggaaaagtcataataagccaaaaaatgagaaacaaatcttggccctggtccatcttttatatacatcatatttcccattatatggacccaagtgatatccacatctgagaattaatatcctatagctgcaatgcaacgtgtcattgggatagaggggtaggcaagagaggcaacagggcttggggaaagaataaaatggtttggaaacagactagattctggtcctgcactgccaccaatacgaacactgaagaccacgtagcagcgctctgtaaatatgtgtttgatggccgggctcacacctgtaatcccagcactctgggaggccaaggcgagcggatcacctgaggtcaggagtttgacaccagcctggccaacatggtgaaaacccgtctctactaaaaatacaaaaattagctgggtgtgatggtgcgtgcctctaatcccagctactcaggaggctgaggcaggagaattgcttgaacccaggaggcggaggttgcagtgagctgagatcgtgccactgtacgagattgtgcctgggtgacagagtgagacttcatctcaaaaaaaaaaaaaaaaaaaagtgacgaatgagtgaatgttgtttgaccttgagtaagtcaccttcagctaaactttcaatgagggtatagattaagtaatcttgcaaatctgttcattctaagagtctgagcaaggttatgctacattgcaaagcaaaaatctaaccattcagagtgaaacgaagcagaattcttatttgcccttggagagctcctgttgcttttcatcttgggtgacctcctgaaagcggtgagaggaaaccctactgtgactgtggaagacccgagttggcctccagaggacaggaaaacggctggtgcaagatcaagtcaggctccttgggaagtacctcaaaccatcccctccacccaggggctctctgttcaaagacactcagaatgaaaggacccagtgtggtcttttgaattgactgcacatcacacatgccccctcactttaaataggaccattctgtataagcttcacgggagctatacttgtgatgagaggtattccagcttctgggcattccattttcccatttaacgttgctaaagttttagttttggaaagatcattgcaaaccaatgactatagggtaagggcatgattccttgtgactaaaactggagttccaaacctttttttatgtaaggacacaagagtgatgaggaagcagtctggcacctctgaattcactatatgacaatgaaataaaaacaaaaataataataactatatgcataatgaagaacacttacgtagtgcagcctatgatgccaagcactgtactcatattaactcatttaattctcaccagaaccctttgaggcaggtaatactgtcatcacccccatttgacagttaaggaaactgaggcacatccaggccaatatcttgcccaagttcactcggttggtaagtgcgaggccaggatttatattccatgcctgactcttgccatgctgcctcatttgggtccacaagaagcatctgtgtgtacaaagtaaaagatactgtctaatgctttttaaagttgccattttcccctctttctatctttacttgttacctaccttaacttgttacctaccttaaagctaccatagctttcccaatgttctcagaaatagtaatcagagaacattgggaaagctagacaggccagatataactcattcctttctttctacacctactttacaccatgagagataaactatccaacctaccctttgagagctttcctgaaaaattaactgcctaagtgaagccttttctttgtgctcacaggccaacttttgattagcagacagccccatggctaagcactgtcaagcacatgtgtgcaagctggtctttgcggacactgaaagaggcatgacagttctaaacagactgagcttcacgaagcggtgcagaagaattctcatcctgcctcttccatggatgctagtcaatgtgattattcacaaactccttagtgtctctgagcctcagtttctcctgggagaacagtcacacgggatttcccaggtgtcatacagaggagcaagaatggcctaatggacatccctagtacctacgactctgaatgttagtgtgaaagtcaaatgcagatgaaacccccaaattcctactgtcatcattctgaagccttagtatgagaccctcagactgagtcctatgaagacaagccagttataaaccagtttattaatacagtatttacagagagggccactccagtactcccgagatgatactaaagatgctaacttatacgtagaaaggttgcaggaactggtaacatttgtgggaaaacattattaatgtcttcacacatttctagggcagatatgcagggaatttcagttttatttggcacaacctgtattaatgcagggatatcacaagaactcgaatcaacgaaaagataacttttccaacattaggagttgttcaaaaatagaatgtgctgcctcaagcccacggacatacaaggaaagattatatgttaaacaggttagataaccctgtttgaagaatattgcaaaaggaattcttgctttgagagaagaattggctgagatcacttttgaggttcctaatattccccagcctctatgattctataaaaccacttactaaagaaaacaagaatcaaaataaaagcaattcaatttaaatgtcatgtgaaataagatttcatgtgaaactattttgttgtcatagttctatggttaggaataactaagaagactgtgaacacacaaaacatacagactagatgtaataaaggtggttctgtgaagaccttagacaacggagggtaggtctgtgtgatgtccattgcatgcaggcactaaaaagccatccctaccttccatgcaaggtactctagatacaccaaggatcagcaactgcctaactccaggttttttttcagtatgaaatgctgttaagtataaaacactagcgtactctaccttcctatgtcttaaaagcgtaggcaggagcctgggcaaaaggactccagatttcagtagcattttacactacaaaatagggatgtcagcccaactcccgcactgtggcaggaaatccctcccatcacaggatccaggtgacaaagcggacaaagtcagaactcctttggcacaacacgtaagttagaacaagaagcccttttgcgatccactgggaggtggggttccttatatccatgcagatgacacggctccctgaaacacaagtgtgatttacatgtgcatgcgattactgaccattatccaaagctcatgggcacgctttgtcctggacaatgagcatctggtttgccaggatggttcccagctgtttcataatttctgttcagttattgaaataacagagcaaaagcccagctagaaagtgttcaatcttgtgttgatgctaatgacatccaggaataaaaagctgtgctgcctccaactagccagccactgctcacaggacacactgggacacctgtggttaatgattaagtgaattaaggaccacttctcagcagtgctgatgtgttaacactccaggctctgagatgggggaattaatttttcttgctcacagtgctttcctctggcttggggcctgggagtgtggtccagtgggtagaaatgctgcactggtaaaaaacccacacgattttcctgtctccttcttgtgcccactgtacttgcctaggcttcattcagcttcaaggcctcaccctggaaagagatgacccagggcagcaataacaaagcaggtaatgagaagcaagattcttcccttcacatgtaacactctccttgaacttattcaggtgtttactcagtgccaggtactgttctaagtggtttgtatgtattacatcccattttataaatggtcaaactgagacatagagaagtcatgtcttgctcaaaattacaaaggaagtaagtggcagatctgagattcaaacccaggcagtgtcttactgaactgccacgttctcacccttttggtgaaagggtcactcggaaggtactatttccctgatgcaagaagcttgttattcactcagcacaagatctctgttccttatgaactttatttagatattgttaggaaatgaaatttcatgcagccacttggtggcaatgatgggatcataatttacagtgttggaaatgacagcaagaaatactgataagataatccatcagaaggcagtttctccaggggaaggttctctaggtttcactgggaaaaggagacttcccaaggtggcagttgaccctactaaacaagaaatccgcaaaaggacaaagaatgggccgcctccttgtcctgacaaggccaggactgcaggctaactcaccagcagataaacagcccagtaagacataacgaaaatgtgctctggaaaaatgctttcaaaaggggatgaaaaagtcaaggttttacactaaacagggaaggtacattaaggaattaaggaagacagggaatggggaaatgctagctatagacagcaccattaaaatgaaaaacaaaattaacagtactatactttgaaatcatcagttccaaaataacaataaaatattcacccaagaataccaatccaggttttgtgttaggcattgtgccaagtcctctgtatttatggtttcatttacttctcagcaatcatgaaaagtaaatattattttaccaaatgtgcatgtaaggaagctgaggttcagagaggttaagtaatttgccaaagaccacacagctaagattaaaccttggccttggcctgtaaagatagtgtattttacctctacacgaacctaaagctggccatctaagaactattagacatttattgctcttaatgatataactgaattcctcccagtattataacaaatattcttcccgaagcatagaaagaagcttacctatttacatttattttaataaatccaaaaaggttttactgtagcacataaaggagttcaaactttggaaatttgtttccttgactttggtcaaaggcacctacaccaataacaagaacaactcatatttattgagggctcactatgtgttagtgatgtcggcaggctttgtatgaattaactcatttaattttcacaacagccctgtgaggtaaatgctattgttatttcttgctttacagatgaggaaactgtaaaacaggaaagttaaagaacttactcaggtcacacacctaataaggaagaaagctgggatttgacccctggcagtcttaggctctagagtctatgctgttaaccaaaatacaatttcactctctactgaattttaccaaatgctctgctgtcccaggactttccagagcatcaatatgctgtcctgcactgtgattcttagagaaacttgcagcttccccaccacctcaccactcttttgtgggtggaggctgtctaggagcatttggaagaagctactaaggttccaaagaacaaccttccacaccagcggcttctctgggtttgggcttcagcttgcacagctgagctgctttgagactgggcttggttaccctaagagaagagtgaatggtgaccgggcatggtggttcacacctgtaatcccagcactctgggagaccgaggcaggcagatcacttgaggccaggagtttgagaccagcctggctaatatgacaaaaccctatctctactaaaaacacaaagactagctgggcgtggtggagcatgcctgtaatcccagctactcggatggctgaggcataaggattgcttgaatctgggaggcagaggttgcagtgagctgagatgatcgtgcctccaacctgggtgacagagtagactccatctcaaaaaataaattaattaaaaaaaaagaaaaaaggaagaatgcatggtaacagagaatgtgaacaaaaagctgatagcaaatggatgagcatggaattaggaagaattccaacacaagcataaggtgggtctcattagaaatatttaagctgaatttgaccagtcctcaaaagtaaggtctgtccagcttttggcagtcaataaagttcttttatatccatttttctggttaatcctcaggaaaactttggtggtgggaacaagctttgctactgatctccctgcagagctcaggaagtggaggtgtggagagaataagaactgccagggcatgcaggtagtagtagtacatggtgaccctcagaagttgacgtcttttcactccaagtgcagatctactgactccctgggcaggttgcttcccttcccagaaaagacaggaaatgaaagaatttctagggagtactacacaaaaactatgtgttttgttttttgttttttgtttttttttttttgagacggagtcttgctctgttgcccaggctggagtgcagtggcatgatcttggctcactgcaaactccgcctcccgggttcatgccattctcctgcctcagcttcccgagtagctgggactacaggcgcctgccaccacacccggctatttttttgtatttttagtagagacggggtttcaccgtgttatccaggatggtcttgatctcctgatctcgtgatccacctgcctcggcctcccaaaatgctgggattacagtgggcgtgagccactgcgcccggccaaaactatgttttaaatatcctctttgtcatttgaaaccaaaagatgctattgtcttcctgacctctgagcagcattctgcagagctggcccctttaactccatccttatgcttgcatactaaatctttgcttctatagcatcaaactctccaggtgttccttccacttccttatcaaatttctctgctgtctcttccttgtctattctgagttcttagagctcaggcctacactctcttctcatgtgtacttttattaccacaaaccaataattcctatttttcttatttttgacccctcttctatggccatctctaccataatccaactgcatggattgtactactactattactgttggctgctcttcctcatccctgatgtctaatcaacttgcacatcctgcatggtccacaggctacatttgtctcaaatgtgtccacttttctcaatccccactccaccatcatctgtccaaagcatcacactctctggcctagactaacttgtctcctccatttactcttgcttctttccagcaccaactgcagcagcccaagtttcatttgaaaaaggcagatctgattctgttcccttagtgaagacacatcaatggtttcccactcttcttagaataaaattcaaaagtaatcaacatggtctacaaagccctgcatgactgtgccatggcttccctgcctggtatctctccgtgccccactccctcctgtagcgggactctgaccaagccaggtgaggctcccaccctgtggcacgctcttttagcatgccactctcctccaccacggcagtcattgctgtgatgataaatgattacttggctgattatttgcttagtgcctgtttccctcacagatctaatcgtcacaatgggagactgtatttctagtgtctaacatggtgcccacacaacagaggtgttcactgaatatttgtcaaatgatgacctacagaccccaggaaaaggttttaattcaaccttatgcttaaaaacctcatgcttaaaaacaacaacaacaattgagtctaacatccttgaaagcctcagtcacaataaaaagttagaggcttagagagggctgacatttttaggctgccaggttcttactttgtacattaatgctccatgattactggccaataagatacaggtgatatctcttcaaaaaaaaaaaaaaaaattcatgggatggagccaaagtgtatattttttggccagatagaactggttatttttataactggacaatgttaggatggtcttgaagggcactacatgagaatgttggtgtcctgaaagagtcttgaaagaataaaacatactaccagggagcaggtgcttctggggtctatttgattcattcctgtgacttacaggcacgctccccaaaatgaaagtatagaatgtgctcagcaatttgaaacacatatataaatcactaatatcatttcagaactcttgagcagaatcaaacatcaccacaaacttgctcaagattaccagagtagaagccttgacccctgaaggctcccattattcttggatcctaactccatgatacagaataaaacaagatgtattttgtttatgccaagtaatagaaatttttattgagctgagtaaaactagaagaggtcctccttgtactttttctcaccattgatggactcattcactttagctgggtttaatcaagttcctggaactttgttataggttgtacttcaacaatggtcaaaagctgagtcttctctccaccatttaattggcctgaagccacgtccttttcataaagctgatcagtgacaacattcagtgtatattcaaagtccttctaagaatatacagacactgatttagagcttagccaaatccacatggttactcataaatagtaaaggacatgcagggcttccttagaaaccctctggtgggaggtgacatttgagatcacaaaatacaaaagctacaagctacatagtcctgtgtgaccaaaggggtagctaagtgggaatgtttttcctacaaaaggaaaaatgactcgcagtgaaatactcaagctgaactatgggctttaacagtttctatatgacaatgtagtccaagttcctactcaggacaccagaaacacaagtggtcaccaaaggccagggaagcagacatagaaggggacctggcaggagcaggacacagcagaagagttcctggtgggagagaatgtcatgactaaggggttcagaatttacagctctctgagtacttagtattccttgttcttctccactgcgctatagaataagatgaaggatcaaaagagaaagctggaataatctatcaatgctctgtggccagaagcattcctgcttctggtatggagccaaggctcatgcccattggtacatacagcaaaaggcttgtgccctcatgcatgctggctgacgtcttctgtgcaagccaggattgacagggtgtgtctctggctgcacatgcctcagtgagctgaactctgacttgctccatggtagaggttcaagcaaatgccacaagagaagagacacaaaggaggccttggcaatagctctgactgggagcgtgagacagaacccaggtcaaaggcgagcatctgttggccacagattctgtgcccttgcgcagaactccttaaatgttcaggataaaagactatagacatagaggccagatgagggatgtggaaaagcataccaactttgacttatcagtggagacacagaacacatgcagtgacttggtgcttaggctctgcaggccaatcccctggatctgaaacccggttttcttctcaacctttaacaagttattaacctctctaagactcagctgcattatctttagactggagattattgtgaggattaaatgagacaattcgtgtaaagtactaaacacagtaccctgcaacatgggaccaattacttccctccctgaacctcagtttcttctttgttaaatggggattatgagttttgcatgagagataatcaatacaggaaaagagataatgatagtagatgagatagtggctataagcaaagcatcctgcctggtacttgacattactaaaatcactcaataattgtaaccattgggtattattgttgctggtctgatactgatatttgaaggacataatgaggttgatgggatttgctgcaaactggaactgaggcccttactgatttaaaccagggaggctggaccttgatgtaccatttaaaaagcaatctgctgctggtgactgcaattcaccaccctctaaatcttcagtggccacctggcaaagcaagtgaattgctgcaagcccgttaatgagaagcaagctggtgttcgggaaacctgtaaaattactatcccattaccgtgcagttagtgcgcctttcatctgctgcccaacttccccaatagatatgctctctcggtttcctaattgtctagaggctttgatttatctggcagaggaaggaggcctgagatatctgggcaaagttctgggaaggaggctttaacaaatgtctgtaagaccacaaggtgagagtctggcccaggacaaggcatgcagccaactgtggctagcagtatggcttcccacacagataagcagtatctgctgctaaaggcaggtcttgcccacaggctggaggacaggccctgggtactaagggatgtctgggaaaggatctgtgaaacattcttcctagcattcagagcatcaataggcaggtcctactcttccatacttgaaattccacttatctgcttattcactgtgatctagttaatacctatatttcacctctcaactactgacccattcattcatatattactcattccacagatatttatgaggcacctacgacatgctagagatacatcagggaataaaagagataaaatctccttgtcctgatggagcttaaattccagtagggacattcaggcatgtaaaagtatatgtagactatatttgaaggtgctaagggctgtgtaaaagtaataaggcagggcagggaaataggacatgctggagggagggactgtgactttaagtaaagctgagaaggtgctgagaaggtgatatatgggcaagacaggaaggggtgacggccttcacctgcttttctgaaatgaccacaccaccacaaaaagcaagggaagccttttgtttgtaagagcattcaggacttatctgcccttgcagtcaacccctttgtgcctctaagctctgtgtgctcacaggtgggatgtgggcccccagggaatgcttggagagtgaccacaactgagaggcttggggtcagaggtggcccgagcaggtcctcacctcctccagccgccgcctctgctctttctgctcctcgatgcgcttctgacgctcggccagcagctgccgcttgtgctcctcattctcccgctgctgctgctccagctgctgcctccgtagggcctcagaacgctccttgttggccagctgcagcctcagaaagtccctccgcagcgtcgactcccctggcagattcaggatggagctgtgggtaggagagagtgatcaggatcccacgtggggcaggggccatggctaccaagaggccttggaggaggaaagcgggacaaatgattcacccacacacagggaaagaagagcacaggctcctagatcctccgctaattcaatcattcaccccaaagaaacagcatcaggataagagacctgcctccctttcagtacgactgtggccaacaaatgctgcctccatccatagagggatgtcacattctcagagttgtcaccttctccaggactgtccacaccactccctcatccttgggacgtggcaaagatttgtttttaaagactttagccagtgtgcaagccatgagccccagactggattattttcaataaaaatggacaatggtgggcaacaagggtactcagacaagcacagatcggcctcacccacaccaccccctcacaccaaaccccatgaggcagaggccaggctgctcctgtgaagccacgatgaactagcgatggaaaacccttgagtcaaggtcaacacagagccaggatctgagcccaagcctgctgagtccaagtcagggtttgcctgactgtaccacacttaaagggcttggtttggctctggccacagcaggtgcagctaggacttcaacccagctcattggttcctagattctgtttaggtaacagttttgtcttctgtaaaatggtggttgtacatgaatgtgtgtgcatacgacagagatcgagaggacataaataagttctacctacttcgctggtggtcctgggctgccctgctcgcaggtgaacaactaaatgttacagactccttgattctgcacagcagcctaagagggagctaagaaatgacttctgtttattcaaacgtagcccttttaatctttctggaagcttccatttgaaataaatctattaaacacatatttacggagcacctgctatgtggcagtcactgtagtaagctctaaggatacggcagttgctagataaattctccctttaaagttatcttcttatgggacacacatacagacaaataatttcaggtattaataggctctatagaagactaaaattgtaattgtttcagtgacagtggctgggagctgaggtaagctttgaggccttactttagatgggtggtcagaaagacctctctgggaaggaagcagttgatgaagaaggaagaacgttccaggcagagggaaaagcaggtttagaggcctgagaggaaaacaggggtgcaccctatttttgagcaactgaacaccagcccggcttcccagagcagagtgaatgagagggagaagggtatgagaggaggtcagagagataggtgcggggccgcgacagccatgcaggcacgggaaggttttatgcagaagagcaacatgagcagatgggtttggctgctaaatggatgacctagcgaggggtacaggggcaagcacagcaagccggactgctgctgcagagtggttctggggtggggacaccacccagggcgagagcagagcgggtggaggagggaaggagcgtttggggatagaggtcacgaagcctgtggacagatctgacatgtggagtgagggatgacttgcaggttctgtcttggtggctgggtgacggtggtaacgagaacaggaatgaggaatgctgagggaggagcaagtttcgtggcagttaacaagaggaccaaggatcggttttggagagtagttagtgtgctgtgtgagatactgccatgaaaagacataaaaaggctttgttcgtgatgttccatagacaatgcttggcgtctactcacaagccttctctaaaacttagagcctttgtgtcaaactctaaaaccccaaacgatggtgcttatctacacaggccacttgccctgtgcagaggggagggacttgggaacccagcctcccatgcacacgaggatgctccattaatattaattgatattgaatcaatgtcagaagatctgagctgtgttagtgactcaaccattaactctgtgtgtgacctgggtgcaacccttaggctgtcgcctcatttctaaaatgagataaccattgtccttttctatttttcaggatttcatgaagattaattagatacgtccataaaaacaggacttggacttaaagtataataacaacaacaacaggacttggaacataatcttcagcatgatataatgacatgttataattacggaagtgttaaggtacggctgggctggctcgttgagtgactcctaatatgcagtttagcaagtgttagaaagacagggtttctcagttctacagaaagtggtcagaaggctgacacagtaaccttttgggtaagcttttgaacactggtgtacaacttctctgaaagcagggcgtttggtcctctgcctttcaggaatgttcattttctatgtcactacttggcagtcatcttctttatgcagctaaaccggggacggccaacatgctatgtatcagatggtaggaaagaagtattcggtctttgaccttgaggaatcctgtggcaggtgaagagagaaaaactggatggctctgaaagctcagttccatcttcttatagaagcttagcaagaatccagctcagtaggtctgagttagcataaaaaaagaacacatggtatctggctcattctagcagtggtggctaagctggccccttttctggtcagaaagctctccctcagtggtacaggaactgatccttctggagcattagggtccactccttggatggcttgaggagggaggccacacctcaatgagtcttctgcttgtgcaattccccccaagtcttacttcacatgtatactgcatggcaccatgggatgtgggcctgccctccttgactcaacaagctgaattcgctcaccaaagagatatcctggcagtgcaagcacactaaccttaattacttataaacacagactagaagaaagtcagaatcaaagtcaagtggaattcaaaatgtaggcatgacaataaaacagccctggattctgaggtccaacaggtgacaacaggaatggcccaaaagtatttgtttggagttcatctctacatataatttgattttctgaaaatcactttctcctggattaggctgcaatgaaaataccaaggcatgtgacaaggacagtggctacccgaatgggcttctcaaaggtgtgaagtaacgaactgaataacgcaagtccgaaaataccacttaggtctctagaaagttgcagttttaagtatttttagtcctgcattgcccagataattagccttctacccattctacgtgttacatatgtaagaaaacaagctcttacgatagagaccataaatcttgggggacaagataaagaatatgctgatttccacattttcgtaatggtctgcctagggaaattttcccaaattaatgagtatgttcatgggcaataaattaaataagaccaccctggtggattcttaaaaacgaacctataaatcaaaaggaaagtgaatttcacacaagcacaattcagaatgtgaacattagaagacttggcttttgctctcatacctgggctctcctgagtcattctcctcctcttcttcctcacttccactgtactcatactctgtctcatctgaagaaagatcccagcatgttagtgcacaaaaagatgctatggctcagtaaagcccaaccccgtctcttatatataaataaatagacacccaaagagttgtagttaacacagcgctggaacggtctccaggcttgtgatttaatggttcccataagtatatgaaattaaccacattcaaggctgtctcggctgactctagatatctgtccccagtgcctagtgttcacatgagaaggaattaaaaaataattttttaatttttttattaatttaatttcaattaaaaataacttgtttggccgggcacggtggctcacgcctgtaatcccagcactttgggaggctgaggcgggcggatcacaaggtcaggagatcgagaccatcctggctaacatggcaaaaccccgtctctactaaaaatacaaaaaaaattagccgggcgtggtggcgggtgcctgtagtcccagctacttgggaggctgaggcaggagaatggcgcaaacccaggagggggagcttgtagtgagccaagatcgtgccactgcactctagcatgggcgacagagcgaggccctgtctcaaaataataatataataataataataatttgtttgtgttattcccactataaagccacccatatcaaacccattggccctttgtaacttattgatggtattaaccatttttaaagtaggattttattatgacttacatggacttgcaaactgtctttagactattttgctaagtgcaacaaagaaacttttgacaataggtgctattaaaaatatatagtggccgggtgcggtggttcacgcctgtaatcccagcactttgggaggccaaggtgggcggatcatgaggtcagaagatcgagaccatctaggctaacacagtgaaaccccatctctactaaaaatacaaaaaaaaattagctgggcgtggttacaggcaccggtagtcccagctacttgggaggctgaggcaggagaatggcatgaacctggaaggtggagcttgcagtgagccaagatcgcaccactgcactcaagcctgggtgatagagtgagactccgtctcaaatatatatttaaaatttaaaaaatgtatatctatatttaaaatgtgttttgattgatccactagggacagtcctttaattcagcaaaatgggaagcagtttacatgtgtgaatgaataagattgaggcttgctttggaagagatcaaatctaatatgtgagatgagtaaatatcagagccttcatgattgtgaagaaagggaaggaatatttagtgggtatctcccacaccagtcactactgctagatattttactctgttctctcatttatttttcataataaccctccaaattagtgtctatttttcaagcaagaatactgaaattacaagaggttaagtaatataaccaatgttatctcattaataaaaggtcaatctaggatttggatttagaattcaatccagaacttttccaacttaaaaaatagtgctctttccaacatattatatgctaaatagcagtacatataaagagcaatgagatatcaaagaaaggaacagctagtgccactggtcataatggaggaagagacttgaagtctttggagaaaaaatgaactgggctttggaaggtcagtggcccttctccaggcagttagcagctggcacttgtgggaaaaggacactctaagcaacatatccacatgagtaaggctggcagtattacagtgcataatatgttcaggaaacaatgagctgtgagtagttaggtgcctgggtgtgagaaaaccttatggagggacaaaggctggcagggatgaaatggctcactgattcttataaatgccatgctgagaactttcctattggcaatgaggaacccttggaggagcttttaagcaaaggaaggtgtcacattactcctatctcttcatagctgtaggttaataattacaaccttgaagacatttgcacatccctaaaaagaaactgaaactgcaatttagttatgttaccaccaggaggcagcagtcacacagtgagaatgctcagatttgataaacatgccttgcttttcacactagccattaaagagataatgaaggaaagccaaaagtttgatgagttcaagtgtatttttaaaatcacaacttagcttcatacatttaggtatgtatgaagctttcaggctacttatttttaaaatattagttcaccaaaatataaagaacctgcataaagcattttaatactccaccctaaaaatgaaatattccaaactttttcaaaatgaataaacagatttcaaagtaaaaatgcagaaattttatctaataaaggaaattacagcaaggaaaagaagcacacaattattccaattacttctactctctagggtaaatccttcatttgtcaggcttctcaatttaatatttaatacttcaccaaaatttgcttttgactgcttttatattactgggttaaatttggcatgtgtcagcatatgttagggaaaaaatatcaggttgaaaaaaatcacaaataatgcaaaatagaattgctttgattgattctaccaaaagttggtcatagaacaactaagaaagtgaaaagtaatattagagcaaactaagtcatttgattaaactgaacaaatggaattagatctcatttgatcaaacaccattccttggggagcagacaaaaaggagactagaactgtgattctggtggccctaagcctaaacaggcttagattccttaaattactacataactcttgaacatacctattcccaagaatcttacttttccactctgcagagaacaaacacattaaaaatgatctatcttcatggcatggtgagttctgagtcacattccagagtttgtgccccacaaaatgtggaaacaacctgaggcacaggcttcaatcactcttatttatgccccagagggagatgggtcatgagttctcacaaagtactctgagtaagtgatgaaaaagtatgggtcaataagtaattgcctacataagaataactgatatttactgagtgcatctatgtcctggacattatgtcaagcattttaaatgcattacctcgtttaatctttgcaactatttgaggcagtagatattagtagtatactctcaatcttattttaaagatgagaaaactggagtgatgttcacataactgataaggggcagagttagaatttgaacccagaatatgaatctgaaaacagtctgagcacttaaactatgctatatattcaccgtataataaaatgtccttttgagagaagttagcatttaatggttgcatgtctgacacactgccctaaaatatgcccttaaaaattctgacttcatggagtagcccaagaccaccatggacaaggagcaattgaaaaatcagtcctggaacttttgagtttgacctatgtatttctcttcatgcctagttcctccagcttgggctggcctcccagctccttagggtctaattgacatcttattaactgcagatgagccaccgttttggcctagcttcacaacaatgtatgatagtctaagctgatcatacattccttcaagtccctgctagctgcataagaattcttccctggggctgggtttggtggcccatgcctataataccagcactttgggaggctgaggcaggaggatttcttgagttcagcagttcaagaccagcctgggcaacatagtgagacctcgtctctactaaaaatctaaaaaaatataaaatcagccaggcatggtggtgtgcacctgtagtcccagctacttgggaggctaagatgggaggatcacttgagcccgggagatagaggttgcagtgagcactccagcctgagcaacagagacagagcctgtctcaaaaaataaaaaataaaaaaagtgctgggtgggtggctcatgcctataatcccagcactttgagaggctgaggtggaggatcccttgagcccaggagtttgagaccagcctgagcaacaaagttagaactcatctcaaaaaaaaaaaaaaaaaaaaaggaactctttctggaaccttcactgagattctctcatcctgccttagccctctgctgatcttacctctccaatccagtctcaactttcatactgctcaccgcccccaccgctagtccccagcttgtgttatgggtattaactgcagaggcaaagaagaaaggaaatgcaaataacagaaaggcagcctctgtcctgtctgtgggctaccctccgctactgcctctgaactgaagagaggagagaaatggagaggaaggaagcaagaacaagcacatcaccatgtgcctcccctcccatcctcagtctctggtcttcctctctactgtccactcaccacactgttaatgctcagctttccagcctcacactgcctttcactgctatcctcccagcagcaaccccctcctgctgtctacccagaaagccctcactgctgtcctctccatttctctcttcccatactctaacttgccctacctcagctagccattaaacctgctccagaccatgcaagtttttaccttggtcatggcgcagtcaatatgctagtcaatctccaagaacaaatttgtcttcctttagaaaggtactgtttcctcaaagataaatcctatgccagagaggcacagggtaggggagtgctggtgagagataccataccgatgattatggcagcaagcacacaatgtagtagaaattagtggtgaaccttagctatgactcatgagttgttaattggaatgcaaagttcaaaagtgattctgaaattactggtttcaaaatttgcctaatgaaaattctcttcaccatataagaatcttgctcatttctacaaaatgcactccccttacccatccaaccttagtttcacttttctttggcttgcattttgtctcatttggcagctcacctcaatgttccctaatatacagtattagcataccatttctatgctagttaaaaatgtaagcttccattcaaaaaggtagggtgcagcctgagactccaagtttggactcatgttctttcaatgatgcagtgaagagacagtgacatataagagctagagtcacaaagatgtgcttttgcatatataaaataaagaagtgtgttaaatgaccttcagctcaaaaatctgatgttccattcagcaagcctggcaacctaatgatcttttctatcactgcaactataaaaaaattatttctgacttctaaataacagaattagaaatgagcctcagagcacataaatttaaatgttgaagaatgtcagtacagaaaaatgtcaactagatgaatttttttctttaggttatctgtcttctgtagagttttagtcttctaaacatgaatattaatttgaattaagaaaatcacttgtcatattaaagtacttcatagtatcattcaacatgactttgttcagtgcctggcagaggtaatgtttcttgcagttctatttttttcatgaaagattctacttcaatagtctcacgccactgatgcccagaggctgtggtctcagagacagcccctcgcactaaagaataatgcaggcccatttgaaatccccatagtcacctccaaatacatcaagcgcccatgattcactccatcttttgtttctgctgctgaaatacaaatgtgcgtctaacctttttctcctcgcttcttctttgttctatcaatatggtccttgagttgaatgcggacctgtcgctcattaggttggtctcgtataaatggatgcttcatcaattgttctgttgctggtcgctggctgtgattctttaccaagcagctctcaataaatgactggaatttttttgacctgccaaacaaaagaaatgaatccacagataaaacggcgatccaaagaaaagcaaatgtgtaatttctgaaatgctgggactttttctttttttaaggtccaattggctggcatagggatcatccactaatcagaaaacagttgtagcactatattaggcataatgggttcaaaggcatcatcatcatcaacgtgcaattgaggtagcagaaggtagttatgcacatgaaagcatttttgcacaatttatatgtaacattacatagcagaccaaaaggacgcagggaagaaaaagacccctatgggaatcacatctagaagggctattggaataaggaaaccatagctgggcctttaaaaattaggagaaaatcactctggggaaaggatagttcagatatgtaggatgacagtgaaaaactcaggctaggatgagaataatgtatgttgggggacactgaggtgagccacttaaataaggcagaagatgcaagctggaggaaagtaaaaccaaggttggataggtaacagggagtgcatttcgtagaaatgagcaagatttttatatgatgaagtgaactttgattaggcaaactttgtaaccagtagtttcagaatcacttttgaacgctgctttccaaggaataagaacatataagtatatgtgtacctttgtcgttaactcaaggacttagacatttaactttaaagaattaagttcacacccagatgcaaatttatcttcctctagaaaggcaatatttcctcaaagataaaccccacgccagagacctggcaggggagagctggcgagagataccatacctacgattatggcagtaaggccacaatgtggcagaaattaatggtggacttcagccgtgattcatgagttaagcacgcatgttcttgctgaaagttccaagaaattgttcagagtcatcaataattaagcttatgactctatagcatgcttttccaaggcactccaggagaccttgatgaaactcgggtcacccttcctgtcctgcccagagcaggaatgatctgttttgtgctctctgttgctctcctgtggtgcacaggggagatacaggagtggatcccaggactgagcctttgcccggcagtccctgcatacatactctccaggcctgagaggtgccctcaccacacagaacacaatggagagcatgttcttcaacactcaaacatgacagggcacttttgtatgcaccactctctagtgctgccctggtcaaagcagtttttcactttattccatgtttttaaagtactgaatcactggtattttttttttccgctctaaatttctaagctacattcaagcttttaaaatattttacctagaaataaaggtagcctactgtgcttggggttgccccaggatgaatcagcgttggccacactgtggactagaaatagtgacagcaggacactctgtgcacctccttgttaagtgcttccatgcatatccttgcttcttcccactgaaaatcatcagcagcatcaacgtgcctgagccatctttgcatcatgagcacactacctgagctgtgtgtttggtgcatgagtgaatgcgtgatgaaggttctggacaagagctgcaatatggccaccttcaagtctgcacttttgagggacagaaagggaggtttggagagcggatattcttctctttctcagatcaatcaaataaatctgtggaggcataaatatgatctcatctaagaagaaaccttgccagaaaaatgtaatgaaataaaggacactcctaaggaatgaattgaagagaatgaggctgacctgcatgaagatataaacaaactccatacagtacttttccaggtagaaaaatcagtattaaaaagatgaaaacaaaaattaagacagaaaggtatgaaatatttataaggaatataaatggcagttctctttttcttgctggcaactagaaggaagtgcttattttattatcattatttttttttttttagatggagtcttgctctgtcacccaggctggagtgcaatggcatgatctcagctcactgcaacctctgcctctcacgttcaagtgattctcctgcctcagcctcctgagtagctgggactacaggtgtatgacaccacacctggataatttttgtatttttagtagagacagggttttgccatgttgaccaggctggtctcaaactcctgacctcagatgattcgcctacctcagcctcccaaagtgctggtattacaggcatgggccaccgcacctgccagaagtgcttttttttataaagtactcaaccaactattaattagaggttgataaataaaagaaatcacattcaatttaaaagtaagatccagatttaatagactgtacagtctattccctgatattggcatctaaaataacagtcagagaaatctccagatctccagaatggaatagtgttcaagtttaatgaaattagttattaaacagagtactttttcccagtatgccttgctgggagaaaaaactcagagatattcaagagaataactttgggcctaaaagatgggcccacttgtgcagaactacaaagctggtaatatatttcatatcttcttcaagtggcaccctttgaagagaaaataatgtttacttaaaatgagtcttcaaagaaggattcgtagtgtcttaagttagcatgaccaaagaatcaatatgcttaattacacacttatttaagagtgaaaacacttcacctatgttgaatattacctcactgtttgctgagtgttctaatgagtttaaagtacatttatataactttattgcttgaatctctgctgatagtaatgtagttctgtctcttataaaataaaaacacctaaggttagtaaaactgatttcccaagggttggcatggagaaataaatggtaatgattggtacctacagtctgataatactagttctactatcagagtcactaaatactttatcttcccagattgaacctgtttatatgttaaattgtgttgggggaattcaaaatgctggaaagattgttacattagctattataatcagttgggttaaaagtttttggtaatcatcagactccctaaacgcaatttggcctaaaatttgcattggccctgccctatttccaaaagctaccctcttcctttactttgagttgcatcacttactaacttggacaaattacttaacttctatgtgtctcagtttccctggctgcattcaatggggatattattagtacttatctcaaaaaaagttatgataagtgaattaattcatgtaaaatattgagaacagtgcctggtatcataaatgccacatatgtgtttgctattatgatgatgatgactatgatgacattgcccccagcaatctctgagcatcattggacttaaggaacacagcatccgcctttaggacttaggagcagaaatccccacttctggccaggtgcggtagttcacacctataatcccagtgctttgggaggctgagatggatggattgcttgaggccaggagttcgagaccagcctgggcaatatagcaagacggtctctttataaacaatagaaaaaagtagctgagcatggtggcatgcacctgtagttctagccactggggaggctgaggtgggaggatcatttgagcccaggagtttgaggctgcagtgagctatgattgcaccactgtacactagcctgggtgacagaatgagactctgtctctaaaaaaaaagaaatcctcatttctgttgaactaagtaaacatagagttctttaagggaattatttcacgtatgggttaaatagcttagcaggaggagtcaactgggctgttatctccaagaagcctgcacaaacaggttaatttttaaagtctgtgtaatagtttttagctggattttaataaagtccaaagttcaaagtcacattactactagaatattcagtctagtagaaggaatttctgatacacacacacgaactttgtcctatctcaaaagtctgacaacccaccaagaatcagaactggtgcctcataaaataacgggggtgatttttagccttggagcaaaagcaggaggctgggtccaggctggttctcccagtaaggaggctagaactcgtgcaaatacaccacttagcctcactgggcctgcacacctgcatctgaagcatgagtggcttggaccagtggagcttgtacatataagcagttatgatttttctaatgacctcaactgagtgctgctttgcctgtgtgggctcttcaaatttaaagggcacatgaaagattcactgtcttatacttaatggagccattcctatccttctccagaaagtcctggagggaagcagtgacactgagtatacttgcgagggcaggtgagtgtggatgagcagggtggcaagagaaggtaggagaaaatcttttgaaggagatggtttacccctgcgagtggaatctacgcacgcacaagagacaggaagagagaatgggtatcccagtcttgcttttcacttgctggtgctgatatggaggtagagggtgagagtatctttggtttcctctgattccacaaaggttacaaccctcccagacaacttattattaaatggctgagctgcctgaacattcagtggtgccctaacttcatcatcccataccacaaaggcctctcctcatcataccaatagggaaggaagaactgggctcctgtgagtggtggtggtctcctttccctccacgatgacagtggaaagagcagtgccactgcctttatttctcaaatcttgaaggtacaagttaaaaaacaaaaaaaaagttcacactaagagaccagtttatgccttgtatgttgtagactcagtcatgttgaaaatgatgctttattgaatgtttgccatgagaagagttcatggccctgtctcaacaatggcgccccctttggtcaggtgttgatatatacactgagaacaaggcatttaacccggtaactcatttaggtagagaatagctggaaataaaagaatgttttggaattttgtctcttggtcgggggagggagtcttttcctcttaaataattaaaataaaaaacataaacaaaatgtttcatttcctctcaaacactagagtctattaaagtaaaccctaacttacttcaaatcactttggacctgcgctttcaagataaaatactctgaagtgtttaaatattttcacttaaaaactggtggaattgtattgcagagaaatgggagccatgtctgctgtcaagtatcatgtgcctggaggctgcaccaccacctctacaaaggctgggatcgaagtgtgaaatggcacattatcagggcttttgtttccccggtctctctctagcaatcaggttacttttcctttccctgtctgacaatatgggacttgttcccatagctttcctactcagttttccttacacatcagggaaaggtgtgcaaggtggcaggatgagatgaaattggcctggacttctcagtgtttccaaacttctcctgctccctccagcattattaaaattagttgttgtcaaaggtttgaagccgaaaaatcagactgcattgtcctaaaagtttgtatttctcaaacaaggtcagcacaccgttgatcttttttgggtctcagtcggtgaaaactgacactgtagggcaagggctgttcactcacttttctgtggggtcaggtaggtcacaaaaaggggtggtgtagaccatggttaagatgaaaacaggagatgtggccaggcgcggtggctcacgcctgtaatcccagcactttgggaggccgaggcgggcggatcatgaggtcaggagatcaagaccatcctggccaacacggtgaaaccctgtctctactaaaaaaaaaaaaaaaaatacaaaaaattagcagggcatggtggcgggcgcctgtagtcctagctactcaggagactgaggcaggagaatggcgtgaacccgggaggcagagcttgcagtgagccgagatcgtgccactgcactccagcctgggcgacagagcgagactccgtctcaaaaaaaaaaaaaaagaaaagaaaagaaaagaaaacaggagatgtatactaaccaactgacaccagcttctgagttggggggaggtggcagctggaggagaaggacaatcacttgtcctaaatgggagcagcagctagcatctttgcaggcagttcactgcatctttgcaagaaaaaggccagaaatctaaatgtaatgctcaattgacagatttttaagtgttgccaattaatacacatatttttaaaacagggtatatgaccatagtgtgacagccaaatacatttgtggagggccagtttgtcctcctctgtggaaaagctcagaatacgtgtcctgcagcagtaaagggagacaaggagaagatagggcagggaacagggtaagtaaagcccactgtatacaccagactcagctcagatatcaagcaggaacctagcagagggctttgtagtgtcactgtcacttccagggaagagaactgcgccagtccctctccccgggagtctgatccagggagaagagaggaagcagggtgttggggtgctttgccgatcacatgatgtatgacacccaatgggagggctgttgctggggagagaagggttgtcttgcaccacaatgaccctctgcagaggaaggaggagcagggaacgctctgcctccttgttaccaatagcaactctcactcccctcgcagggcccggcaattctgaggctgccatctcttttctggctgtttccttccctctttctgtgcagtgtgccctttcctctgttccaccagggtggctctcattagtagatgactggtggtaattaaggctgccccctgtatggtagaggtgagcctgtgtgtgggtgggtgggaaacatgaggaccccagtcaagcgcctgatcatgaagggctatggaaaggggcagaaggatcctgtccctcatggtctcactgcccaggacttatctctagaaaaaggataggaggtcacaaatagtgcaggaattgacctcagaccatgagtaatccgagattcaagaatgtatcagggaggatacaccatttccataggaagaaaggaggaagcaatgaattttggttatggaataataagataggaagatcccaactatataattatccccaaaaagtcaaacatccaacatctggcttaacctgtagaactgtttcccaaatgtcagtcagtcatatcctatcaacataatttttgccgtaccctcacaccactcatactagtattcatgtagtagtttcctttaaattaagccactgttttatgtaagtttatcaaaaggaaaagttaaatcgctgccccaaataagaagccagtatcacctgccatatgtgaaaacagtagtaaaaacaaaaaaactgcaaatgctcatacacgagccagagaaataatctcaaacattacctggtatgtatatgcacttagggaatgattgttgtaaggaatagaagagaaatcagccaatctaacaggctgactctctaaactatcaccctctctgataagctgttctgtgctgccaggaaagatatgacttggagttatagatcaaagagctttcatgttattacttggcttcacttacccattttggctaataatttcttaccttaaaggtgggggaataaagacctgctgtacaaacagtagatactcaatatatactttaagatgaatgacagcatatggaaagtaattcaccaagtcatcatacatgttagtctcattctatcagcaggacctagggattagagctaatccaaaatagaatcacaagaaaacctcacccttagatctgcgaaacatcgaagaccaaactcaccacttcttagacttcagccgaggcgctgggttccgggggatgaggaagagagctctcatggggtgcatgtcacagagagctgcaagagaccaaaacaagggccagctacagttaggaggccaaacccaggccaagcccgtcttggctgtgcagataatggctgcccaatgacccactcagtttacacaccaccagtgagcacaaagtcagaatatccaaatgcttctgagcatttgaaagatccaatatccacttacaggagtctcataaaatacaacatggttcacatagctactgctaacatttctagtgaatacatgtttacttcatatttaaggaaactaagttaaagggtcaacaaccagccatccttgctgtgaatgaccacctgacatttaaagtaaataccatcagatgacaactacaatggagatggtaagctatttttaattagtaaaagcctaagccataaataaaaggcatttcattatcccgtctatttcttacacgtcgacagctcatccaaatgcaattgttatctacacagatttttggagtccaaaacaccagccccagagccccattttctctgtttccagatatcccgaatggcttttcaggtttcgtaacgggttttgtttcattttgtttttaaattcactggccccaggaagcccagaggattaagtcacacagagtctggcagaaaaacaaagttataaaaagatctcatcttgtaaacatgacattatcgtttatagtgaaagcactcatatgttcttattttaataaaatattttattagtttacttttcaaacatctgggagaatttctactttgtagctagaataagaatatatgctccctaaaagccaaaggattctgtgggcagaagtttatttttagccctgtctaccactcatcaagaatgataatatggtttaagactgcaatatattatttttctgattcacacatgcctattagcattgtgaatgagggcaattttgtcaaccagcactccaaatcaatcatgctacagatgagttctaccaattctagactgggaagtaagaaaacgatgacaacccgaaggtaaaagtcataagtataatgacctgtcgtgcaaataaagggcctatttttgtcctagtcctttgagatgcagacaccaaggatattactgggtaaattactatgtgaatggaaacagggaaggagccaggcagtatgggaagtcatcagattgctatgcaagtctgaccctgagtgaaggagagagggagaaaaggtaggtggaagggtcccagcctgtcctgcaggtcttgtaaagtcataggggattacttgggtgaaagttgcctacaaaggaatcttgtgtcctccaggaaagggcctgccttagtatccccactgtgctaggtcactggcggggagtggcccttgaaaggtgcggcctgctgccattgcagcagctggggctgacaatcagttacacttcctatatggaagtctgtgaggcacagtctcatgacagagactctctgctggggccaatactccaaatctcaaggaactgagattctcaagactgctggagccctagccactctgtctcaaatagcagggaaatctaaaattttaaacatcagtattttaagaggagtgatagccattgagtggagtctttgtataacctgtgcactgaaaattaattttggattttcatacattggagtttatagtcttgtgagttggtcacagttttatgtcaggtgaggagtagtccaagaataaatgatgtacagaatctgtaaaacaaacaagactccccaaagtatgctttctttttcttccttttttttttttctaataaaaacaggattctcccactgctctgaaatgaatggattcctggttgatttaagatgactctgctttctaaatatgccagcttgaatccatgcagggctcggtgtagtggaagtaaagcaactgcagctcctggcaaggaaacttcagtacctgcagagcagaccagcaacagatttcaccccagaggagggtacttacggggagcaccttctgccatttcaatggcggtgatacccaaagaccacaagtcactctgaaaaagaaggggcagacacacacataaattcagtcaacaaaggacaacttggttaaacctggtaattgcttcagaacttcctgtgaaagtcattcagttttctgtttacaaacctatttcttccactaaccttcaaagcagaaacagtcttacttttcattgacagtaccactcatggtgtctggcacatggcagcttatcaataaatgtatgaaaaatgaatataaacaattttaaattaattcgttactgaaacttatctgtgggttgaaccataggaaattgctgctatttgactgtttataacaccatcattgagctataattgtcatataataaactgtacctaaagtacaccatttgataaggtatgacgtagggatcctcctgtgaacacatcatcacagtcaaaacagtaaacatacccatcatcccccaaagatctcatttgcctccttcctttcctgcctgaacccatccccactctcctgtccctaggcaaccaatgatctgctttctgtcactatgaattagtttgtaacttccaaagttttgtataagtgaaatcacatcatatgtggtcttatgtattcgatctgtttcacgtagaatagtgtttctgaagtccacccatgttgtagtacatatcagtatctcactcctttttattgttgtgtagtattccattctatggacatatcactgtttttgcatttggactgtttctagtttgggctattacagatacaggtgctgcaaacattggtgtacaaatccgagggtgtatgcttttatttcttttagttaaatacctgagagtggaatggctggatcagatagtaggtgttatttatattcaattggtttaactagaaaaacagcaatttcatatggttttacctaataagatgaggacagggagactttttgatgatggcattcactgatgtctctcttgtgcttagatcagagttgggcacagtaggaggtactcaaagtatttgttgaaaagataaacaattattgcctattttgtgagtagactagtatgtaacaatagaggccagtatacctttatattatttcttatgctcagagtgacttttattctctgaacagaattttctaggctaatgcctccatttctacctgtacaatctccatctctaacaatattctcctcccatactctgtctgtggctcagtagtctctaaatattgcatgagagggggaatatcaagagatggggaaaacctggttagaaaacaccaagaagaggcttgctgcctcagtttcacagcagattggtaagaaaatctagtatcaaatttggttcaatggcccacatcctaatatagatatttcattttaaatacctcatgcattttgtacatttttcaaaattgtctcagattagagtgatcaaaggtaagtttccttgctattgccatcaaacaaatgtcaaggccacatgaaaaagagatgtaactggaagagagcttcataaaattcataaccttcatgctgagtcactccccagaactaagtttctcaatatcctgtgaaatgacactcagggctcttcagtaattgggcagaggtctgcacaatgtggagggggttttctagggggtctagcctcttgcctaaagtgcagtctacctgagagcaggtggctggggcacatgtgtaacctcacactaggagcaagggggattctttcaatgttaccagttctcagttcaactgggaatagcaatgcaccttcacaacaccatcattctaagactccaaggaactctctgcatacaacacaactcacaaagtcaactcttgtcccttctctttgttatgtttcaagatgtacacaaagattttcattaaacgcaatctgcaccccgtgtttctctggcctagcaagtgactgagtctcccagaggctcttggcctcgcttagtgaggttatttccggagctgatggggatggctcaacccatctattacaagttggctcaggagcaataactggtaaagacaaaaacgcagttctattgtacctgggttttttgttttttttttttctttgagacggagtctcgctctgtcgcccaggctggagtgcagtggtgcaatcttggctcactgcaagctccgcctcctgggttcacgccattctcctgcctcagcctcccgagtagctgggactacaggtgcctgccaccatgcccggctaattttttgtgtttttagtagagacgggtttcacagtgttagtcaggatggtcttgatctcctgacctcgtgatccacctgcctcagcctcccaaagtgctgggattacaggcatgagccaccgtgcccggcctgtacctggggttttatggttgatagacaaagataatcatttcggaacatgagagaaacactgaatcatttgctgttcaggaggctttaaacaggaaacacagcaataatagtctggaaatggtgggttggctcttaaggtccctgtgctattttgataagactctagtatctccagaccttggtagttctaccaccattttacccaaatccctaggaactgagagtttctatagcgtgaaataagacacaagtaagaaggtggcagccaggctctatggccctaactgcaacagaagggtccaatttaaatggctttcaagtccagaaagctttgagctgggttgaaaaccaatacatgtgaaagaaaatgatggttctggggtaagaagaactcaaggccaggcctcaggtcaggaagaaggaaaatgctcgaaggcccagcctttggatcttgactcaagctgttacctcttcctgcagcacctcagcagtgatgtgctagctgactccctcacctccccaaagcctgctcaacccctgtgttctcaacgaggacccctgggacctccccccagcactgctcatgccccttccccatatttgtcccccacagaactaaccacctctaacatacgacatgtttattcatcactaatttaccatgttttgtgttgattgcttgtgccctttacctctaacacacatacataagaacctaagagccacagggcaaggatctttgttctgttgtctgatgtatccaaagtacctagaactgctcctggcacacagtaggcccttaataaatatttattgaatgaatgaacaaatgaaagatacatgagagaacgtagcaaaacctaagtgttctagggctagtagactctttgcagatcacctagccaaacctttcacttcacaaatgagggaacatgacttacccaagatcaaagagcaacttagcagctggttttaaactgagctgggtcttctgcttcctaggccagttctcttttaactagcatcacaatctaaggacttgagtattcaccatttttccccttatcatttttgttatcaaaatgcatttttaatccataaaataattacttcagattcctactttgtccataggtgactgaaggtgctggcaactcaataaaggtactgagattcagtgaggtactccagtttcatgctataaaactcgcctcaatttcccaatggcaacatggattggtagaaagaaagaaacaggtattgattgattgattgagatgaggtttcactatgtggctcaggctggtcttgaactcctgggctcaagcaatcctcccacctcgggttctcaaagtgttgggattatgggcatgagccactacacccagctgagaataggcttttaagacaggcagatccgaattcaaatagaggtttccaatttagctacatgcagactgttgctcagagcttagctttctcaattgcacaatggaaataaccgtggcatgcatgtattgatcaggtatgctgctagcacaaaatctggcacagagtagggctcaagaatattgatttccttcttctccactgtcaggtgacactgcctttgcctgcccaacttagtcttctatgatttcccttcatttagttgtggcagaaattgtttattggctaacccaatggtcattttcaaccctcatttttgttgctgcttccatttcagagtatagcaaagccacacttgcctatcctgactccccgacagctaaggatggcagttagggatgtgacatagttttctccaatgagacataagcaaacatcttctgggagcttctgcttttcctgaaataagggacaaatatagctagtgtcttgctaactttttcccacttcttagtgccttgaataaaaatatgatatctggagctacagcatccatcttgcaaccatgagttattgccaacagactaatgatgccagcacagaaagctaggagcttcggtttctgaaggtatcagtgaagcatcacatgaaccctgaactgcctacctctagatttctggtgacataagaaacgtaagtacagacaaaagcattcctaagtgataatacacatacagcagtaatttgaagaacatactttgacagtaaggaaatggagaggtctcatttgttaggtaatcctggatttattccacaggaagcaagaaggtttagggaaaaaatatgtactttatttagtacacatcacctcagaatccctcttgggcagcctttccctaagccaccagaacacccctttcaaaccaaaggtcatatcaccacaaatacctgtgcatactctgctaagtcacatgacctagtcaattctgctgcttccttaagccttcatttgatatcattgttaggattttttttttttttttttttttttttttggctggggttctcttgttttccaaaaggaacatttatattcctggtcatatatatccaaagttgcttgtaagctacactcaactgcccatgctagaaagccataaatgtccttgacaggccttgtttagccgttggatacattagcgagtcccaaagacacttcagaacttaagtaaaggagaaaatgctccaattaccactggcaagacagatcacaggagacaagcaagggaagatggaagaacaagatgaggaaagagtcagaaagagataagtttcgttcatggccatggtgtgactcattttggcagaagctggataattcattattccagaggtgttgtgcagcctagcctgtggcatgattaataccctagcgctatgtgcattacaaacagaagagagacaaattctagtgcctttgggaaggcagaggcaagacagaacttttggctgctggaaagggtgggagtggggaacagctgatacacaagcaacttgaacagaacaagaaagcattccttctggggctgggctgctcaacacagtgaagaaaagcaacacgtttagatgtctgaaccagccacagaagaatgagaggctgtgtggcacaagacaagaaccccaatgtgcaccatgaggtagaaggtgcctatggtctgcagccagacccaactgtgacacaactaacaactctgagcccatgaaaagaactgcaacaggaaaagaacacatgtcttgcaggactggtaagagaattcaataaggaagaatatgcaaaaagtgcctaatatacaatgcagtacatgctgcattgggtattcaacgaatgtgggtacagatagacccttaggaccagatatcatcaactggcagttcaaccagcaaaccagagtcaggtaagatgacagggagctctggtactcagtggtggtcaaagaggtcacagggaccatgcaggcataaacaagaagcttacaggaagcaaacaggaaaacgtgtgtcctccttcctcctccagacttgatctcccgttctctattgctccctgctggcagagcctgataagaagtcagatggacaaacagaagggaggacagctgactcctagctccattatcacaaagcagagagcagcacggcagtccacagttgacagacaatagcttaataatgggcacagccagcatactgtatcacagagcagaaaatcgtcttttgttgggtaacttatttgtgactagtttattcttttgaaatgttccaggtgggaaaaagaaattgatgcattgtgtgtatggtccctagggacaacatcttaattgagtggtaaaagttatagagaagcagattctggctcaacgtaagcagacagaggtgtgtaacacaaatatgaggttgaaccgtatgaaactgttgccttttaggggtaaaaaatggcccccaccgggtccagtggctcacgcttgtaatcccagcactttgggaggccaaggtgggcagatcacgaggtcaggagatcaagaccagcctggccaacacagtgaaaccctgtctctactaaaaacacaaaaattcactgggcgtggtggcgggcgcctgtaatcccagctactcaggaggctgaggcaggagaatcgcttgaacccaggaggcagaggttgcagtgagccgagatcgtgccactgcattccagtctaggtgacaagaggtagactccgtcttaaaaaaaaaaaaaaaaaaaaaaggccccaaatagcaatacttccatatgataacataaacacaaaactatctataatatatatactaagtactatatattgagtacttaccaagtggtggacactgtattaatccctttatatatattctcactttattctattataacctccgaataaacaatttattattcccattttatgcaggtttacaaaaagttaaataactcccctgagttaatttgcaaataggaggcaaagtctaaactggtcctgtctgacttcaaaggactgactcttattaattatgttatatatttatatattatgttatctagatacagaacttaggtggtgagttagggtcactgaagtggagatagttattaataatcccatttcacacataaaacaaactgaggacagaaatctttagttttttgtccattttcacttgttatgtgaccaaagggaaaatattagaatagctcactctcttcccctgggtatcagcatgttgcgtggaggaggtactggctgcgtttcactaaggaatcctttataggtgggtgtgaacagagagccacagaaatatgttgaataggagtttcagtttcctgttggtgacactaacatgctatctgggtcatcttccttctgatcgaatagggaaggacctttgtttgaatctcagtagacagaggccacgacttgtttgagagtgtaaatgcatcattctgcaatctgaatattgtcctctcaggtgacaccctgcacggcggaaactctaccactagttaggttgctcacttcatttccaactgaaactcttacttagaagaagtatttccaccctgcctgaataatgccaattatctgtgacacaggggaaaagagtactttttctctacaaccagagcacaatattcacccaaacgctggaggagacacccatgtctgcaaataatctgcagcacccatatgaaagtctcataaacagagtttaggcaaataataaacaacattggcacagatcaggcctgaggacaggaatctggtggggagtgggataagggggtaagccatttcactgtgcatctcttacttcattggcttcatataagagcaaggcctgtttatggcaaaaaacataacaggacagaaagatatagaaaataaaaattgtaagttttccatccacatgccctattcaaaagtaaatactattaagtttttccaggttctttatagatttcccgtgtgtgtgtgtgtgtgtgtgtgtgtgtgtgtgtgtgtctatggggtgggaggggtgaataagactacattatgtgtactatactgtggcattcagccacagaaatttcttagtgggtggttctgttaaagtaataaatacacaggactataaaatgcttagcagatcccatccaaccaaaatgaaattcaaagtaggttaaaaaaataacaatttaaacagcctaggcattttgaacagttttattaatttcaaatcttttgaatgcttattattaaacgggaaagctttcattattgccccacatacttatcagggaaatgaaacctttcctttcacttgaagtgttttgacagaatttctgaaaacaagaaaggaagggcctccaggggaaagccagcacacccggcaaatgagattctggcactcctccttaggagagggtctattttcagtgagttacttactgtgcccagtagatatcacacaaaaccagactctgcaataaaaagctacagaagaccttatacgttgagttactttaggttttgtaaaaagttatagtggtctttaaagacatcttagacacatcaaaaaataattgataaacaataaatcaaataacaaaactaagctatactctttttctttttcttcttgtctttattttacagaaaggacttttgtggtaagaaatctaataaagtccggtggccaagtcatcctttattctaaatacacactctcggctgaaagtggctatagcacatgagggcccaaagtgttgacatcaagcttctggggctgggatacaccactgggccaagtggaccaccaaacacacagtgaaatcctcgggctttgatggggtctcaaatgaaccttctatcagaaactgcatgtacagatacagcttgactaactccttatacacaatggatagtctataaatatgcactgagtgaatgaataaatgattttgaaagtcagcatattgtcaagttgtcccctggtgacaggttacattcctaaggatactgaacagaaaaggggatgatatatggtgccaagaaagaagtagtaaggttatttaaagatcagcatcttctctggcccacagtaaaactgtataagtggattaaataaatctgcaaagaatccccaaaccttccactataccccaacagggtatggcttggttttgttatttattatttactatttgatttgtctaagatgtctttgaagaccactatgaatttttttaaaaacctaaaataattcaatattataaagtcctctgtagaaaagtcttccttattcattcttttgtcatcctcctctttttacccatggcatataaccagtgaagctcatatccctgccatgactttttcctcctcttgcacaacctacattcctgacaatcctgttaaactaatttgcactaaggtctaaatgactgacaccattgaacctattctatcaggattctttattttttaaaaaaacacacagacattcatcttcaatctttttaatgtctcaggatacttttatagccaggtgagccttccagtacctctgaaatcactgtgcagcatgacgacctctgtggctactcatacaacaggatttgcccatacctagagttatgcactggtctcacaccatttacagtgatcttaaactatactccttagccataatctgaggaaagaggaccaaaatatcagtttaattccaagctttggcttggccagaaggaaagcctcttctagataccctactgaaaacaagtcagttgtaggcacccactttatttacataacaaaagtcccatatatagtgcagtcagtcacaatacttaaaagattaagctgaggttgtaagagctgcaaacgctgtttccccatgctatgttacatagtaatctagaatatctgtggcccagatgtagactagttagcacttgttaggtataactatggtttgaagaattgcttgtagctaatcatgatacccatatctggcctgggatgtatattttgtagtggcttctctgaagggatttgcaaacagaattatttaaatatgcttatcattagcagtttaaaaaaatgacattttggcaggagattaatttttaacttggcagctgttttcagacagattgttgtcaggttattacagtgactaactttgaaggaaggaggaaatttatgggagattattaggttttcagaccttcaagcttgcaattcccaaaagaggcaaattttctgtcaacactgagatacggggcctcaaaaacgctgcaatgtttgcatctttgagacctgatttcaataataaccccacatgtcgagaactaaaaatattccttaaaagtgaaatattcttcaaatatactgttcaattgataaattggagatttatatggaagtacattacagaggagcaaggtaatatattggaaagggctctgaacagaaagtttggagacctgcattcaagtgctaactctgagaggattgctaacccggtgagcacctgcagacctcggcctcagtttcttcatctgttagataagagtatttacagaggatcattaaagtgttttggtgaaaagtccatgcacctctgaaaccagcccaagcagatcaagttttgcccaagttgtcctgtaatgtacacaaagaccacagggtgtctctctacctaatgcacagcctggaaacccacacacagttcctagatcccattgcccctaattttattgccttgactttcagtcaccattcattagaaagccgtgtcacctgaaagtccagacaataaacctgaggggcaataatgcaaaattatgtttggttattggctagcagaatagaaaagagaagggcttcttggagaaatctatttgaacacagctttgaatgtattagcaaatttctagtttataatataaagtaacaagtcacaaatcaaatttctatgaaacatcaggccacacgacagaaataccataaagtagtcaccaatattccatctgattccctctcatgaaaaagaaaccccagataattatacttcgagcattgtagaagtaagtcagattattctcaatcagaaaaagatgacccaagacaacaaactcacatcttagtttaacgtaaaaagctatcagaatatatactcttccaaaaatctaaaccataaccaaaatggaaatccaatctattttccaataataagaagcaagagtaaatttaaaaaaatatagaaaatgatttaaactttttatttatttttttattttttacaaacaggccatcagataagatgggtgaattcattaaaaagatcctcacttgaatgtcttacaggtcttaaactcaaataatgtttttcagttctccctttgggtgacataaatcataaatataagggcatgtaagactttataagactcaggataagatggtaggcatagttttgaaacacgacaaagaagccataccttgaaatcatatgtggcatctgggttttcatcacaggcaataacttctggtgccatccagtagggagttccaatgaaagtattcctcctgcccactgttcgatcaagctgagcactgactccaaagtccactatttaagaaaagacaagtaaataaagtctgtgatcataggttttagatagcgataaaatgaatgtgaattattttattgtggtaaaacataagtaacataaagtgtacaattttgaccattttcaaatgtacatttctggggcactaagcacatccacactgttgtgcaaccttcaccactgtccatctccagaatttctcatcttccccagctgaaactttgtacctattaaacaatagctcccaattcccccttgccccaacccctggcaattattctactttccatctctataaatttgactattctcactaccttgtataagtggaatcatacagtatttgtctttttgtgactggcttatttcagttagcataatatcatcaaggttcatccacgttgcagcatgtgttagaatttccttccttctcaaggttgaataatattccattgtgtgtatggaccacattttgtttatctgttcacctgttgatgggcacctgggttgcttctaccttttctatattgtgaatatgtttttaaactgcatgagaaatggatgaagtgtacccatgaggaaggcacaaagaattacatttgattacaccaaggcttcacagggaccaaaaataggtgttaaaaaaaagtaagcttggttgtcagaaagggtagtattttggggatacaagacaagtgattaaaagcaaaagtctgagtcagactgcctaagtttgtatctcatttctgccgctactagtggtatgacctagggctagtagatcaacctctctgagcttcggtttcctaatctgtaaaatgaggatgatgacatctacacagagttgctctgatgtttatgagagataatctatagaaaattgtcttgtacagggcctggcatataatatatactcaacaagtaactgttaattagtgaagtaagaatgctctcaggatagcttatctagttgatacatatataactgcttagcctacataatgtatacttttgtttttaaaagagaatattcatgaggtgagaaagtttggtcccaaatgttaactaagaaaaaaaatggaagtcatatatttcaacaaaaaggaagagcaaatgtttgggatataaacatagaagatgtttaaatctctttgaaaatatacaatcatatggacagcgattcttttctagatgacaagttacatatcctactggatatttgtcaattcatgctcttactcatatacatcaagcagtcaaatgcatgtggtaattctctatttgggcagtcccagatttgttgcggaaagagctctaacagatacgccaaagagaaggattctcccactgatggaagtgggggtaatcagtatgcacctaaagtagaatattaagtatccactttgcacgggagcccaaggtaataacaaaatcaatgtaaatataacttaaacctatgggaatatagcaggaattgattattctgaatatgcctgtgtatattttaatggaaaaaaattgggtcctagtgctctgttatagcagcaacagtataaacaaactgtaagatataggaggccatttcaaagtttgtcacttctaatctctgctgaaacaaaaaaatctcaattatttctatatattgattaagcaagtggttctgttcccacattatatataattcattcctcagaatgccttgagaaaatattttttaaaataggcaaagaaacattttcctttccatttttagggcaatgctctccaaatccacggtgacaaattaacattaatttttttagagctgttaatataatctcatcacttcctgcaattccaaggctcacaggattctgctcttacctagtttaacttctgcattttcagtcagcaagacattttgccctttaatatctcgatgaatcactttatgctggtgcaggtgactcagcccctggagtgatggagagttaagaagggttaataggaacataagccaagatgccaataaattattttgactgttaaggatccaaaaactttacactcacccagacatacttttcagaattataatcacatctttcatgtgctcatagtgctcttctaactgtaggcaattcatcaatataaattaaagtacccaggcagtccttgcaatgcatggtgctgtgtttaatgaaatgcttgcatattggatctgattatcaggtatcagggaaccacacaagtaattatacggttccaacatgaacatgagtttcagttaatactactgtgaaaagcgaagtttaaacagtttaaaatagaaccatctacacagtctctgtacagaaaactaacctgatttaactgaatccctgcaggatatttgaatttaaaagttaaaatttacattctgttatccaatttcattgaatgattgattgactgagacagagccttactctgtcgcccaggctggagtgcaatggcgtggtctgggctcactgcaacctctgtgtcttggattcaagcgactgcctcagcctccagagtagctgggattacaggtgcctgccaccacgccaggctaatttattttagtacagacagggtttcaccatgttggccaggctggtcttgaactcctgacctcaggtgatccattcacttcggcctcccaaagtgctgggaatccaggtgtgagccacagcacccggccttgttatacaattttaattaagcgaagtaaaatatttctcagaccagccaagaaatttcccattggctttacccattgtgccttacatttaaaaaggaatacagtttctatttcttttgttggcattcatcactgtcatttttagtttatgctagtttatgctatttgtgactttgtgctcattatgtgagaattattcagtgacaactaaacctgtttgtgttccatttcttcatgaattactctgtttttggcttctttgtggtgtgaattctttaacctacagacttactctaaagtagtcatatatttttcagataaattataatctaaaataatctaaaaatggagtcttaaagcaaattattttatgctaacacctgataattcaatgtatcgggtccccgagtgttctttattacctttaattttttgtgcttttcatcttctccacaacaacaaaatcatggtatgaaaaatgaggttgacaggaaaagaaacaaacctagatatctgaattctcttgtcaaagaaattcagcatgagagtacagaggtccaaaaagacccacatatacatttagagatatcagaaaacataaaccatgttatagaagggtttgaggcactggtttaggtcttaaaaaattgcctttcttatctgttcagtttgtcacagggtaggcatcaggggtttaaatgtgtggttttcacaaaatttatgtaccccataaatccttaagagagggactgaagatccctttccctctttcactactgaagtggttgaaagcagataccagagcatggaagtgagccaaaagttcttttaatgagatcatacaatgcatggaggtcacctccaaaacctcttgtggccagagacctttgggtgatcaaatgtctcttccagtgagtcatgtctgaaatgctggtatcatttcggagaatatactggaaaaaggaggaaagccattgtttccacacattgagaatgtgtgaaaggtattgagagatgctcatgtgatgaaacatccctgctgcttttagaaccatgaagattagatcaaatgactgatcctctgtagggttccccagcagtgcagaaaggcatattgggcagaaccagccctagagacctgacaggttcttggcagccactgagtggtcaggatgactaaataatccattatgctctatctgaatgagcaaaattttaagtcagaaattcaaagtaagtttgcacaatggcacatcaaaacagagataaacgtcagatgtgaaggaaatcagcagccaggcctccttgtttcccctcaaattttgtgttatgttctgtttaagaacacaaaacatataatttatatttttgcctatcccaagccatggatgtatgtgttttttcttaagtgctttaatttttatatttttcccatttatatctataacccagctggaataaatttttgaatatggtatgtagcaggtgtcaggtttcatgttttcttatggatattcaattgatcaagtactatttactgataaaagaaccctttcctttgacacagaccaggtatcatccatatgatgtgggtctgttcctggacccttgattctgttcctttggccattgtctaatcttgtaacaatactactctgtcttaatttattagtagctttataataaatcctgataactggtagcataaattctccagctttgctcttcttcttcaagattgccttggttattcttggccctttgcatttctatataatgtttgaaaatcagctttataaatttccacaaatatacctataggaattttaattggaagttcaatgaaaccatggatcaaactgggtagaaatgatgtctttagaatattgggtaatctgtgaaataatgtacacctccatttattaaggtcttctttaatatttctcagtgatattttgtagttttcaggatagaagtcattcacatcaatgttataattttaaaattccattttctatttgccttttgcctaatttggtttgcatttaatgaacagacatcgtcttcttatgccttccttcttttttaacttctatccatttcatccatccacccaaagcatacaatctatctctcaaaggcatatcttgaacacacagtaaaaaagttttaacttttgttgccttaaattaagaaggcagagcttataaataaataacaatggccaggaagatttaataagaatgctcagtagacatataataacctccatattagtaggaagggatgattaagctagtctgaatgaactaaaatatgcccagttactttcttcttcctgaactcagctcagcaaatatgatactattgtctagatttcctgattgggggatgtgtgggaaaactgggcaaacaggcagtcttgttcagctattttgattagtttaagtgattaggtcacaaagattttttttaaaggtaaaatcggttaaactaggttgtatgtataggaatgactaaagtcacacaatccttataaactttatatggtgggaaggtattacaccattagggataatatattaattgtgaactttcacaaacagataacttaaatgagtgattaaaatatctcataaaataattcatttcctaagtggaacactgtctttatgatctaaaatcaggtttctaattggaaacagcattgaaaatgaatcccttgttaagagaaatcacccaatgtcaacctaaatgaaaatatgctcatggcctatctccagaatggcgctcacttccatcagagcagaccttcacaccaaactaccactaccaccaccaccaccactgataggataaacttttaaagggtttttgatatgcttatgaatttcactagaaagtcagaaaaaaattcaatccctcataagatatcatgtgttgcttgaagactttgggaggtgggccagtccccactcgtaacctacccgtaagatttccctgcagatgtatgcaatccactcctctttcaacgtgttaccttttgtgttcttgatcaggtcggtgacagagccagcaccacaaaactccatcaccaactggcaaaggaagcaaacaagccattattttaatgatgcttcactgcttccattaagttggggtaagaaagcacaagcaattggctgctttggaatgccattcctgcaaagaaaaagttatcataaaacaatatataaaacacaagcttttaccttcatgtactcccaaaatgatataaaggaaacattatttttaaatttttcaacctgtaagttatatttgaaaattgaggaaactctccatattctaagtatttttttttaatgggagtaggtaggtgactcagacaaaattgagaatatctctgttttaactcagcagtcaaattttcacataaaagtaggattattcccctatcagaaagaactgtggttctctaggtgtcccaacttagggttacaaaagtgcacactgtttatgttactggtttgtaagtggcactgtaagctgtcagtgtgggaactatctgtttttaattaacttcagcgaatgttcccaggaggttggacacatcaaataaattcaataaacaataaactctaatttagcacctttcatgcaaaagctccaagcactctataaatataaactcattacactacttagcaacttataaaataggcagaaaataaacatcacccttactcaatggggatgtagagaccatttgagaaaaaagccatctatgtgcttttacatgcattttctaggcttagaaaaacacatccatttccagacttttaccttcaaaaatatcttcaacaaagatcaccttattaggtacttatatattttttataattatatgaaaagaattcagaataactagcaatcaattcctgacttagtagtagagacagaactaaaatggagccacaataaaaccacattgatggctttggctttgtccaaatctacattcctgatatcagcactatgtttccaggtcctaaaagatacctcatcaggctccaaaatcttcaggcagaaattatattttctttttctttgtatacctaatagaaactaaataaaatctcatgaaactcatttcatgagtgagtttccaaagcctgttctgacttgtcttcttatgattccacaacggctagggaaaccttcccaccttctccaagaagccaaggaagtttcaagacctataagtgcttatagggaaatttgggaagtgccacaagtagactacattccaaccagataaaagttgggaaattacaatatgtaatagcccagaaactatcaaagaccacaaaatcatgtcaaaaaggattcaatttcaagagactcccagtggtgaaagatgggataatctgagcatagataagaataatagctgtaatgtgtagaaacactttaaatgtgcttaattaaatgccttaacaaggtcatcccccaccacccaaagaatatgactggcactgttagaaaaaaataacaaactaactaagagctgacaaataaaaggaaagactgaagagtctatactgcctttttaatacaaatcttaccactgggtagttgaataataaaagagggaaagtttctgttcataaaaaagtaggtattccatctaataaatgaagaagacatagtagaagaatgccaccattttgtgcctcctaataagctagcagactcaggcagtgatcatcaatgactgttaacattttaaaaagtaaatagaaaaaaataaataaataaaaaagtaaatagaatttgccttttggtataagaacgcatattacctaggaagtagtactgccaaaaataaaaacagaaatctgaacctgatcaggcctctagctccagccactgatttacaggaaattcagaggactgaggaacatgtaacatcatgaggatacaatcaacaaaatctagaccaggatactagtcaagacaaagagttttttcaacacataaattgcaagggagaaaaaaagagacgcaaagaaaacttatagatttaaaaacacttagatacaccaacaaattgcaatgggtgcaccttatttagatattaatttttttaaaaaaagatatacacattttgagataattacaattctgaatacggacttagatatttgatgatactcaagaaatctggttaattttttttttgtttgagacagagtctcactgtgtcacccaggctggcgcgatctcggctcactgcaagctccacctcttgggttcacaccattctcctgcctcagcctctcgagtagctgggactacaggcacccgccatcacgcccggctaatttttttgtatttttagtagacacggggtttcaccatgttagccgggatggtctcgatctcctgactttgtgatccgcccgcctcggcctcccaaagtgttgggattacaggcgttgagccaccacacctggccagtattttaaaagtgtaataatggtactgtagttttgtaaaaagaagttcttatcttttagagaaaaatgctgaaatacttatggataaaattatatgacagtttcttctacaaatagtgctgagacaactggatattcacatgcaaaaaaatgatgttaaacctttacctcacaccctatacaaaaatattaactcaaaatggatcaaagacctaaatataagagctaacactatcaaactttcaggagaaaccataggggtaactctccttgaccttagatttagcaatggcttcttagatatgacaacaaatgcacaagcaccaaaataaaaaaaaaagaaaaaattaattttatcaaaattataagcatttgtgaatgaaaggacactatcaagactgtgaaaagacagcccacagaatgggaaaagtatttgcaaatcatatatctgataaaggtctactatccagaatatataaagaactcttacaactcaataacagaaagacaagcaacccaatttaaaaatgggcaaaggacttgaatagacattcctccaaagaagatatacaaatggctaacaatgacatgtagaaaggcttgatgtcattagtcattaggaaaatacaaaccaaaaccacaatgagatatcactttacatctactaggatggatgttaatttaagaagaaaaaaggcagaaaatcacaagtattggtgaggatgtggggaaactggaacctctatacattgctaatggtaatgtaaaatggtatagttactgcggtgaacagttaatgggttcctcaataagttacacacagaattgacacatgactcagcaattccacttctagaagtatactcaaaagaattgaaaacaggtgttcaaacaaaaacttgtacatgagtgttcaaagtagcactattcacaatagacaaaaagcagaaaaaaacaaaatgtctatcaacagaagaacaggtacacaaaatgtgggatatccatacaataaaatattattcagccatggaaaggaatgaaatactgatgcatgatatgtggatgaatcacgtaaaacattatgctaagtaaaagagaagccagactgaggcaggagaatggcttgaacccaggaggcggagcttgcagtgagccgagattgcaccactgtgctccagcctgggtgacagagccagactccgtctcaaaaaaaaaaaaagagaagccagacaaaaaaggccatatattgtatgattccatttacatgaaatatccaaaataggcaatccatagagacagaagcagactagtggatgccagggactgggtgtagggggtaacaggaatgactacttaatgggtacacagtgttctttcggggtgatggaaatgttctggcactagatactcatgatggttgcataacattgtgactatatttaatgataatgagttatacattctaaagtagttaaaatttaggtaaattttatgtttatgttaccaaaattttaaaaaatgacatgttttgtttcaaaataactagaaggggcaacatagatggacatgtggatggggtggaactggccactgattaaaggctgttggggctagttttgggtgcataggtgttcattatactgttctgcctatttttgtgtatttttaggattctccacaatacaaagttaaagaaagtcccattatatagcaaatcagggttcaatgccagcaggatggaccaaagaaacatcttttgatagcaggaaatgaatattttcccgagtgagcaaaacatgtttgtgtcccttctctaaatcccattttgaaaagtacattgaccaggcctcctgtgaatacatccattgctcctgtatcagctggggaaaatgtcccaccactgagctttattaggccatgtaattatagctcccaaggaaggcaatggaagcccagtgactcgagtctttcaaaattagattggacaacatactttcaaatattcagtaggaaacaatcctactctagccaggcactactgtcagtgatttctataatttgctttcccattcagctccagctgaaggctgctaaattcttttcctctcactatggaacaaaatgattgttaaattatataatgggatttaaaaaaaaaaaagaaaaaaaacagcacttgctagcaattggttcctacagccacacagcaatgctgataattaccgccaccacacagcagggatcctccctccccataagtaacctcatcacattaataaacagaaacagagctcaacatgccaagctcagcagtgataagtcaataacttcacatctcactagtaagaaataatgggtcattaaaattctccctgaaagaaagttctcaaagagtttatactgggataataatactttctaacatttactgagaatttaccatgtgccaggcactgggtgaagcgatttacaaatgcttcgttaattcttcttcacctaacttcctttttctgtatttggaaatagagcttacagtctgcactttatccatagtctacactcattaagtaacttgagcagggtgaaagcacgttgctctctcaattactagttatgtgtccttgggtatgttccctaaccaccctgggcttagcaatgtctctctccccaccactaccactatgataaaatacaaaataaaagcatcaaccttacaggtttgatgtgaacattaattgtgactatggatataatgctgctagcagccaaaaatctcaagatgtatttatgatgtttctattctttggtctattttgcatttataaaaatgcgaaaagaaagagtttctgacatggaagatagcatcaatacctccccagtgtccacttcacttggatggtgaagagacagggctgaaagatatttgtaaaaggcactgggcacatttttctaaaacctctattaatgaaaaagcaccagagacacatgtttttgtttttgtttttgttttacatttgtaccacacagcaagaagacacagtggtgcattccagggcaatggatctttttatttggaaggcaggggtgatagggggtggaggaattttaaaggaatctaacatttgaaattttcactcaacaccgcctaaataaataactgggtcagaaacttaaataaacatgcataccacttgagaagaaagaaggaaggtcaagttgaaggtggttgggggcaggatgaggactaggcctgagcctggaggaggtgtccaaaaaaagcacagtgtggagcaaccaacttattagagaaaagaattgcttggattatttagacatgggtaattattactatctaaataacaaaggttaatttttaaaagccaaagagttctgacacttcacaatttgcatggttgattgtcagcagtttttgtcagttgtcatgtttctcgtaggatgttttctcatagaggttggtcaggggttacttagtatgccttcctgtgcttctcccctctccaggacaatatttaagtaaagggtcctcagcctcagctgattccagaagacatttcagaatactgagtcagcgcttgaggttatctcttcacaagagacagggggcctttagcatggaatcaccagatgtggtggcttctaaacttccctttcctgccctaataacctctaaaagaattttaaaagatttagtctcaaaggcagtcaaaggtttggatgattcctggggtccctaaagtattcactcccttgctagtttattggttttaagttcctgtaatgagaaacgaactcttaggatgttatttcacaattgcagatacttacccagaataccctgacaggaactaattcctcccaaatgtcactagtcagtcacccacaagaataaatgactactaacagatcccttctcttttatggtaaaaggaggggttggaggcagggggcaggaagaggtgcaagcgggaagattaaggtcttcctaaagtgagaagggtttgcaccaagcagtttaaaaggcaccctaagaaaataataggggctgggcacagtggcttacgcctgtaatcccagcactttgggaggccgaggtgggcagatcacctgaggtcaggagttcaagaccagcctgaccaacatggagaaaccccatctctactaaaaatacagaattaggcaggcgtggtggtgcatgcctgtaatcccagctactcgggaggctgaggcaggagaattgcttgaacccaggctgcgaaggttgtggtgagccgagatcaagccatcgcactccagcctgggcaacaagagcgaaactccgtctcaaaataaataaataaataaatataaataaaaataaataataggaagaacaaacttccaagaacacaattctgcaaagatttaacccagaaacatcaatgaggcacagagtattttcatcatgtgtggctgaaaataaccacagatctcatctgcatgatttatgatggtggaaacaaagtccaaactcagtaactttggtacagaaggctgctttatgtgcaaaaggtaggttaagtctcaaaatataaaatgtgtgtatagaaatacaaaatacaaaaattggtaggtatacatttgaatacatgtatcatttcaatcaattgaagtaaagcttggggatttcaaaccttaaaaagcaactttaatggccttttacattcatttttaaactagcatgtactatctatctatctatatataaactcttggcttctgaattatatttttcgactgggaaagagaatgcttgaactataaattttaagacttccaaagacaaaaagatgagttccaaggatgggaagtgtcctagactttgtaataaagcttctggatagtgaacaactctctaccttgaacatggcaaagacagtttgaatataccgagccaactagtatttttagcaacaacaagtctgcccaaaggacaggcccactacaaatgctcaagtcgcctatgtctcaagagacagacaacccagagtcagtacgatagcatttaaagaaacgttacggacattagctgcatcttgtatttggtgtctggactcaaattccacagtatgaatgcaaaattttctgcatatatatatgttttttttttggtaggagtaagtcactacatgtcaattttgtccaaagatccaatcatagaagctaactttaaggttgaagaaatttgcaactctgcatctcggaatgttacacccaaatagaagaatgtggggtgaggaatggtgagccagttttcagacaggttgaaaataggaaaagaaaataaattgctagctttagagcatttaggactaatcatcttgattgctgaagattttgagaaacacaatataaataggaacatagactttggctcaaaagttatctaaaaaaaggaatcaaaagggttgtatggaccattagcaaaataactttgggtacatatcaagtcttccttttgcttagatgaaaagaagtttaaacaaagttcaaatgaaattctttgggacaaaagaagagatcaattgcacattcttatcaaagaatcacccattaattcataaaatagctctattaaagctcaacacacaccagttgcaaggtattaagttacgtgtagcttcagatctgtgtttgtatctacgtaacttaccttgtgtctctataggtcttgcaatgtggcagctctgaaactgggagactgtttacaatcattcctcttaccatgttaggcatatctatatttgccaaattcaaccttttaaaaatttctgctcacaaataacaagactaaataactcctccagacaagtgacgtaggctctgtatatgaaggaaaggagctgtttacttataaaagtaacaaacactaatcaaaacaagttttaaaagcctcatttctgatacacagcattaacaaaagataaattttaactgttcaaaggattcagctatgagtggttaattttttttttttcctacaacctccacgtcacacaagggtggttaaatttttaatggcattatctgcagtacctaacatttaaatgttaaaacaatcaaaattgaagtgggcattatttttaccaagccaagacgctataacaatgtaaatccaaaatactgcagaattaggtttaggagttgtggccaacatcaatgcagagtctaaaaaggacctttcatgggtagttgaatgagtttgtttcttagttcatcccagtatcttattctgagacgatcttacacaggggctgggcaagtaatgtgaatacatgaaattgagtatgtatggaagacaacaggggatgttggggcctctggtgcaaatttgatatgtgccctctaaacagctggtacactgctctaaaatactgctactatttgaaatttcaggcccaatatttctagatcattttatttttcaaaacttttcaagaatccagacttttctgtgaaactgctcaaattttctaatgttggcataattaaaccaccaccaccttatgtgaaccaaactcaacatatttatcatggcagcatttagcctctaggctgccagtttgccaactaagaactagtctaatattatcatttttataaagtagaatccaaatgccagacacattggttctcccgaggtttgactctgggtctccagattcccaggctgtcagaatctttgtccttaaaacgcacacggtataatttcttaagtcttggctctgcaagtgtaccgtgtgaaaacttgatgaatagattattgagccgctacagggcaaaaatctgctatcttacttgaccaccctacatttcagaagatgattacaaatttatttcctgttacgagatattctagccctgtattatggtggtatcaaaaaagacagcaaaatatgtgtgagttcacattgtaatttttgagaaattagttaatttactaaacagtatttctccctccctcccagtgtctgaatggcatgcagcaaaatggagagcctctcatcactgataggcagcagaatgagatgttgtgtgtcagagcttgccttgtttccgagagatcagaatctttattgaaagggctcccttttttgatttccggatcagaccctgagcagttgataaaggagaattacttggccattatctgaagtagttgtatttccacaaagagctagtgctaaacaagagtttatctctacaacaagactgataggattcgtacagattataattcaatcagacacctgaaacaggacatacattggctagtgggatatatgcaaacctgtcctccagccatagcaaaataaatatctggggaatatttcatgtagtctgaatacagagaataaatgttagaaagtgctgcttttagttgctttaggccatgcctctatataattcataatatttttatacaaacgtaatcctaacaaaatgccactagtctgaagagtcaactatctatgacctttgcaattatttgataaaacattcccaaagcacctaacgcacttttcaaaatgtatttcttagagtttacagcactcttattagtagctaacaggtcttacttgctctttgaatattgggtaaatagaggagtacagattaaaggtgaagttaaactaaatttatttaaacataaatcttcaatcctatttagaacatcagcttctgatatcagaactatttttcatgaccaaaggagaagagtgtagggtttaagggcttgattctggaatcagacagcttggggttagctagcatgctggcttcatcacggacttgctataagaccttggacaaacttctggactctctgagcctagtttcctccatctgcagagtagggataatacttgatttgcagaatggctgcaaaaatctaataagataatatgacaaagtaaacaagcatagtacttggcccatggtaagcaggtgataaatatttcctaccattgttcttattaacagagaatgccccaaatttagtgagtcagaggccttggaataagtatgtactgttatattctatgactgtgttcccaccaatattgtaatctgatattaatttcctaactattatgtttctgtctttcttcttcctagttctttcttgatttgtcaccacatcaatcaactaggaaaagaaatgacgctcttgcccttatgaggcctttcatagcttttatcttcatctttggtaagaaagaagctactagacaattgctagaagggatggtcagagcagccctctgcatagacgcgagtctgacgagtgctaggccctttgtccttcaaacctggcagaatgtaggagctgtaacttccacattttgttacctgcagttaattgcatttaattgaagtggggtaagttgaatgtgatggcagaattcctccccatgtggtccagtttggaagtgctcactacttgcagatccccccttcatcaagttcaggaaggggattcacttactaaaacagtttcctaactggtctcctgtttctctccttgacccatctggtctattcgcaagccagcaactgaagtgaccccttcagtatgtgggtcagatcccatccccctcactccatgttcaaaaccctccatggctctcccacctaatgcagagtaaaagccgaggtctttccaatggcctgcaaagccctgaatgatctggatccaggttgcagactgttaacttctcagaaagacagcaagggagctctctgggttctttttatgagggcactaatcccatttataagggctccaccctcatcacctgatcacctgccaaaggcctcacctcctaataccatcacattgaaagttaggatttcaatatatgaattttgggggcacacaaatgtttagtccataacacattgcaacccttacctgcattcccaattagtactccaccaggtacttactagcttccagcatcctctgtaattgtcttatttattatgtttattgtttgtagtctacagcaagaatgtaagctgcattaaaataagtactttcataaattttgttcactgttatatcctgagtgcttggaagagtgccttgtgcctagccagtatatatatgtatctatactagccatgtatatatatgatgatatgataatatatacatatacatatgtatgtacacacagacaaataaatgaatatatggagatatatatgttcgtgtatatatatatatatatatggaagaatgaatgaatgactggggagtaaataaatgaacacatacacatcaggcttttggttcccagcaacaacagccatctccatgagaagagcaattggccagggtgagaactagtgggaagtgactcatttccagagtacaatacctcccattaacaccatgcagatgccagcaggtgtgctgctttctccaagtacctatctgaaaatggactgaagattttgctcagtttttaacaaaaacttccagggggctttcacagaacttccaaccaagctaaagtgttatgttttaggatgtctgcaatctggtcctgcatcatccactaatgagttttgaggcccggggaaagtcaattaacttcactggacccagcaaagtttatcatgactaattcttcttccaacttaaaacatctcaggatctgcaaaagggcgaaaaagagtcaagccctattaaccacccctctccttccctcaaccaacgattcgtaaataaacaccccaattaccccaattttaataattcaacttaacatgaaaaccaacttttctatctggcccatctcacaaaatgaatgaaattaatagctaggtgtggctcatctagaaatagctgttctagctcaggtgatatgctgggagatggttataaatctacattaatgctttttttttttaaattgagaaccatagccctgaccaaagaaaacacctttctacagacaactataaaatagctatcattccttggctattctaaatattgctgcaatgaacacaggagctcagatgcctctttgagatactgattttatttcctttggatatatatccagaggtggggcttctggatcataaggtagttctatttccaattttttcagaaacctctgtagtattttccacatggctgtaccaatttacatttccaccaacagcatacaagggttcccttctctctacatcctcaccaacaatatacaaattctttttctttttttttaaattttaatttttttggtagagatgaggcctcactatgttacccacgctggtctcagactcttgggctcaagcaaccctcccagccttggtctccaaaagtactgggataatagacatgagccaccatgcccagccaatatacagtttttatttgttgattatatcttaatacaactgggagaaaaaaagtcaggatacccgttttccttgaggtggcagtgattgagagggagagcaagggggacttccagggtgctgataatgagctggaggataatagctatcattctctacgtgtcatctgctgcagcttctggcaattcagagtcactgctaaaatgctaaattgttgacaatgtagaagtcctttggaaacacaaagatatgttaactcatgccaccccatcatatcctgttgaatctgcaggcctcagggaatctgagctctcaaaagtacctgttgcaaccaggttttgttctaacaatataattttcattcataaaccaatgattttgtcagcatattacccagtgccttccaaatgctgcagagggaagcaaaagacacaatccttgccctcagagagcagacagtcttttatgaggagcaagaacagcccggtggtagcaataacaaaagcagcagcagaaagggttcagatgctgaacttaagagaaatttcaggccaggtgcagtggcttgcacctgtaatcccagtactttgggaggccaaggcaggagaattgcttgagactgggagtttgagaccagcctaggcaagaaagtgagacaaaaaaataaataaattagctgggcatagtggcgtgctcttgcagtcagagctactcagaaggctgaggcagcaggatcgcttgagctatggtatttacggctacagtgagctatcacggtgccaccgcactccagcctggaggacagagcaagaccctgtctctaaaaaaaatgtactgaagagaaagattagagaaaaaaaaagcagatgtaaaaaagaaaaatgcttttaaaatgaaattactgaaattactacctcaaatattttcaacacaattagtatacattatatcagatatccccaccaagttactacgtattttttccacaaaaatgaaaacatactatatctaattataacctcttcaacaggctttacaaagtcctattttatttttgtgtgtatgtgtgtgtgtgtgagacagagtctcactctgtcacacaggctggcgtgcagtgacactatctcggcttactgcaacctccgcctcccaagttcaagcaattctcctgcctcagcctctggagtagctggaattacaggcagccaccaccatgcccacctaatttttttgtatttttaatagagatagggtttcaccatgttggtcaggctggtctcaaactcctgacctcaagtgatccacccacctcagcctcccaaagtgctgggattacaggcgtgagccaccctcgcacccagcccctactaaaattgttaatgcttatccatttataaatgcagagctacatcattttaaatgtctgcaatgtcccgtaagtgactccctattggttaacttctacatacatccttatgtagttacctaaataagtgacctgatttaggacatattcctgcctgtgaaaatagggagtcaaaagtaaggtgtttgctttggaaggggtgtgtgtgtgtgtgtgtgtgtgtgtgtgtgtgtatgccaactgcccttaagttggaccagtgttcattccatgagcagtgggtatgagtgtccattctagacattataattaaaaaaaaatctttgacagcctactaggcaagaaatggtatctatttttttcttgtggatttctattgttagtaagaataggcttttaatacaactttactgataattgatattgcttacttttttggttgtaaccatttccttaactcaatcttgctattagtaatttcatgtttttcctattgatttataaaaatgcttcatctctgaaggctgctaaattctttgctcattatattataaaatgaatatttttacttagttatttgcatttttactttatgttttttgttaagaagacatttaaaacatgtatatagtcaagtccatcaaaattatattttatggtgtatccctttgttgtcatatatctctctttaggattatccagtcatatttattttctcccactacttttatatgttgaatcttcatatttacatctattatacatttagaggccacaattaaaacctactgtaacttttttagaattatataaactatataaaatgtgtttacccccaaataatttttcttttaaatttggagatgagccttatggaaaaaaaaaatcccaatggttcttttcatttccaaagattgagtactcatattaaatgacatgaaaatcttgttagttttatgagctaacatttttatatcttttttggtcactgattgcattcactgtctatattctgtcttccccactggattggaaatgtctgatgcattaaaatagttacttctgcccgaggctgagtactttgggaattctccatgaaatagccattactggatccacacagctcagcacagtatttggcatatagtaggctcttgctaattcagtaaattttgtgtgttaggcacatacaaaacctctggaaaatgagcaagacagtaagaggttaaaaaggtatttttagaagcattaatataacaacgacatgtgggatgaacagaaattgagagagaggaagcggggaaggagggacggaaggacagaaggtagagggaagaagaaagagtgaaagaaaagtagatcaacacataggaggccattgtaaagtccaggcttccactgaatgggcccatactagggaggtaattataaaattggcaagggaaggccaaaccaatacagcattataatcttgctgaaggactaagtgaataaaagttccaaggacagaaaccaggaaggctccgcacagcagcaacaggctttggtatcaaacacagtaaactcattggtgggacagccaattagagctgcctcttagactgtcaaagataaaggactgtggcacatacctaagtggactaggggaaacatgaaaggaaaacaacctttgcagagtccctacttggtaccagacactgtattaggtattttacttacagagttaaagtttatgtttcagtcgcccactcatcagcgatagacagagaatcgcatagagcttggttagatcctagatccatccctgctagctatgtagactttggaacagtttattcattttttctgtaaaccttagttgcatcattcaagaaattagggaaagaataatacctaactcaaagaagcaaaataaatgatacaattcataaaatgtaaataccaaggcacctaaaataaaacacaataaaaggttgtcaattagtgaaaaaaaaaaaaaaaaacagagaacttaacaattggctttggggatggtccatattaagggatagaaggaacatttagagatcctgaaaagacagatattcaaggaaatgggagaaaaccctgaaaacaatatgttacggacatcatgggggctaatggttaaagaaggagttaatcaaattttgtcatgaggatagaaaaatgaaccatttggccgtgtttgttttttatgtaaataaagcaaatttggacggcagtacatacccaaagttggtcatccatgcctggtgggttctttttgataaaagcaccatagtatgtagcaatattccggtgatgagaatatttcttcaacatgttaatttcttgtttgatttcttcctcttcatcctgtatgagaacaatataaaaattctgtcatgaaaatctatggttgttagtaggattctgttcttcaacaccatctaaattttttcttgttttttcttccttgttgacaaatgagcataattattacatatgagggcaaagaacaattctaaaacataatacattggctgtccaagagactcttctttttgtacagcaaactggcatagcacaatctcttggaaaacaaaacaaaaacatccaaaacaatccctcatctcttcacctagaagagatcaaggtagaaagactatcgagagaaaattcactgtaggcctctgggaactacatccatcaagtagctattactgattctatctggtataagaaagattgaggaaaatgaaagatattaaaaccgtgggcgctcagatttaaattttgttaggttcattttctttgaaggctcctttcattgaagtacctgactgaagatgatgaaagtcagatgggaaaaggagcaaaggtaagttctctagatctaaggaagttcacaaagcaggagtacccacctcaccttcaggaaactcaccttagaaagaaagggggaaatgtggtggtactgaggatgtaaaaagagacaactctcttacagagttagtttcttaatattcaggtttcattcactatgaattttgatttggagtccaccaacctggacccttttcagaggtcctggcagtgctggtggagatggtgacctcccataattttattttcttgatgtgtatacacattggttggactgcagaagagtgttttattgttgaggttgggggagaaagtttctacctcaggataattttttaggtgcagcagtaagctatgactgtccctgagtgcaagatgtgacattatcatgacctgaaaaactacccatggtgtcccctgtctgtaccctcctccactccggctgcactgcctccttccagtgtctctgcattactgggacttcctgcagtctctcgtgtgctgtcttctttcccccacctcttcttcacataagctctactcaccattcctgattgagtttaatcgacattcaccagggatctcttccttaattctctcaggcaatgtcaagtccccccactgcatctggtcatagcccctacactccttcacatacctgctgtatttgttgacattggtatggaggtatgtcccattactcgactctcttctccctatattgtaagctctcctctccagatcttcagatctcagttctacagttccttccccagcaaagctccctgatctgcccagtttggttctagccccgtgaatcatcatgtatcttttcctttgtagcacctatcagaattgccacccacatttatcatttgattaaggtctcctctccttatcagtcggtaagaaccgtaaactcaggaatcctccctgttttgttctctacaacatccctagcaccaagcagtgcctgtgaataaatgcaactaaaagaacaaataactacaaagagcccaatgcccagagcagcattagtgatgttagaaggaacaggtaagaatagagtgaggagaatagtgaagtgctgacatttgctgaccatgcttatttactaaaataagctttaggaaaaaacaaaggggatttgcaaacctaggagaagtaaaagcatgttacatatcacatggcttaactaagctgaagactaggtaatctcaaaatagaatatatgcttgggatgctgagctaaggagaagcatgtggccgaaacagtggggaagggagtcaaggggcgagacaggggaaggcacactgctgaccacctattcttcttagcagccatcagaaactccccacgccttcactgcaggtcgtgaagagaatgaccttcgccagccctcaacttgttgaagggtccctacagcgcacctccaatgtcttactatggtgcacattggctatttttaaacttgctgtatggggccaaataattgtggacgaatgtaggatgtgagcggatgtactttggggaagcctaaatagaaagggagaaaaacgacctgagggtttctgtgggcagcacagcatcgacagctgcttccattaaaaaggcaactacgtgaggtaataaaagacacggatcactttccaactgcagcctgtcaatcttagcatcagtcattcttagtgagaaatcaggctgcttctacaagtatttaccgcttgcctcctggattcttagcaggatagtgggtgatgtgggaaagacaggggagggggggactgcctataaaaagctcaccatgtcattaagaaaataagagcttataaaacagttaaataacaacagaaggcactatgtaattaaatccaaaataaatagtactggaggtcagaataaagtcagtacattctccatcattttgcaaaggtaaactgaggcaatatgacaataaggacagcatatgcattgagtctgggatcagaaagaagagggtgggcagatggggtgcatgttgagtttgggtaccattcctttctggctgcagaatcccaagaaagttgcctatctttttggaccctaagttttctcatttataatgagataaagatattataagtcccagcattttgtggtacttagataacggatgtatgttataaagtgtactacaaagtaaatgttattactaatctacataaccaaaaaataaataaataaaagggcaggaaggccaaaatgtaaatcacttgaattttaggtttaaattgcactgtttccaaacacagttatggaaccactgtaagacatggttaggtagttctaaaatataaatccttgatcttacgcaactttttaagtcagcatgcaatttagcaggcctttgggcctactgtttatccagatttttagtctagggcacagatggcagtaagttattcagtgaaataggaaggaagaccgttactagatgagacaagaactcatttaaccatgtcacaaagagttcagcctctcacaatatggcccatcaagggagatgagttacaatgctttccaaaaatgcaaagagagcaagggaggctagaattaaactaaaaagttataagtgaaaaagttatagccccatgaatcatcatgtatcttttcctttgtagcacctatcagaattgccacccacagtggcagaattgccactgaatgtggcaaaaagtaggagacaatttatcataaaggatcacaggctacgagaatttgaatagcctctatttgtaaattattttgtaaatgtactatttccaaatcttaagtattaagcacaaggatcaagccctctgataaactaatgaccactgggcaataatgaaaaataaagtagtggtaccaaattatcacacatttaaaagagtaacttcaataagccaagtccggtactctaggaagaaggattacttaaatcagatgacttccaaatccagtcatattcattatgttaacctcagccatggcatttaaactctccaaatgtcagtcattttcagctataaataggaataagaatacctatataagctacttctcagggcttagaaatgattaagtgcttatttaaatgtagctttagtattaatataaagaagataatattatttctcaagatcacaggatctacttattgcttagtgtttgtggtagactgaaaaagaaaatggccatgatatgtgtcccacctgcatcaagaggtggagtccatttctcttctccttgaacctgggcttagccacatgtcttgctttggtcaaggggacattagcaaatcggatgaagaagcagaggcccgaaaagcacttatgccttgagactggccctctcctactgcttgccagagaaccaacccttcaacccccatgtgagaaaccgggattgaccttctagaagatgagaaatcatgggaagataggcagttttcaaatgcaaggaaatagataattccagttaatgcttttaagccactgaccacctctgatggcaacatgattgtcatcatgtggtcataaaacatagccaaagccaaaacctcatgtaatgtttactgtgtaccaggaggtatgtatgaactatcttattgagcactcagaacagctatgaagctggatcctattttacaaacgagtaaaatgagtctcagagaagttaagtaactttcccaagttcactcatactttaaatgttaaacctcagattcaagaccagatttctctgactccaaagccagtattcttaattctttacagaaaactactagtcagatgaagggcaattatccatggtgtccaaaaccaaagtcgttaatcggaagcgtttaagagcatcttaagccagggcagaagagaaccctgactttggtcttccaattaaaggagcttgttagcatacaataatatttgcttatgattgatttcaaggaataaagaagggattttaagttgcatatttattacacaggggaacacactttaagtgcctatgatatgctagcatttaaaaatggaataaaacatttaatattagttatatgctctgtaataaagtctgcccaacatttaactctcaatccgtggcagaggaatgaaactatgcaattcctacagcaagtctaagagactagtcaggaagaagtctagagagaagtataaggtgtatagattcataaatgccactatcccatagatgtgtggacactggctagaaccatctctgctcccgctcatctgcactgctttcacagcagctgttgccattaagcaggtgtttgtgttatctgtcattctcaccttcagcattgactgaatgtggcaaaaagtaggagacactttatcattaaaggatcacaggctacgagaatttgaagggatcgtcactatgatatagaatgtggtttttaaaaagcttctgaaataatttgtaatagtgaaatccctccctgcaatagaagtttttttcaggatgcaaatatatagctgacaaaaactaaatttttaaaatcagtaaacatttatttgtttaaagcaatatctacttatacaattagtcaatgacaagaagttgttctagtgaatacaaaattagaaagaaatttaaagttatacatcaactctaatatcttattaattttcatttttctttcagttctataggatggagaaaaatctgcatttcctaagataaatagttgaaatagttaagagcatgccttgaaattttagtaggatcttcacaatcaatgccattctgcacatgaatagggtaacctagcagcacaaattaacaggctggcgttttccagtgtgttcaaagttggtgtataacatacagtttgaggtctgctttttaaatcacagtttattatatgttaaaatatatttaaaattaaatgagaattaaacatgtaaatcacctaaaattatctcagggtcaagttatgcagctttgggtctgtttccttaaatcgattacatctaacagactgtaataaattagattgtaataaataattacaatagattgtaataaataattagatgtaataaatctattacatcaaatagttttaaggaaacagacccagagtcatccaacgagttgtctaagtccctacctcttcattttagcattgataggactttgccaggacattctgcaggcagcacctggatttgctgtatatgttaactctaagttaaattaattcattcaagaatgatttactcaacccagcaaacccattactaggtatatatccaaaagcaaacaaatcattctgccaaaaaaatacttgcactcacatgttcaccgcagcactattcacaatagcaaagacatggaatcaaccttggtacccatcaatggtggactgggtaaagaaaatatggtatgcatacaccatgcaatactatgcagccataaaaatgaatggaatcatgtccttttcagtaacatggttgagctagaggctattatcctaaagaaattaatgcaaaaacaggaaacaaaatcctgcatgttctcacttatgaatgggtgctaagcattgggtacagatggacataaagatgagaacaatagacactgggactactagactggggagagaagtggacaagagttaaaactgactgttaggtactatggtcagtacctgggtgacagaatcatttgtcacaaacctcaacatcacacaacatacccaagcatcaaacctgcacatgtacctcctgagtctaaaataacagttgcaaaaaaaaagtaaagaagaaaaaagaattatttactaagtgcctactatattccagtcataattgtaaatgtcaataatataatcatactacaataggcataacagattcaagttctgctacaatgaagcttactacagtttagtggaagacacagatatgaatcaaagaatgagatatatgcaaaattacgaccatgagaagtatgtggtagctgatctaattaacctcaagaaacctaagtttaagctgagtttttaaggctaggtgaaagttacccaattgggaagaaaaaaagagaaaatgtgatgtagtgtgattgggatagaaacattttcctggcagagaaagtgtttgccaaggtcgtgtggctggagaggatgtagcatgtggtctactttggaggcttttggtgccataaagagaaaaataaaaattgtctgcaaaagacctggtaataataacaacaataggcacagaataccgtgttctacatattgttctgaaaccctttataaataatgattaatatatttacatctcacactaactttgtgagagaagtggcattatccacatttatagatgtagaataaagaacattaagcaatatgtccagggtcagagagccatgaagtgtcagaactaggatattccacgagactgacactgtgcagggctcttctttgccagtaggctaacctgctttctcttacaatgaagtggagttccctaaaggggtagataacaaaaggttgacatatgtctttctcatacccaagcctgcactgaggcatgactcccaagaaaaccacgaattaacaagacccaaactcaagtaacccagaagtaaacaagttttaaacctagcaataatgtcactcatgtggctaaagtctaccataaatggcgtggcttatatcttcaaggatcctagatttacaattcaggtaacagcccacaggaattggaatgagtttttttttttttttctgatagtataaacagtgtactttataatgttccccccttttggctttggttattgggaaaaataactagcaagttctctgtggccctgtaatttcaatttgcttttccttcaactggctttctaatcttaatattgtttttatatttatttttacataaatatgcatttatactctacatagatttttacattgtatacactatatatgcattatatattatatacatgtattatatgcatatcatttacatattatatattaaatacatatttttatatattataaatatatatttgatatatattacatatatttaatataaatatattttatttttatatattatatatttacatatttatattaaatatatatttttatatgttttatatatatttaatatataataaatattaaatatttatatttatatttatattaaattattacatattaatatataaaatattactatattagtgtattaattatattaaattatatttaatataatatattaaatatataaatatatattttatataaatatataattataaatatatattttatataaatatataattataaatatatattataaaatatataatacatattcatataatcattcaataatcatttactcaacccagcaaacccattactaaattatatatattattataattatatgtaatatataatttagtaataattataatatatattatatataatgatatatatcattttatatatataatgatgtgtatatatataatgatatatatcattttatatataatgatgtgtatatatatataatgatatacatataatacacatatataacacataatgcagcacctactaggtgccagtgccagtgccaggttcaaccttagcaagctctgcatggggtgcaaagatggataatgcacagttcctgtccctggccttgaaagcttattaaagtcagtaggcttcaaatgagaaagaacttttaatgaaggaaaaataaaagtgggtgaaggatatgaacagacacttctcaaaagaagacatttatgcaaccaacagacatatgaataaatgctcatcatcactggtcattagagaaatgcaaatcaaaaccacaatgagataccatctcatgccagttagcatgacgatcattaaaaagtcaggaaacaatagatgctggagaggatgtggagaaacaagaaagcttttacactgttggtgggagtgtaaattagtttgaccgttgtggaagacagtgtggcaattcctcaaggatctagaactagaaataccatttgacccagcaatcccattactgggtatatacccaaaggattataaatcattctactgtaaagacacatgcacatgtatgtttattgtggcactgttcataatagcaaagacttggagccaacccaaatgcccatcaatgatagactggataaagaaaatgtggcacatatacaccatggaatgctacacagccataagaaaggatgagttcatgtcctttgcagggacatgggtgaagctggaaaccatcattctcagcaaactaacacaagaacagaaaaccaaacactgcatgatctcactcataagcgggagttgaacaatgagaacgcaaggacacagggaggagaatatcacacaatggggcctgtcgtggggtggcgggcaaggggagggagagcattaggagaaacacctaatgtagatgacaggttgatgggtgcagcaaaccaccatggcacgtgtatacctatgtagcaaacctgcatgttctgcacatgtaccccagaacttaaagtataatgaaaaataaatgaataaaaataaaagctgaacttcccaagtcattaaatagaaattcaaaatactgatgaggaagtcaaatcaaagaagagcaacagagctcaacaagagaagacctagtgaagtcaaaagaggggaatgaatatgaggtgggaagtgttggcagcataaaggaaaggacggacctgcagaaggagaccttgtgttccactactgaggaacttgattggaaatcatgctttgaacagccccgtcagtgattccaagcaccccagtttctgtatgccaattttgtcatctacaggcatctccaccccactagggggctaagggaattaattataattttgatcaagtgctttgaggtacacaaataaaaggaccagtgaatataaactattatgatgtaaaaaatatttttaaaaactattgctcacctttattagtttggaggtatagacagtagcccccaggcctattttttgcacttaagcaatgtatctaacatgtgagcatacacatacaacaagcccaacatccaggccatacacacagcatgcatgaacatgcgcagagacccagacacacataagccaccaaaagggtctaatctgtatgcaagaagaggacagatgctaaagtgtgcatggagtgggcagctcagttgttcatttttagaaccctagaagctttccaagttctacatgctgtatagcatacagaattgaagcactgaaaatagccccaaaggtggagggtattaggaagacaaaaaaagccatttgtttatcttttctctgttgaaagttttgaccatgtgcttgatcagactgttctgtctgctaaagacatctacataaatggctccaaagtaaaagtcccaaagagctgtccagagggcctctgtggcaaaggagcttcagatgggaatccccaagctttgctgacatcacctgaaggtcaagctcccaaatctggaggtgcacctcccctaccccttcacttggctaacgaaggtctactcgtcctgtagatctcacatagctgtcactttctcagaaatcatttattggccacccagctaggtcagtttcttcttaaattctctcttcatactctgtacactgcttggaagttaatcagaattgtgactgctattgtttaactgctaaatgtcttgtactaaaatataagattccagaagatagtgcccatgtctgtcttgttcactggatgactccgtagcacagtgcactcattcattctcaagtaaatgaatgaatgaaatcttgtgatttcagccttcagcctctggaatctagcttcactttctttcctggatcctgctctagtaagccattttttttcagctacatactattcagggtaaggctaacaactctgtaattgaggtggtaaagatagggtgagtgcaaactatttacccatatcagcaattaactaacacaaattggcacgtagttcacagatcaggctgtcatcaaaatatacaactacaggattttaatgcacactaaaatcttttcattcctattgtctgtcttattcagtgattcaatgtaccttactggcactaaccattaaaatcatgtattgaggacctattatgtgtcaggtacaagatatatcccatttaagtcccaaaacaagcttgcaacattaaccaataagaaaactgtggctcagaaaagttaaaatttgcccaaggtcacaatcagtaaggagatgagtggaatataagcccagctctctctgaatctgaaggccatgctctggcaatactctctcatttctcatcctataataagatgtctgtggagagtgtgggtatgccctgactggctcgatttgaattccaaccctgccatttactatccatgaggcttgggcaagtttcttgggctctctgctgtcaattcctttgtaaaatagatataccagcagtattctcctaatggacgttgttttaaggattaaatgagtactaagtactcatttaagtactaagtacaatgcttgggacatgataaacaatcagtattagcccctttttggcctgtgcctatcgtcattattattattaacaatattatgtgcatactattaattatgccactgaactgcctccctttgggatgaaagaaccaaatgtacttggaacaatgtgtccaccttactcttccaaacaacccaagatgaaaagatttttcttttctttttgtgcaatttcagcaagcattcactgagccctttaataatgggcaaaacagtctactactgggagaagaccacttccttactcttcagaaagagatggaggctggtcataagcttcacctacagaaattcagtaagacagaaataggaattcagtgaagcagagcttagcatggatcctcctagtaggcaatcctacggtgttactctcctgttcaacttctggctcttgcattggctctagtagtagtttgaggaaaggagccaggacttacggtctcccacccttggtttaaaaaaagaaaagaaaagaaaagaaaacctgcttacatttcttttatgtattgggtttttctctaagtctatttgatcaaagtgttctactgagaaaactaaaaattaaaaaccttgtaaactccttgtcacagtattaaattccttcatgacctggcccctcctaatgtgtctagattcatcttgtatcaacgccttcttggcacttttaacctcgaaactaagctatgtgcagtttccagaacatgccctctcagcctcatgccttggcaccggctgtattcttggctggaatgtcctcacctgactgtcctcctgggcttcctcagtgaggactgtctcctcacagttccgacaaactttacaagtaacgttatttacacattctacagccttgttataaagtgtataagctttatttataaatatttagggcaaggttgtgttactgtgagcaggcaaaagaccatttttttcatctttaaatttccagtgcctatcataaagtagattttagtaaatgtttgttgaataaatcaatgaaaaaagaatcacatgaaattaaacactacatgaattgaagactgaaaacaatgtggttaagaggatagacttaaaggatggggttacattgctcaggctgaaatattcactccttcctttggcagccatgttacattgagcaagatacttaaaatgcctggctttcacatcctaaaatggggctaatcatggaacctgcttggttagctgctgaaaggatcaaatgaattaatatatagaaagtattttaaagagttctggcacgtagtaatcactcacttagtgttagctaccattattattctttttgataggaatataaaaaatgtaattagagaaacactttacttaaggaccaaatcagttttgaacacactcactataatatatgatattatagtcatagaattctcctgtttttgcccacccagcatctttcccactcttttctataataactctcaggtttttctttgagaaatcaactctctccaactctcagtccctgcggtaggttccagagccaggcatccagcccaggcgtggactggagagtaaggaattggcccagggatggggacatggtccaagctggaccactgatattcagactggcacctttgctgggaccaatggcaatgaggtagtgaaaacatgagcctgcagctgctgctgggacgaaagcagagcccacagatggagagagacaaaatcctgatcatgttaggtgacttctctgcatcctgctgaggtttttgttgttttaattcatacaagctagtaaattcccttttcagcttcattcagtttgagtggcggtttggtactacaaccccaaatgtcctgagtagtgtaatcacaaccagtcattgtaaaggcaaaagcttacaatattagtatttcattaagtcctatatgcacttcagggtgtcactgtaaagggactactttacactaggaatttttatccaaatgaaaatggggattatttacagggttatcaaaaaaaaaaccccacaaaaaaccatagctccttcacacttggtggccagaaagaagtaaatacaagaccctagaaaagtggtactctcattttgatgtgtgtgacactctgaggagtttacagaaaaggcagattttgaggctaccccagaaatcctgcagcaggcccaggaatttgcatttctcatgagtacttcagaggtgctgactgcccactgatgctgatggtccactttaagaaacactacctgggagggtccagctcctcctagatgccgtaggtcaatctagagcgcaaaaatccagctgagaggtaaatcccagactgtgacaaaatggggaaatttccataatgatttcaaactataagatcttcaaggcctactctgagtttaagcacaaattctgaagcaaatgttggcaaatttggaagtgtttcagctctaaaaatggaaggatataagcattatatccagttctctcaatggctgttttataccaaaaaggaagtgatatagaataaaaacaataatttaaaaattgatgtcaagcttatggctttatcagttttataacaataaactatagtaactttgtagtaggtcatagcatgtaattaacaaagacgacctttgagaattcatttcagttttttaacagagcaaccataatgagtacaattataataattggtaagaagcttttacagcattctgtaatacacaatagacaacatggcaaaatagaatagactgtcttctaaaggcaccacgtgagtttcacaaaggaaatcttatgttgactgtgatgtgtaagggggtgatacaaaagtctcttgatgccacatcagacaccacaaaaataagaaaaccatttcctgatgtgcatccatgtttgccttcgttaaaagtcagtggttaaataatcatcaatgacatgactgaatcacagaaaaactatctagccctcctcaataggagttccccaagagaattaagcctaaatactataaagcatccactctatgtaatggattgacactcctttgcatgtaaaatggccttacctctgtaccctccttggaagaactgagaaggcagtctctcaaatcatcttctgtagagcttagatgcttaatgaaacccagtttagaaagactaactgacattccttaagctgaaaatacatgttctgggaaaaataactgtgtaacttttaattccaagcaaggtggtctagcaatagtggttcttgagtagtttctggttctacttgtgaggctttaaattgttcagagtcatactttgaacatcaacacacattttatgccccaagattaatgacatcagtggaactctcaactgtagttcttcaaaaccacacaatagaatttaatatacagcatgaatgtcttggactccttccacaaccattaattgttaaactgccaagctcatctcattatgcagagatcctattcaatccaaggaaaatacagtagtatgacttcagctgaattgcaaaacaaattctgatttgttctgtggttggagctttgtaaaatgtttacacgtttataatgggtttctatgtagagactgatagtatctgattttaatttttgtgtcagatcctgctaatcgaccattccagtatccactctcccttcatttctgactgatagaatctggatttttaagtagacacattagtagaataaaagactacattttctagcttcccttgcagctagatacaggcaatgaaagcagaagtaagtagtaatgttgtatggaagtagaaaatatttcactggaaggggctcatttgtacccttctgctccccctgctctcccttttttgcctgccataaagtgtgatcagtggaaatccaataaatattttgaaccataaagcaaccttaactgtggaggccatgcattagaatgatggagcagaaagataaaaacatccttcactctaccatatcactgacatacatccctaggctgtccacctttacactcctttaacatgagagcaagacacttctattatgcttaatcctctgttatttagcgttttcttaaactgaattaatataaggcacatacagtttattattcagtaaaggccaggtgaattaataaactaattgggactaaaaatttgaacttttgtaatacctaaaacttaaataatatatttaagacaaataaaaagaattagtactttatctaaatggtaacaaaaatacaggaacaaaatattttactggtcaaaaatatatacaacttaaagaggaatttagatcaataataagtcagtacaatgtgtggtgtaaacaataattagtgaaacgtgtattatggtaggtaactatcacataacatatacttatctaaggtaacaaagtgagcccaaaaggtatgggttgaagtttgacatacagacatactgtgtgtctttcttatttatttatttttttcttatttgtttttcttattttcttttgtgtgactcattcattctatgtctatttatattgaataatcaacttctgggctgaatggaagactttggtcttttagctttcatgtacagcagacagacatcttagaaaaatccccaggacaacagaaaattattaacatgcctttgatgtccagtgaatcctttcgagtcagatttttgctgtgtactcttgaaaaggcattaaaatattttaagtaggcttagcaaaaggatcgaaaacattagattgtatttaaaataaaatctatttcttagattgcttttgattatccaggcagaaattttgtttcattgttgctctataatgataagaatttgtgtttattgtgattatttggtcagtaatattttgttttgggaaatattcatgttaaatatcctactaggatcttagagccatccaagctcctgtctactccagtggtaggcagacctttgggaaaacagttaagactcatttcttctgtataatctcagtattattcatttaataccttcacatccttgttctgcattcatatgcaaatatctgtggttgtgtttatgtaaattattggcaaacagtattcactctaactacataaggcagtgtgtaggtatcaaatttaattagagtgatgtacccatgatctcttcagtcagctactgcatactcttccttatgttagccacaagtggggaaagatattagatatttagggagattatttttctagaaaacaatttttttctatcattaacttctctattacaaatatagagatggtccctcatttacaatggttcaacttacgattttttttgactaacagtggtgtgaaatcaacatgcatttggtagaaatcatactgcaagtacctgtacaaccattctgtttttcacttttgctatagtaatcaacaaattacatgagatagtcaacattttattataaaataggctttgtgataaatgactttgcccaactgtaggctaacgtaagtgttctgagcatgtttaaggtaggctaggctaagctatgatgttcaacaggttatgtgtattaaatgcattttcaacttaacaatattttctacttatgatgggcctatcaggatgtgaactcatcataagtcaaggagcatctgcatggctattgagatggcaaaataaagacacttacccctgtgacatccataaccttgatggctgcaagctggcccgttttgacatgacgaccctgtgaagaaaaaataataacaaaagatttagttctgatgatgaatagtagcattcaattccaacaataaagaaaaattgcttggatcagtgctgtactatgtcaatggggggagagagaaagacagacacacacagaaacaccatgtctacttagtgtttattttgtaaaacgtccccagtcactttgtttattttcacagtgggtgtcaagtcaaataaaaaatgcaatgttgaacaatttggttctaactcctctccaaggcatttgacaagagcttatatgagaggaggatttatgtcgaaggggagctaggcctgcgtggaagaatacacaagtatctctctgttagaaaacactcggtagatgaagaaactttggtttctttcattcttaaaatatcctgtgatggttttaactggatatgattctgctataattcacctgagattgttcatttatctttatcttaaaagggagcctaaactaaaacagatagcaatcaatccaaatttgtgatcaaggagacagtgttgaacattaggaactgcttccccaaggtgggctcttttggtctttagaaccacagtgaagcagcaaccacgtggcaaaatcagaaacgagtagggagcgccaagggggcactctcagaagagaattattttctctttgtttgctccttgagaaaacacaatgtctacatgtgactctcagacaacagcaaagatggtcatactcactacttttacatgaattttatatatagcttccaaaatacattttacttattgctgctatcaggcaataaaatatagcttctaagatcagctgggttcaaaacctagctgcatgaccttaggcaagcccctcaaccttccaagcctcagtttcctcatctcaaaaactgaaataataataatacctaatgcatagaattgtagtgagaacgatatgagatcatgtatacaaagtacttgacagtgacatatgcagattagctgtcagcagatgctggccgtaattatgtatggtcctgtcttctggtgaattttaaatgttgtcttccctactgaactgtatgtttcataaaggcaaggaccatgtctcatcgatgtatttccagtacctggaatagtaagggcctcccccatagatgctgtggcatgtttatgaattaacaacagataaggaggcatgtataattgtggtgtggaaaaagtgattggcctagtgtgattcagattcagtagttgaagttggtgaaaatgtgctagtttagttggatcaaattttttaaaagttgtggtagaaaacattagtgggtcaattttgtaattgagaccacctatatctttgtgttcttaaatcctttccctttttctactacttttctcccttactaacctaattttccccactcctctggccctttaacttctgcccactctgcctgtcctctttcttctcacatatctcagctttaaaaatctatttactctgattctgatggtgcttccttccgcttttgacccccattctgctgccctttttttcctcctcactggggaaagagcacaaagaaggggacagtaggtcagtaatccaatatggtcacagacacagcccctcacacttatttccactttcctgaaatcgagggagaggatggcgtgttaccttgtaaagagccctggaccagaatcccagaggcccagttcttgtccaggctctgcccatgaccaccggctgtgtctgggccctcatttccccatctacaaaacgtggggagactgggctcagtggttagtagagagggcagtgagtgggtatcagcactaccaactctttccatcccaagcagcatttagaaatttagtttccacaagattgatagggagagaagtgccactgctacagaaccaggaacactaactttcttgcagagcagcaacgctacctttcctgcaaaccatgagtcaatcttgcacaaggaagaagtagcaacagcgtcctcttttgagtctgtgatgccgtaatgatgacccttgcaaaggaatcaacagctttgtaaccaacagtggactttaaagtaatggctataaatcatgtcttaaataatggctgttcatctgctaaaacactgaaagagggtaggggaaacgtaggcaaatacagagggtctgtctgatattatatagctgatttgccttgaaattattttaatggtacctgtaacaggatacagacaaaccactgggcacggcttgcagggccctccaagagctgaccccctttctgccataccaccttggtaggctcccacttgctcttactctgtggaccttgagaacaaactgtttgcgcttctgtaaatgtactttattgtttcttgcctctcagatggtatgttttcttggtctgggatgccctttgccttcttgactcctcagacaacttactctctctttccagattcaattacagtactctgtcctctgatacctcacttgtcgattcctcgtcacctctgtctatcaatgaacatgtccctgtgtgtattattccaaggacctcaaaggattaatatccctctctccctctctggtcttccttcctctctcccttccttcccctgtggctccatttgcagcccaaccttttccccaaataaaaccttaagtgaactcccttggttcaagcagggacttgactgcccaactctagtctgctctgcctcccgactcccctcattcctgagggagtccctgaggcatgtctgccagcatgcactttgagagactttgcagtagatttttaagtccttaagaagcaggaaatcctctttgagtgaataatttgttacaaggacacctcaacacctagttcttcccatcagcagcctagggctgagccagcccatggtactggctcaaggccagagatgaggcgggataaaagtgacgtgtgttacatttcgaacacaggcagtgggcagttcttgttggaataaataagatatcagctcttttaaaaaacctagtatacttggcttttgttgttgctactgttttttgttttgttgttgttgttgttttgtttttttttttgtttttttaagtagccactatgaaaatgatggaaggtaacactggaaaagaaaacaacactttaaattttaaatttcatttcccggctgaaacagcagttctcagtgggtctgacagctaactgaaaaatacaccttgggatggcagtttgggcttacatgagatcctggaggtggaacaattagcagcctcagatcactcccaggcaaaggtatccccacgcgctagagcaggaaggatgctgagctgtcacattttgctgatcaggaaagggccatgaaggaacttgcccagcatgagctgccttttctatccccagagaacatcaggccaagttatgatccagattaaggcagacttggagggaatggcagggagtcagccgacctaaagctcactaggaacctgaggcacagtcattgtaagacagtttttaaagaggtaactttataaaatcagaaatgaattgagtaggaaggggcccctaagagcctaacccaatcctctccttttagagatcaggccaaaacttcacagctaaacttaggacactttctcctccatcccacttctaccatccagctcctaaatcacaaatttctatcgccaaacttttaaaataatttttaaaacaaacttttaatattttacttaactggaactaaatatcgaaccagtcatctttgcttcacataggatttttaataatttattttttaaatttgggggcagtgcaacgaaggggatgttattgcaatagaattttgaagggaaaatgtaacagtaccccaattctaatttatttttccttataagagaaatttaaaatacaaatatagacaccatctaaatttagatctaaaatacatgtttcaagctggtgcagtgttgcacgtctgtacacccagctacttgggaggctgaggcagaaggatggcttgactccaggagttcgaggctggcctgagaaacacagcaagatcccatctctaaaatggacaaatgtatgaatgaaaaaaaaaaaccacatgtgcaaccaagaactaaaaattaaattctgaaaagaaaaaacttctaaaaggagataaaagagtttaaaaaaattctccatgaaaattagagaaaatgtcctatcagattgcagttgctgagtcattttttaataaaaggatgaactgaattatttttttcctacagaaataaccaataatggcaaaagctagtgaacatgctaaatctagaaaagtaaaactgatattctgataggaccccaagcctaatgtcagataatgtcctaaagcataaaaagcctatccaccagaaaggaacaagaaaggcatcaaaacaagggaggcagagccttggggtcacggctcagcctggtcctcagacacacttaagaacctactctgctcccctcttcccttcttctccctcacttttgaggcaacaaactatgctgatccttgttctatgtaaaataattcaacatcgaggtgaaatccaaatcactcaagtacgattaatacaataccctactccttcaactcctccctaaaatgaatgcaagagaaaacaacagttttgttttaacagccacataagcttcacttttgttattgttgttattttctaaggaagagcaagagggtttttgagctgctagcctaaggctagcctggaagacagaatactttcatttctaggtcacccacatacatttatttctggcaaagcactcaagcaaaccatctttgttgaaaattcagacattccccccactgtcttcatcctcctgccaaaggaagctcacacacaggtagagagtggctcattctccttcctatctaccttagatttaatctccactttattgaggaagtcgtcttcaatttcctaattgcaaatgagtactccacctttgtgtttccacagaatactatcccaaccccactgatcataaccagcactgtgatttttttttcaaaacacgcatcaccagaaccatgaaaataaatcaaatcaaaatggaaaaaaaaagcagaatgtagaatatgtagtaatggcagctgttgttttatggctcacctgttcttattctatctgtctgtctgtctgtctatctatctatctatcatctgtgtatcaatcatagatgctgcagtgtgccaccaagattctcgagtacagactgaagtacctgacaactctgtcaggtccctctctgggaatggcccttagccaaagagccacctcacccaaggtcatgctccttcctggagaaaggtgaaggatgatggccacttggattaggatggaaagggtggagaatgtgggaatggacaggaggccaaatgaagaggacttgggaatagattggatatgtatttcccttgtgccttcatagtgcttggcacagcaggcactcagcaaatatttgctgaaaaacagactgaatgaaggcatgaaatttgagggttgcgtttgggttcttggtaccatccacatatctacatctgtttcccttacccccacatttccccagccacagagtgtatgggaccagatagggtggggttgtaagcaggaattataattattttgctcataaataaaaacctggaagatgattttaagtggatgaagttcttttaaactctacagagagaccagtttactttccctttccatagatcacagagaaaccagaaattggttttagctttacttctgagctgtcatgatgatggcaaacatgaactctggttttccactcccatttgagactaaaggttagttaatatctatctggacatctttaggaatgctacctttccttgatacaacatgtcttgaggcaaagaggtagacaagacaactttatgaaaagactccaaagatccttatgatcaagtaacatgaatgttcacagagcatacttggcatgatgtccattcctaagtcttccccaggttaaatggagcctttgtgtttccttggcctacatgtgccattcgttggtggcttaaaaaccctgctctccatatgtgcagaactgtaattcagactttatggctcccagacttgtggcagaggtaaagcaaggtaccgactcaggatggtgcccaagcaattactctccatctcaacaccactcactgtgaattcctttgcttggcacctctgagtgacagaaaatggattgctttcaagactgttcaggggtgggccaactgaaagctgagacttgctcacagacatgaagtggggaagaagagactgggtttcatttttctttgttagaaactaggattcttcagtcttcctggctgccagcttggctcagtttataaatcaaaatggatgcttaaagggaaaaaaatcaaatagtcacaatttttagcagacaatagttaatgtatgcagattccgtggcagggagcctaatgcctgtacccaggaaagacacgcacagctgaagtgacagcagtgacgaggcagacaagatgaggggtgacgagaactcaaaagcagacgagccagcctctgggccagggccttgcgccaagaacacacttcccagtaacctcctctcaacccaaaaaatgagcacaaaaccaaagctctcactggctctcatctaatttataccacagaattaccacaatcatctgtggctttttaaaaattttttatttgtttatttattcatttatttatttatttattttgagacggagtctcactctgttgcccaggctggagtacagtggcgctgtctcggcccactgcaatctccacctcctgggttcaagtgattctcctgcctcagcctcccaagtagctgggattactggttcccactaccatgcccagctaatttttgtagttttagtagagccagggtttcgccatgttggccaggctggtcttgaactcttgacctcaagtgatctgcccaccttggcttcccaaagtgctgggattacaggcatgagtcaccacgcccaatctcatctgtggctttcatacattcatttctgggaggactaacccccctaggtgtgggggctcaaaagatggcgacaaagtatgtacatgcagccaactcttcagcctctccaaatatcccactcctccccacacagcacaatagccttccctatcccctgaaccaagaatggcacctggggctataaacatcattcaaaaccctggtacctgaacactagtccaaggtaaagtttacatacaactccagtaaaaggtgaaaaataaggacccagtggtgattttttcagaaaacaagaggtattcaacttaagcaggattcttatttttggtgttaaaatgcccattaatgaaatgtttttaacttttaaaagttaacaaccatatgtttttgttgttgttgttgtttttgttttgttttgttttggtggggggggggtttatagagtgagattttagtattccatgaaatctgagaatccaggaaaaagtatttttacatacatgaacttagtagaagggtcaataaccctctgaagacacaaaaaaggttcttgatgcaacctggaaaaagttaaatgtgagggtgtatagcccttaataacttaaaatagcctgtgtgaattgtattggaacccacttctctctcctctgggtgccctaagtccctaatgcccttaaaacgcagtcctccaggcacatggctgctacatactagaacagaaagcccctcaaaggcaggaactccaccttaaacctgtttaatcctctaacattgcctgggacagcgtcttgtaaagggtaggtgccaaatcacactggaaaacatcaagtttctaggcctagtgaaccttgtaaattgccacaaatcacaatgaacagagattcctgtgatccatcaggggctacacctgggagaatcttgatagaatttggggaaatgtctacttccgcgtgtcagaagcttaagaaaaaagaggaccataagaatggcttacggtgtcctaactggaggggaaagctatgtgatctgatgtgagtgttttgctcaacaaggttctgtttttgttttcttttccaagtgttaactaagaaaactaggtcactgaaataggccctggaggctcactagagacattagcattctgcatgtcataatcaacagcttaccagaggaaagggtcagggagagaaagatgcatcaagagaaaagcaaggtccagacgctgccctgccaacatcctttcacctctgcctcctcttttcccgagctggtactaactagaggtaggacgatgcaactgttcttggagaaacagggttcatttttaaagatttcaaatcaatagctccctctctaaggactactttatgaggcaactctgtctttcccctcaggacctctggcagactctttgctcactccatcccacctcctagctgcagataaagaagatatattacatcctctcccctggccctgcacagggttgccaaatgcagcccgaagctggcccctattgtctgagatttacaaccaggtgattgggagtgggcagggttggctttggaccacagacacgataggctgggggttgggggaaatagatgataataataataaaaaggcaatgctgcatttcattttgcctaatgtatggcttcaataggaagccagtccacccacagtcctgtctcattcacttaatagacttctgcagcagcagcaggagcagtctcctgttcagaaagaaaaaggaccacactggtgtcatgagaaaaaacaaaggcaaaggaccacagtgttcccagctatcattcttggggtggcagtaacacaaatcgggacccatttggctctttatttgggctgttgatgaataaaccctctcccacggtgtcctcaaacctccagcagttttaattaaaacaaaagaaatgtcagcagggaaaagactggaatataattagggcccaccaaatctaaagtaatatgggggaaaaagactagtaatgaaagggaagctttcaggttcttactgaatccccgctctgttactgacacaaaaatcaatttcaataggctttagttgtatctgaacgggaacacagtgacagatgaaatttagtgagcaacttactggagtcataatgattcccacggaaaaaaaaaaaaagactacaatgagcactcccagccaaatgtctcctctgtaagaatgtgtatgtttattatacatacacataacatgtatgttggtaaaattatatctaaaacttatatacctaaaacatatataggctgagtgtggtggctcatgcctataattctagtgctttgagaggccaaggcaggaggatcacttgcagccaggaactcgagaccagcctgagcaatatagtgagaccccgtctctataaaaaatctaaaaattagccagacctagtggcatgcacctgtagtcccagctactctgccgaggtgggaggatcacttgagcccaggagtttgaggctgcagtatgctcttgtatgtacttgcactccttttaaacttaaactagatctacctagaagtaaacctaccatccccattgacgtcatctgactggagacagcaacattctttaacagtcccattacaaaaggagaacctggtccatattggttaatagcagaagacccagatctccgcaaaggctgaaaatatctctccccctccaacagatgtcttctgtgtcagcacagactgcatttgcgattgtgatttctgagcaaagacctgcatattgttctctgggaaggagggtgagaggacaaaaaggacattagaaaactgaaagttgttttataaatgcaggatggctcttacatattcataatctttcaaaaaaattcataaaattcaaaaaaattgaattttatgattgtgccactgcactccaacctgggggacagagtgagatcctatctctaaaaaaaaaaaaattaaaaatgataatattgtatatatacaaatatactacattgtaaatatatacatatggaggagagagaatttaaaaactagtttttttttaatcccaaaaaatgtaaattctccctctcaaaccctttaaaacagtggttttcagcggggcaactttgcttcccaggggacatctgatgttgtctggagacatcttttgattgttatgactgcagctactgacaattagtgggtagaggtcagggatgctactaaatcttcataatgcacaggacaccacccttccccaacaagcaataattgggtctaaaatgtcaatggagtcaaggttgagaaaccatgttttaaaagaatttgacatttcataggtgctcaatgaatgctggagtctatgaaatgtcagattctgcaataggcactaatactacaaagatcaaatgataaggtcttgacctcagggatctcccatggcttaagggaggcacagcagacgacgaattgttctttccttgcttagtagaatcttacatgtaaaatcttttcttaaatcccaaaaatgtatgttctttaagaacacaggcaatactatacccagtgacttctgagaccacttttcaactggcttttgagtggccaattctaagactttcccatttaagcagcatattctaaatttttaaaaaacctaatgaagtattattaggactaaatggaatttggtttattataactggacacaattctggctaattatgttaattttagaaagaatatcctattttcattttaaaacaatatttacatcttaataactcttcatactacgtgttctttccttcttaaaggtttacttatagttttaagttatcaggtactcaattcagaaatatattattttgtttgattaaaatataagtcatgtgaagttttaagctaaaaatgtaacagtcaatgacaagagaataaaggtgtttgcctttatccaacataagttcttcaaatgcagggatataggaatcttgcaattgctgtaagcgatctgtttccaagaaataaggaaagcaaaattcaattttttagaaaaaataaatgagcagcattattctatatcactgacaccattcaccaccttttagatacttaaggattaaagaactcaagatggtcaaagaataacatccaaatatagactctccacagtgtatgaaagaaataattatggcctattaattgttccacctgcaatagcagaagacccagatctccgcaaaggctgaaaatatctctccccctccaacagatgtcttctgtgtcagcacagactgcatttgcgattgtgatttctgagcaaagacctgcatattacaaaaaggacattagaaaactgaaagttgttttataaatgcaggatggctcttacatattcataatccttcaaagtgatggccatcacagactacagcaatttgtcagcaaacacatccatccctgggaagctagttgctgggagtaagtagtcaagtgcctctcagaaacctgtactctcccatcaggacaataatgctgagaacacttttgtctgaaatcttgggggaggggcgggggtgaaatatgatgacacactgagaaagaacaagggctgttttaagtaaatatgatctgccccaagctctgggtaggcctgaatgggagggtagctgactagttagtaaatgcattgatttatagttaaatttagctgcgatccaactgtgacctatcaggtagcttcgtctcaaggagggtgagttttccctgactccagtgaaattcttctttccaccacattttcatgcctccagtttaggtcgactcatcagggatcgtgagacgggtaagcacagcatcttgctgactcttggaaatcttctcttctcgagcaggtatttcacatagtctaggagagaattgactatctgtagctagagctctgcaggccctatagaggacgtggaggttacgaggaaaggctttgaaagaggtatgaggttcccttggactaattagtgggtctagagttagaacctctaactgtgtagaacagatacaaaacaattagctcactaggttgcagtaaggattaaattacatgtgtagatacacttggtagagtggctgggtaaatggtgttatcacagtgcttttagtgtgattgaggttccatttctgttctcttctcctactattcccccccagtccccgactcgcccacattgcaggtctagtttccttctccctttcctccaatgtaccatggggactttacatgtctcttccttctgccacacttgaatgctcgctgccttcaggtcttgacttgaatgggtcaaagagtctcaaatgactcttctccaatagtctttttctggctgctatatctaaaacttcaactccactttaactcttattatcctccttccctgctttacagatcatctaacaaactatacagtttatttatttatcatgagtatcgggcatttcctgctctaggagggaaatgtcttgagggcagcggcttctctttgtcttgttcactattctgtcttcagtagcagatcagtgcccgcatggtgggtactcaatcaatatgtgctgtatgaatgaattcctaacctctttgtggaaacacttttccaagtccttctgtttctttttttttcttttctttttttttttggagatagagttctgctcttgttgcccagtttggagtgcaacggcacgatcttggctcaccgcaacctccacctcccagtttcaagagattctcctgcctcagcctcccgagtagctgggattacaggtgcgcaccaccacacccagttaattttgtacttttagtagagacagggtttcttcatgttagtcaggctggtctcaaactcccgacctcaggtgatccaactgcctcagcctcccaaagtgctgggattacagcacttctgttctctttttaaaaattcatagcacttcttacttgaaggcataacaactctgatagaacaagtactgttatcagactttaaaactgaggctcaaaaaacccaagatttttccaggttgtattttcctttcatattggccttgcatataagtcaagcaaacaataagatattgtctctctcttttaaaattctatttaaattctctctaaagaataaagaacagaagtgtaaattaaaatgcctgataatcagaatatattttccacctaggaagatttatttctgtaaatatatatgctttatttaaatattagcaatataaagtatagaagcagaggtaactgcatctctaagatatatttctgctagcagcagccaacagatctaccttacaggtagcagttaagaatgaggctgtgctattcacaatagcaaagacttggaaccaacccaaatgtccatcgatgatagactggattaagaaaatgtggcacatatacaccatggaatactatgcagccataaaaaaggatgagttcaagtcctttgtagggacatggatgaagctggaaaccatcattctcagcaagctattgcaaggacaaaaaaccaaacaccacatgttctcactcaggtgggaattgaacaatgagaacacttggacacaggaaggggaacatcacacaccggggcctgttgtggggtggggggaagggggagggatagcattaggagatacacctaatgtaaatgacaagttaatgggtgcagcacaccaacatggcacatgtatatatatgtaacaaacctgtatgttgtgcatttgtaccctagaacttaaattaaaaaaaaaaaaaagaatgaggctgtgctttttgaaccaaagagaacatttgatcctctttccctgacataaatatggaaagacggaaaatttgcctaaactgttaagacctcagtcagctaaggacacctgcacaaaacacgaaaattgccttccttcctcctcttcctcattttcaattgtgaaataggtgtaggcatatggtcaaagactcataagcaggatctcttctaacagcacctgatctgaaaatatcaagtctaatttcaacctagttgccagtatctgatttcaatcacattggttgggtcttaggtacttgcctaggatccaaaagatcagtatcaatctgcatttttttttttttatcatttaactcagcagtcttgtgtttgcaacattaatggtttatttcactggtggcttctgtctgcatgagggacattaagaaaataaaattggcgctcatataagcaaaataactgaattgctggatttagtcattaaaatatacctcatgatatcccaggaactcttaaccagaaaatctgtcttagatttaataaaccactgatggtaatttaatgccaataataacacaatatttattaaccactgatgagcattcaacggttcatgggcttgagtactgaaaaatatgtagcaattatacatatgatgctttaaaagattgaattatacttcttaaacatgttatttctgtttttacatttttaaacataaaaaaatctttttgagaagaatacattttaggaaacaaattcagaacccataaaaaaatctttggaaataataaatgcagtggagctaaaggagtaaaaatacataagttctatttagaatttgatcagttttcaatttttcaataaggctctaggcaaatctttttagctctcatggttttcatgaagaagagaaatagaaatacttgttatgcctgttttcccttccagaactgaaatgcaaacaggagtgtccggataaggtgagttctttcgaactccactttcagtggagttgtctaaccttgacaactcctgcccagggattcacaacatatcataaatacatacactattacactattaaggaaaagggcagccaataaaaatttcctgaaagggcatcatttctgtaagttgaaatggatttcagtgccctttgatatgtggtcaagtttttacaaagaaaggtcttatgaagaaaatctaatttcacataaaatgaacataatatttatagtaaattaaaaaaaaaaaacaccttcttatccaactcacaagccacattgttacacaactccaaaaagcacccttcccattgttttctataaaagtggcatcttctggggttgaacctgttggtagccctgttaattaaaagttaaattcatagactccttactgagcagctattatatataaagcactgtcttcatttctgagggacctgagtcttaagtcgattttattattaaattatttacatttctcacacaacaaatttagcttcatttttaatggattttactcctagaggaaggtttataaaaatatgtatttttatttttccctgttggttccattttcagaggctttctccaaatcaattatggccaagatcaactcatggcatcttatttgggggaagacaccactaaaagaaaatcttcaatatatgtggttttaggaaacataataattaaagaaaaatcgtgagaaaagaaatccaccgttattaactcattgagaaagaaccatcgatgttagatccagagtattcttccttaatttactttgtaaggtccttcgagaaaaagctcaagtgcagaaaacaattgaagaggactgcaattttgttttttttagagacagaaatagttttttttttttttttttaagacagagtctcgctctgtcgcccgccggggtgggaatgcaggcgtgcgatctcggctcactgcaagctccgcctcccgggttcacaccactctcctgcctcagcctcccgagtagctgggactacaggcgcccgccaccacgcccggctaattttttgtattttttagtagagacggggtttcaccatgttagccaggatggtctcgatcttctgacctcgtgatccacccacctcggcctcccaaagtgctgggattacaggcgtgagccactgcgcccggccagaaataaaattttaactttgtgcttacttagtgctatactattctcaagagagaactcgtttactcaaaaaaatcaggattctaatacttctcaaacatactcacttattctgggggaaaaaaccacttttctcaaagagcttaataaatgatagcaaaaaagggatttgctgcattccaatttattttgtactggctaatacattagccagtacatacttttcatctggtcacatactatttctaccatggctttaagtaaatatactattaagaaaactatcatgtttttgaactcgaaatttaatccatcggcctctatgttacaaaggtgagatagaaatgaacttcattattgtatttcattaattgacacacccatatttgatatactttattagaaaaatcaactcaatagtgataggatgacaacttactgcttctctttaaatattatatatttattattaaaattatttaaatttaataattttaataaggagtatatcatagggcttgtctagatttcaacaaaaggcttgaaattactacaagattatgaaaaaggagcaatgaagctactgaaaaagatttgtataaacttcataactgctattttgcatttaactataccaataatgattcatgagcaatttcttcctggatgccaatactcttagaaaccctcaagaaatacagtattaaagcaaatgattggaaaaaagaagactgaataaaggatgcagtagttcagacgtgttgtacttctatctccattgtgtataaaggtgccagctgtgtagggacttgggctctataaaacaaagactttgaagtttcattcttcaacactcaacttaggtaaggatgtaattaaaacaaattccaccacctaaatcaaagttagagaatttagagaatgctttgagcatgatctgaaatgatttgataaacagcacaattgggtaaaactgtcaagacattcatagcttcaggaatgggctgataaaaaaacatgtaataacatacaaatacatgaatgtcaccagaacagctgatcaccttatcatactaaaaataaaagaaacaacatttaaaccataaatttttaaattttattataaagtagatttgtgaaggtgattaaagggccagagttacccaggaaggttgggacatctttttaagatactttaacaataaaaaaaaaaaaaaatagatcctcaagattttggtataatcaaggtgttaccattatcaaatggaagaggggaagaatagattgattttaaaaatctgtgtactaatttttacagtttacatatttcttttctatagatcatctcatttgcttctggtaactttcctttgtccaagaatttactcactactgaatgcctcaaatgcaggtctgaataaaatgctatttcttgccctcatggaacttataatcatgactttcttttgttatacattttcggtattatgactattttgatttaagtaaatcaacatcaaatcctattggaaataagagagagagaaagagagagaaacagacagacagacagacagacttgggggaggggagcagatgaagaacggaagtagatgcttgtgtagggcagccttgaaaacacacaggaaggaaagcaaagaaggcctggagggtgcagcttcagatagagggaaaggagctatgtgtgagtgagggaggaagacgagtgtgctgcaggagagggtgagaaaggttggattgttctgccttattccctgagcctaatttgcttagatagaatcccaaagccattctcaagtcaaagaaaaagatacacctttgagacaacagtggaaactaagatggctccacaaccatgagtaataaattagatcccactgacacttgggtagagaaccagataaaaaaaaaaaaatgcctttctattcatacttcaaaacaaaacagattctaatcacctcagcaaaaataggagggctggaaataatagatagtctgtaagatttgtagctggtaaatgaaaaattattattaatagctaatatctactatgtcaggttctgttataagcattttacacacattaactcatcacagcccattatgctgttaccctcattttacagataaggaaacgcacaaagaagttagatgacttgttgaaagtatctattatttaacataggcagcatctcatttgacttctgcattttctttattgcttccttttagcaaacaaaaaaaatatttctaagagctttcattagattgaaaatattttcagagttcacttacaatcttagtctttctagcactagtttttccctcaagatcttgagttttcagctattatttctcaaaatggagttttcagaaggcaggcggtgacttcagtctaggacatacaaggtttgcaggaggctggccgcttgagaagttgatattatgatgcgcagatggccaaaagttccacagagcaaccaactcagactgggctgaacagaaatggtagcaaaagtaggactttaattcagtcctaaaagatcagaagaataagactggggggaagacaaggaaggacatttcaagcaacaagtaaaggcactggccaatgtatgaggaagggcttaagtctgtgtatggctatgacatcacatgtgtgtagaaaatagcaggatatgcaattggagaagacaaagtcccaatgaagaacagcttcctgtgtcacgtaaggagtacgatgttaaagagtttacacttgggagttacaagatcagactggattccagaaaggtcaccctgtcaccatcttccccactccttgcccaccttcctacccgctaccactcagatccaggattgcagttcatctgtcctctaccaagatttggagatgattaatccagtcaggatctgaaacaaaggctggcagtgaaaagagaatagatccaaagaataaataagtagaatcaacaggacatgtagatggtgttttggagaattgaaagagaaacagaagtcctccaggaagataacatctctggcttgtacaatctaggtgggtaagagtgccattctttgagacagaagactcgggaaaacatgaagaaggcaggaagtgacttcagtcaaggacataacaaggttttcgggggccgggtagacatccagacagatgtgtccattagtccagtggagaagactgggcttcaggaggtcaagtcagtctacagagacagaaggacttgcaatgaaccccaagaaaaaacaaccagcgggtgggaaaaaagaaagcagcaatatgactgcaaatcaaggaaagagaaagtttcaggaaggaggatgtgatgagtttcaaaaaggagggtatggtcagagccagtgctacagaagaccaagtgaaataaagactaaaaagagctcattcaatctggcaattatgaagcccctgggaccttacacagcaatgcagggacagacatcagtttgtatagagtgaaggaaaaaatgggaggtgactatgtggaggcaaagagggtagaaaaaagttgcttggtctgaaaagagatgaaactagtcctgaggtctcgctgaagatgactgcaggctgggaggaaaggggcaattctgggcaagggaggagacaacagaaacagcaggaggagtcctctcacacagagggaaaagctttacattgagttaggatgaaagaaggtaagaatgtgggaagaagatgagtttgagaagaaaggcagagggagacctgtgggatatttacccaataagggatacctgtccaatggctccagtttttctaaaaggcatagaagaaggtcacctgtggagaacaatgaaggcaggggcagcggaagggaggagaggagagtggtggagattgggagcaactattccagggaaaacaggagaaggaactgagcaggtacatacacagttgattattaagcagtgctgagttgagctgtgcagcccaaatgcagaaaaataaacagctagactgaccttagggaaggggtctgcaaggtggatattatggaagaacaaaggataaaggagatagtacatgttggctaaaaatgattaaactaagaaatcatgaggcccaaggctggagagacaagttattaaagtttcatggggactgagagactgacaaaagacccgagggcttagtcaacatcaaagaacaggtgtgtagggtgtgagggagtacaggctggaagcatcaaaggctgtggtctaagattgggatgctgtacatttaagattttaaaagcaaaacagacctgggtcataaaaagtccaggttgtgaataataagagtggggtgtcattccaggtaatagcaatataactatagtatcaatattataccattttacaagtgagacaaggactagatgacttattcaacatcacagctggttaatggcaaggctaaagtttcaatccaagtctttgctgccaagtcttattgaccttgtcatacaaaatcattttacttggtacctttttctttcagcctttgaataagaaataataaaatggtgattttgctttcagactaggacgacgttataaatgaaagaaagctatcaatctgacttaaaatgcaagtgaaagtaacggttttattttcagaactctggttattacccatagtgtaggagcttatgaaattctgttaaagtgtatctttgcatactgttttcttattatagaaacattaaaagtaactagctattgaacatggcaacaaaaatagttaagaaccactttatctcataaaacataaatttcagcctccagtggcatgtctgctattatttcataattctgggtcccactccctattaagtccaaggctgtgtcaggatgatttaggaagataaagcaatgttacaccacatattttcaacccaggtacctttaggcatacatccaaatgtgaatatcagatctgtacaaatgtaaatggagttgtcattttctttgattaagaatcactcaggctctccatcaccattactagacaagacagagtggcctgctgccaacttaagggggctggagggatggggcagtggtgtggaaatggcaaattaggggcctcctgcagtgagttactgctcaccagtcctgggcagcccttaggacattatacattaagacacatattcaaatggaatgatggtggtacacatcagcataattcacctcaaataattcattacaaaaagacaaatgaacaaatgtcaaatttgctgcctatgatattagctattactgtcttgtacgatatatattaagtgaggagcctgcaggaaagcatatacagttattccatagctatttatttcatccactcttgaggcaagtagcgtctttccctgtcagttggaaccaatccaacccacccaacccaacctacctagactccctaactgttcctagctatcctggtttcttactgagctagtaactaatagtttgcttttactgtatatcaacttgtcaggctaaggttttacatgattactatttaatccccacattgcccatgtgaagtaggtgctactaccacccccattatactaatgaagagagcaaagcacagtcccaaagtcagccagctggtaaggccaagctcttagcgatgcctgcatgcttctgcctttgttactccgcctttcaaatttcacccaacttctgctctatagcttgatggcacatgttcaggaagaattcccatttacttcagtccatactgattactcccttctcagaagtagctcatccatacctggatggaagctttgctttctggtaatgccagcaccctctaattttcatgggacaggccttggagagactgacccagtcttgtttgcctgggaaaatggtgttgatggatggacagcttctttgtggtagtgagatttgggttaaatagctccagtaccttaaaaattccaagatgtaacctaagccctagtcccccaaaatattcagaaacagggattcctagaaatctaaatcatgccctttaaaaatttcgtgtccaaacctgatagacttaaaaaattagaaatgaagaatattagagacattcatgtccactgatattaaccccttccatcctacttctctaaagccatgcagctagctcagagaaaagtaggaactccaactccttcagctgtgggaggtgggaacaacacaggccctgtggtcagataccttcagttctgtcactcactggctgtgtgaccatgaggaaatcattcagatctctttagatctcagtttccacactaaaatcagagaaatgatacttaaggccgttataagaactaaaatagctaatgtgaaagttttgtaaaccatatagtgctctaaaaatgctacaaacttccattattattctacatttgggatttctgactttcatgacagagatttgtttttatcttgcaatcctctgctgcaacaattatcaattgatggtgtcccagaccactgtcaaaatacagtgtacattattcaaagaccccaaataccaaatggtcacaagcctagtgtgttattatgtctgaaagtgtttgagtgaccaaagaatgactgaagctctcatctaaacagcagaaggaaaaccagaataacccaacaaaaggtatcatgtacacacatcaactaccagacaggttaaaggtgggcaacatcctatgagagatgagactaaattaaagcacatgttggaacctgcctgtggtctgggaagaacagcagatacagacagcagagaacagcaggaacagacaacagagaccgggacacagatatgagaacttcctaaagaaggaagaagggatgagtccattaaaagatgacaatttagaatgtcaagagtcctctggtgtgttctaaaatgaggctggctacttgtgttgttagaggcctgagatgatgtctacatgtttgggtaatgatcttggatgatatgaactgatagctaggcccagaagtaagaaacaggtactgccataatagttatcaaccttcctgccacagtcttgggatgagttcctctgtcctgggcaagttggctggggctgaagcacagagcaagggccattgcaaggtgctccttattaggacatttttcatctaacttagacccacagactatgtgcacttagttggggcctaattatcaagaacctgtattccacacatacactatttgatacttaatataaataatgtacccaattttatttagcaaaactagcaaaacttgtactcaaaatgaatgttgtctctaggcactaataccattgatgtttaaatcattctgaaattacctacatcacatccctttgaatatagaaaaataatatggctcatctttgttaaaaagtatatttaattttttacatttaatatcattctaaacgggtaaggaaggtgaaagattgagttggataaaactgttagaaagtaaatatgataacagaccaaaaagaaattttgtggtttgtgtatttcatcaccaaaagaaagtagctcccaaatttatagggcaattgcaacatttttgaaggaaatacgtgcaattctctaaggtaaatgttcatttgcatagataaaatctggtatgcgtgtgtgtgtgtgtgtgcgtgtgtgtgtgtcatatctctttacttaacagccaaaacaatctcctatgttaccttcagccattgtttcccctcccctataaatacatcttcattgcaagcagtttgtgggtgagaaaatgcctccattttacctatgttcaccagttagttacaacctgttgggcatacagtaggtgctaaataaatgactgacttttaagcctcaaaacttaactatagataagtgttccgaacacaagaagtagaaaactcaagctatatgggcagccgatgaaaattaactgtgcacttatataggcagatgtaattaaaaatgaggggaggagaagagaggaataaacaaaaccaccccaaaaactcatatcgtgtgcacgacattatatctgaaagtgtcataaatttccattttatagcattaggaagctgccttatgttaattcaaggtgggtaacatgcatattaaaatatagctgtgctatctctgcattgttctcccagcttagaaggtaaaatactgaagcaaacatgtggcctaccagtgggaattaaattagagcgatattttacatcattgcatagcattggttctttgacattcacaatgttaactttgatataagaaatcagctaggttagttttatctgtttatctgggagaaacttaatctgggttttgtaagaaaatcatggggtagtggaatggggagagcactcggttcctggtgacaccatctaaatcttgaagaacataaaaataaacagctaggatttcaccatgtaagacaggaaaaatgggcacttcagaaaatttaaatggagtaggggtgtagagaagcatttcatgttttagaatgcatagttttttggggccgaaggaaaccactcttagtcaactttaagaaataactagggccgggcacagtggctcgtgcctgtaattccagccctttgggaggccgaggcgagtggatcacgaggtcaggagttcgagaccatcctggccaacacggtgaaacctcgtctttactaaaggtaccaaaaaaaaaaaaattagccgggcgtggtggcaggtgcctatagtcccagctgcttgggaggttgaggcaggagaatggcgtgaacccaggaggcggaacttgcagtgagccgagatcacaccactgcactccagcctgggcaacaaagcaagactgtctcaaaaaaaaaaaaaagaaataactaaagtatctgggaatattaaaccatgacttcaaagctgtccctcttgcagcctcagtgaggtgcgaaaggtctctgatttcaggcacccctcactctggcttaattctttcactctcacatatggttgtctgataaatccagctaaaagcaaaacctgtgatgaggtctcaacttgctcctctgcctcccaaccctccctttaagcttgtgaccaaattgctgaattcacctcctttctcatagatctgcctgaaaaaaaaaagaaaagaaatcagaagacaggtcccccccccaccccacccccagttatctcaaatgtcacggctaggaagtttaggctgcatggaccatcaagaccctacaataaattgaagtaacaaacatattaccttctcccgaatcctctctgaacagatcaccgtttctctaccctccccaagggaaactctgatcaaacaaatctagccactctttcccttaaagagcaaaactcacaaaattaagttaaaaattcattcttgaaggttggaaaacagcaggaaatgtctttattctacatattaaaacttccagagaaatcaataaaacaaagaatgtaactagctgtccttcaagagtttaaataaaaacacacaactagcaaaattatgaagtgtgtctttcaggatccatttttctggacatgactcagacaaccagccatttaaagccctctttacatttagtgtttttaatatctgctcttaaattcttaattcatcccaaagtgcaaatgattaatattaaatttccttttttcttaagaatgtttattttagcaagaaaatagtaacttccagtacttgtggaacaacagaacaaagaccttccatacctcatttatattgatcttaatgtagcgtgtctattactaaagacattttacagaataaaaccccaaatagtcttaaaaagataatttgattttcttaaggaccattctccaaattcttcggaccccaaagaccacaccacactcttcctctatcaggctgctacaagatgaaggaatgatcaactaatttacagaattttaggctttacctagagcagtggagaatgcagtttttagagttttaatatttgctcacccttccccatataaagcagagtctcaaatataaacccagatttcctgcctgcaactgtaaattcagtttctggatatacatcaccaagataaactgttagatacaagcatcacccagatgttttgtagtattcatattaataatcctataagcctctctttggggcagaaaacaatgatcattactgatccaatttccattactggatgaagactcccaactactaatacagatacatgtgtctatccctccctttacagctaacatataagggctaaatggaaatcctagtagtacagcatttatctatcattttgcaataatctgtgggcagataacacaatagcgactcgttcctttaattcaatttcataatcagaagtgatatgcaaaatataagtacagaaaagctattttcagaaaatatgatctgatttttcacagtttttgaataagcaagataaacgttataatttggagtatggtaatggctttgggaattgtgttctgagaagtaaaataaaaagggatttagcatgtagattaatcatatggcttttccaaagattcaaaattttgagaaagccatttttaacatatctgaaaatcacttagaattttcagtgccatcctagcctcttcctctaattttggttcataaccacatcttattttgctggattgcaatggactttgaggttgcaatatgttttatctgatgctgattcaatttagacaataaaggattgaagttcttgaaagaaacatctggccaacaaaacctgatatgagcagagaaactattaatcattactttaggttatggaaaatcccacattcaaatgaaccaaaaagattcttgaaaatctatccctctactccccatgaggaaacagtagatttttctaaagctccctgggtgacaaatgctgtctggttacaaccatcttagctagagctaagatggtttcagaatcaaactacaaatcattttgaaagtttcctgttttgcaaactccggatataagctaaagcgatttttctattcactacctagacatcacctgctcatcaacagattttaaagcatcttgcagaggcaaatttccaaaaaaggtagcctaagtacttatccactataccacctcttcaaaagcagcagagaataaatacaaagttgtctgattagtcagtaaacaaaatgaattcaagctgaggtgcctgaacacgggcaaaggaatgttttgtgccacaggcccaaaagaacaaagctcattttgttgcacattatcaggtgtcatggttcatatcctggagtgcctttagagaccccaggtgtggctgctgctcagtgtttcagaaacattcttctgtttggaaggacattgaagagccgtaaatgccacaacagtttctctactttctaggccctctatggttttgaaattcatcccatctccttggatttatattgattgtgggtatggcttagtggtgatgggggaaggggtctagttctccaggaggaactcaaaggaaggcagttgtatagaaccacagaaacatatagaattatagaataaagtattctgagcagctaataagacgaccatttactactttgccacacagagggaaaagaaggaaaacagctcccaacaaggaaaaaaaaaataagtacccaatggtcctcttccctcttttgagcatggctgttgtttcggggtttttccaagccttgttttttttcatcaattattttctttgatgcctacttcactatgcatgggaacagaaagcaaactattagaaattttcacactgccagaagttcaacaaatgagtctacaattcccaaggcccagggcctagagaaataccagctgaaattaaaataaggagaaagagaatcgataaagaggttaattagcttatgtggtacagtcgagggaggcagagcattttgctgggaaatagccaggatgtcccaatggggagatgcaatcttcttaaccaaacgagatgcctggggaactcttttctccaatacttcatgaacactaaaaaacaaagccacagatacaaaggacagagtgctggccatgaagaatcatggggagctacttcataaacactttaggaaatactgttttgccctccagccaatttcctctaagcttcaaggtcagaaagaactttacaaagggtgactagctgaggagtcatccaatttacttcctactgacccaaaagagaagccatttattaccactggcaggaatggatgaattctgaccatccccattctgacttgggagtttctttttgactgcagtagggtatttgagtttgaggccagggatcaaaataaactgaatgctcactcaggacagaagagtaacactggccccccatgaagagagtcctctgcacttccccaggggtgagtgtgtgactgtatattttcagtttggtataaaaacatcaggagcagaataactcacctgctgagagacaggtctacttccctaggtctgaacatcctttccatctttctttaaacttaaaaagcacctattaagaactgtttactctggttttaaagtggaactgacatgacaagcggctgcacagaaacaggccgagagaggaacaatgaagtcatgaaggaggcagccctgggcccatttcatctcaaaagaagactgctcaccactgtatgctactctgccaaggtcctagagacttagaagaagcaaggaaccatgctgtagaaccagggcaggcggtactctagaactgggaattcattttccacaggcttaatgtaaaaagaggtttaaatgattccatgtaactggccatcatggcagcatgcaaatttacttagcattacaggagtccaaatttcagctctaaccctaccagacatgtgaccctgacactttaaccactctcagcttcagtcacctcatctgagaataacatctccccatctcagataggaactgggacagagtctttgtgaaatacaaagcagatgttcatgacataataactattgctgttgctgtagaccttgtttgatagtatttatgctcatcacagcactctgtccttgtgatctggcttctcagaatggaaaacaacattctaacgtcaataaaagcatgaagaacatgtcaggtacttgagaacccatgccactttcaaagcctagctggggttcccaccagcaacaaagagccaaaagcactgtccgccaagatccccttctcttgggacatcaacaccccattcatctttgccataaactaagccacacttgatgtgactttctggagagcaggctactttttcatcccagctcagattctgatggcattacactgcccgtggggatggaattccacacatgcggacagagacacagcttctcaaaatccctcaatatcaaactgctgttgagattctgatttcattgctgatgaatctcattcctgaggtacaagtcacagagccttttatggttcctgcatttggagattgtccctagccactacagacaaacacatcatcttgtgcttagagactggtgcttttgtccctcatcttcatttttccaccacagtgatgatggatgccctgcgatctcatgaagaataatgacagcaaaatgaaaagcgtatgtgtcatctctgggaagacacgtgggcagtaaaatatagctgtaccaaggctttgtggccataactcctaatatctctgtgcaattggaaatgatttttaaaaacctttatgattaatattttatctagaactcctaccactgtggaggaatagaacaaagaaaatgcacatcacaaagggccttcagcatcaataagtaagaaatctttaaagagctacactatctcactaatgatttccctactgacctgaatcaactttcagagagaaaatgcaagtaataaaggcctaggagatgggaggatgactcatttgtttcttcttctagctgttttctaattcccctcacctttttccaatgccccatgtcaatcaaagaaaggaatgccaacaggctctcctcacaactgcctgtagcaactacataaggaacccacgagaccagtaaagaaaagccaagtccagactcctcttggtcagggtcagccaagtttcaacttaaaatagataaaaaggaagctcttccaagtcaggcccaatttaggacttcgctccatttcttccagggacaccatgccaggacctgccctccttctgcccactccacctggttcccataatttttcttcctgttcacttgaccctctaagaaactctggaagtggggtttatcctattggtgaagtatcagctaagacaattcaatgatgataatctcattataatcccagtaaccaatttaattaatttactccttggactgctcagaagttcagtctctctcatgtacacacataaaataatcagacacatgtgcgcgcacacacacgcaaacacgccactgaaatttgacttctccttacaaatattcatgggtctatcaaccttgtagtgtgctgtaataatctacattttgtgattttcctgtgcacagcttacatcccacaaagtcaaggacagtgtgttttatataagagagagagagagcatgcacacgagagagagagagtgtatgtgtgtgtgtatatggcacatagtgtgtactttataaatgttgggggaataaatctcaaacctggactttacattcaggcagagtgttgacaaaaagttggaaggacagacctaatatttaaacataacctttaaccagaaggcagccacatgaatctttcaagagtcgccattaggaacgcacccacggctgatgggataagactcaggttttagggttaagtaagagtcagcagttgtctattggcaattgataactattcctgaacactctgcctggtggcctagaagctgacccctcacaggagtccagtcaggaccactgaagatatgaggagcctctaacactaagcccttgaacaaagaaggtggaaaggattccagtgccttacattttgcttcaccctcacgttggaaagaccttaacactcacaaatggaaagaaataacccaatagattactatacaaaaagagggaggagaaaacaaattgcctggctaatctcatggccaacggtaaagaattaatagaaattaaggcaaaaaactggaaagtggtatccacaactgaaaagcacaacctcttaataagccaggcaccctttataatatcatggaatcataattctgaactctgtcattgtctgtttcattgtccttgtctgtccctcacccagtgctcttcaagagatccattacatccctcttcttgccctcatttactaaagccctcaaggtattaatctgtagtgcagagcttggctgttgcgtgccatataagaggatgtgacaatcctttgcttgtccaacctttagttagccttctgaatctcctcctaggcccatctatgcacttccttgtaaaatccagttttagcaaaagaaccctgctaagtcagtttagctagaaccacctatcctcaatagctgataatccctgttatctgattatgttcctcatcctccaccatgccccaggtgatgtctgatcacccgggcttgttttcagcaagagtcctgttaggttgcttagccagaatcccccttaatcctgaagtttcctcttagtaggtttccacctgctaacccccacacagcacctaggctataaattcccacttgctcaagctgtattcaaaattgaggccattatttctctcccgctgcaagatgctattgcaatggttcctgtgcctctcccaatgaccttgaataaagtctgccttactgtgcttttcccagtgtcactgaataacttttttccctaacagatgaaaacctggggaaatggcatcccttcccatccccacctcctccccaagagacacacacattttaatgaaagcattaatttccaagaggggaaggatgtgttgatttggccggggtggatggagagagtgactagggtacagaggctcccataattaatagcatctttgtactatgagttctgtggagctaaattgacatgctcttgagaaaacaaggggtttgagctcagctcacaatggtggctgcaccatctggtttccaatgagttgtttttagctaaattttcagttaggctcattaaaacctaagacacttcagtgtttagtttaaacaaatgggctcacacagcccattttaaaaactcaatagaaccttcctttcctttaatggctaaaatgctttacaaaattccttggggtcaaataggatgtttttccaaagctagttgtttaaagctattcctaagtaacttctcacaagataacgagggttattaccgaaatattgcaaattttattttcaaatattttcctaaagtttctcttatataaaggtttatcttacattaggtattttaataaaaacctatcaccactagcaacagattacttaaaagcttatgagtcacatttcaaagagattttgtcggctctcctttcttcctctatcaaaagcctactgtgtggaaggattgaggtcctctgcctggtctccagcctcagctttggtgccatgcctctcctcccaccttcacccatacaaggctactctcttgccctttgtggctatagcatttctcccacccttctatactatgccacatctttacacctttgctcatgctgattgccttccctttttttgcttagtaaacagacatacatattttatgatccagcccaagcattactttctgtgttcaagtcttcttgatatttctccccaagcaaaatcgattgcttcctcttctccttatacataattttagtcacaacttcccacttacttatttgcatgcctgtcttccctactaaatgtcaatctactttcaaacaagaaccccagcaggaatgataattcctggtaagtaatcaagaaatgtttgttggttggatggatggatgatggatggatggataaatgaatatcatttttgataaaatcaaggcaaacagccatgtcataattccgagtgtaaagaaatctattttaatttcctgtcttcctgtacagagtatgacttccttgtataaatatgactcattcattcaacaactgagcacccaatcctatgggtcattgcttcaggtggtgtggctacagcaatgggcgaggcaccctcttctaatgaagtttgaacaaataaataaacaaatgcagaccatttcagataatgatgtgtgttattcagagaatcaaacaggagagaaaacacaagggctggatggtttgccgggaggagacacaaaactttggtttgggtagaaaaatcctctgtgaagaggtgacatttgagctgtttcctggataacaagacgccaggttttatgaacaactaggatcaaatatgaatactattatttataaccttttcaatcctaacccagcagcggggtcagtggttagccactctgggggtcactgggagcaagatagtgacagtggcctcactctgctcacctctccaagggagttttcacaactgtgctgatgaaccatgctagagtgagggcagactgacctagacctagaggcttaccttcccttcgttttgtttagaaaaactgtctgctcagtttgatttcactgacctttttaataaaacaaccagatttagtgtttgcctgtcctcatgtacccctcccatcacatcacaccccaccccaccccactccacctcctctgtgatatcagcctgaatgtcattcttcatcactttcatctgaaagtgattagattgacagaaagaacaaaagctggtgtttcacatctcaatttgtcttgtcccccagagtccataaatcaaacaaaaattctacacagctccttaaaatactctgaaagataaaagatcaatgtctggaagcaacttctttcaggcattcagaacagaagcaacaagtgagaaataaagctgcccattcctaatcttggagtagtttttcctggcttctcaagaggagtggcatttgcaaagctctgtggttaaagcactgtggaaagcagttgtattaatatacttatgaagaactgcaaaaaaatgccagttcgttttttactaagcagtcagttgcctaccagaaaaaattcttcccttcttccttgatgagggaacctcaattttgttctaatatccatgcctcaataaaaccacactatttctggtttttgtttaaatcctggtctatcctgataatcccagccctcttgcaagtgactggtttaaggggtggttgtgacctgtatgggtcaatgaagtaggaggcaaaaatccattggaggtgtctggaaaattttcccttctgatgaaacactcatagaaagagacagcccttttcatagtgctggacattatcatgcctgtatctgacacatagaacttataaagccatattgactgtccaggtaagctagcctaaagagaagctaaaagccttccaactgaaaactgctgtcatcttgaaaattcaccaggctattcccagccttaaaaacaagcaagttgggataaacttgaaggtctattccagctcaaaaagtatgggattctcaccaaggcaccttttagtgctattttagttagtagagccagtgttgacatatgtgatgctacttgtaaaaaaaactctgccaggtgaccagagactcatagggagttttgttcataggaggatatgaattgggatttgcatgcccaaaggctttcaaatttaacttttggaataaatcaagaatcagagcaggttaaggaagggcattaggagaaataagacgtttacactgactgtaccagactgcaactctgtcaacagagaggaacaattttgagagaaaaaaaggagggggttttcaaatttcaatgatgttgccttttaaaaaatctccatttattcatttatccatttgacacatttttatggaacacctacaatttggtaggcaatgtctatatgcaatgatgtataaaacatacttttcctttaggaatttttcctttaggaaaaattctttcctaaaggagtgaatagtaagttcagtgaaggtcatagaaaagtaaaaatatattacagtatttctgacaagagccattattagaagaaagcccaaaggagtatgggaggccagccaggtaaggggtgcttaccctaggatggagcaagtggtgtaggaaaggcttcctatggaagcaacccttaaactgagacttggaggaggttatggagggcagggcgggcagaggcctggcacactggcaggaacacaaatgttttaataaggctggagtactgggtgtgaggcagggagctgtaaagctagagaggtaaaagctgggaccaggtcacctgaggcatgctacggagtttgtgagattttattttatatatgtatgtgtgtgtgtgtgtatatatatgtgtgtgtgtatatatatacatacacacacacacacacacacacacacacacacacacacacacacatatatatatatatatatatacaccccttacctggctggcctcccatactcctttgggctttcctctaataatggctcttgtcagaaatactgtaatatattttcacttttctatgaccctcactgaacttactattcactattcactcctctaggaaaagaattgtatgttttatacatcattgcatatagacattgcgtaccaaattgtatacacgtataatacacacacacacacacatatatatatattttattttcagacggagttttggtcttgttgcacaggctggagtgcaatggtgctatctcggctcacctcaaccttcgcctcctggggatcaagtgattctcctgcctcagccccccgagtagctaggattacaggcatgcgctaccacacccgactaattttgtatttttagtagagatggggtttctccatgttggtcaggctggtcagtacttgggagcagtgtgaaacagaaggaaatttgtctgcaggtgctttctaaggcccccatcccgggttccctcacactctccagaagctctcaaattagaaattctataagcttgcttctgctgtggaatcaatgaatgtgcacagcttaaagtacaattttgtgttttaaagggggataatctcttaacacagaagaaggaagcgatagccctgcaatggtaaggggatcttggagatacatttagatgaactaagtttacagttaaggagacagaggcccagaaacactgtggaatgttctccgagttcacccatggtatttcagacccctgccatgagagaggtagtgggtggcggggctcccttcagaggctgctgtattaggcccagtaggctgccaactactgagaacagtcaccctttccttacggaacaccttgaccagaagttccacgtggcatggcatggcacacaaaatgagtgctcattaggcatctactagaagaagggaaaatcctgctatttctcatgcaatttgagaatgtgaaagtgaacccgggtactccccaaatgtaggcaccaggaagcagaatatggtgcatgagtgtattttcaaaagaaaaagctggcaaatgacaaaatccaagaaaattggcacagctgcttgccatttgaagaatcaaaaactgaaaatatttcaaataataggagaaaatctagaggaattgtgacttaggaccaatttggataggatttctaagcagacaatgatcattttaaagatgtgtggatgctcattttcaaaacctacactgacttctttttagaagagccacaggctagaagagccttctcagtggaactggattcttttgtctttaatgacacaacaggtagttacatgaactgagtggtctcagacctgcattaatttgggcagacagagatttcaaaactggtgaaaaacaaaactggaagaaagccactcttaaagtgtttaatttctttgcatttgcaattcaagcagatgctaccaacaaaatacatatgcaagaatggttaaaggttgcaagggaatggtaattaaaattatctttgtaaggtgattcattttgtgaaagctaccagggatgtgataagccaatattaatgtaattaatcaaggttactggggaaacagagggaaagtggaatcttaaaaagagactggacagtggttgagtcctaaggagggttgatctgagtcactagtgattgctttaaataagcattatttttttttcctttttaaaatcatgagaagggaaagaattatcaaataagaatctgcagttggctgttcagttatcccatggctcctggggtccccagacatagccggccaggctgtcatggcacctccaattcagatacatgacatggcccagcatacttccaaatgcaatctagaatcaaaaggtggcagatgtaaatgcggcacgggcccaggaagctgtcagggttgagagaggaaaaaaaggagggaaagaagaaaagatggggggaagataggaggaaagagaagagaaaaaggaagaaaatagcaggaaaggaaaagtttctcttccacagttgagatcattgttgacaaaggactgtggacttgagttttagaaaatgaaacaaaagtattgtaagctgctaacatttccaggaattaaattgtcattcaccacccttcccaggaggtaactgctaaggagataaaggattccaatattattttaaataaaaaaagcctacattagggtctaatacataagagtgggaaaacaaagcaaacaccttctggaggaatctttccctctcagtttcctttcatcttttctcaaagtagagaggaatgactcttccttaggttgcccccaacccaggctgtcacctgggcacacagagaatgactgggctcctctttatgcatttgaaacgcctacttagggtcttcagacctcattatgtcactctgctccactgcacgtctgtgagatttgccaagttatctcattcaacagagttgtgaaatctgcatgcttccatgggaaaacctgagcctttgcaggaatagagtacattttatacaaaaggaaccaagcagaaatttggtaaaacaatctgaaaaaattatagagtgccttgaaaacacttccttcctctggcctttcttgagaaaccagaagtcagtgtcttccaagtttaaaaaatcagtccagcttaagttaaaccggcttccttctgttctccaaagcagatgattatcatatttgactattttcactcagagtctgttcagaacagcctggccagtgtaaaatccaaaaacatttcactctcagattgccatgtaaaatgcctctcttataatgagaagcctagacaaggcaaatggcattttcagcattataaattttttcctcttgataagaaactggcacagataaatccatgttctatttcttaggatgcatttaacttttttaaaggattcatttaaaaattattattcagaatgtaaattacaggagagtttttgatctaaccatcttagggttatagtagtattcactcaatctgagtcacggtagaagaactggtaagtacagaattgacatcttgctaagaagagccaagaggttctcagaaatccagccaaagctgctggtgtaagggctgctctctttacctggctttgttcaatacagtaccaaagaattcctgcctcagcaggttctgagagaaagtaaagggccagtctcttccaaaatgaaacaagatacagcaaagggaatatacttaattcagaaaagcagcttggcaagactgaaaggagcctgaagtcaaaactcagagactcccaggtctgatttatccttctctccattggctacatgttcataagctgaatgttccagtcatgggaaatggacgtgagttcaaaaatgtgctagtgtgactgtaaaatgctttgtcctcatctttctgattccagagactaaatacttatatggaaatcagcctattaataacatcttatcgtaaggataaattacagtgccatccatgagcaaaggactggcaattatctagtgactacagccttttagatagggcaggagaaataaaggcaactttttacctaactgatatgtgaaaggaaacagagcaaagttctccacgttctccatgtgtcagcttcctcatctgtgaaactcgttcatttattgaacaggtttactgagctcccaccatttatgccagggtctgtactaggacctacggattcaacaatattcaagaaagacctcatatccactccctgccaattgcaagccttgctgatggccccagagcctcagccaccctttcattcttcatcagaagaaattcagcatgacccttccattgcaccacatcaagactacactctgaggagtccttctggaaaaccgtctcaaaacttgagcctgattgggagttgatttgctcctcatttaaaatacaacccctcctcatagaatattatgcttcccagtgatacagtctctcattgaccaaacttttagtcaggctcttctaaatcctcttcccaaccaggcctcgacttttggacttccgtgtgtgtctttatgttgcctaattttagcaagagtcctgacaagttggtttaggcagaatccctcacctttgctatgtgatcatcttcctcagcccccatcatcccccacgtaatatctgatcatcctagcctgccttcagccagaatcctgtgaggccagtaaacaagaattatccctactcccttagtaattttctatccattgacctccctactctgctacttggctttaaatctccaccctgccacttggtgtattcagaattgaaccctgttctatactaaggtctctttccctatattgcaaaggtcctgagtaaaatctctttgtactgctttaactgatgtccagctctggttttctttgataccagtcatccaaacctgagcatgaattacttcaatcaccccatgaaatctaacctcaagcagagactagctgtaggaatggagttttcttttgggagaaagacagagggaaaggtaatcaaagaaagaagggctgggtggtgtgctgcaagggaaggcattggacaggccagaggtccaggctccaggaagtaggaaagagaattggaagagggacaaaatagacaatgccagtgaagttacagttggcagctctgggaagtacttccatagccaaaacaacggctgctacatggagtgatgcaaattcaaaggcatggctctgtcacaagaatttatactttccagaagtatattcacccacaagtagaaaacttattttaccttcttttgcagagtaattcaattctcacttgatatagcccactcaagttaccaaagttttcctattgacatctcaatacaaaaatattcaggattattcaaagctcatttgaaaaacctcaaaaatttgtaattaaaagtacaaaatggcagcatgttggctacttgaaaaaaatcaaactataatttttcttacaatgaaagggagtaatactgtctgtaatttatttagagagtagctagtataatgcaggcatgcatattaaacactctctctttcatttcatctgactaaatgaataaatacattataccatccagacacacagttgaaacatttccccgagtattctttaaacacaatgtgcaagattgcaatggcatcatgactgacaaaaatgacaaagacgctgttaatcaagtaaatacaaagcagcagcatgaattatttatgccaataatatttgtaaccatacaaattatatattgatgttatactggagtgtttagtatttcagccaacatacatcacacaatgttcccccaacctcgatgtttcatttccttggatagctttaattcagtggtggcactcaaaacagaaccacagacacaatatcagctttttgttgctgttgtctcaaaatatgatttctttcttattatgaaatagttatcccaaaaagcacagctggggctggtgttacttcagagcttcctacatgaaagaccactgaaacagcctatgctggagagattatagtttcactttgcttcatgtttagagggaaggtgatatgtgacaatcactgctgaaatggtctttactgactcttgcatcaaggtcagaataaaaacattttaggggagggactactaaggcaattcttctaaggcaagaacctcaaatattttccttcattaacctaaaataagtttcagagaagtttaagtacactgaataactaggaagctttttacttcttcatctatgagatcagtcatacttacctatgattcctccatctcaatagaaaataaactcacacacccacacacatattcacacatgcatatacacccacatttacacacttactttgagcagttcaatttctgcttggaaactgtgaagataattatttatccttagttaaccccatctttctaagtttagaaggagctactcagatactgccacagttgggtaggtcactcactaaattttaagttccttaagggctgggggcaactgggtcatgagaatacccccgtagtatcaatatttacaatactgtttggttactaagttggagtggattcttaatgagcaattggaccacttaggaaaaggctagaagacagtactacatcttcctcactgacagctacttccctgttcatacagagatggaatgtatgtggagcaccactatagagcgactgttaacatggagaggaaagaggccagagagaaaatgcctggtgacttctccaaaaatacccacatcgttagtgaggcattcccacctaaatatcacaccagcaattgaaatcagacccaaagtaaaattcgtctctaatcgccaactatctttctcaaattctccttatgcctttacatgtgttaatttcatttcctgaaatacccatccccatcttttctcactcctctctcacccctgcctactgccccagctgtttcctgacaggtatagttgttagccacaaaaaataggggttgaatcctacctctataccactgtctagttggatgattttgggaaagttacttcacactcagtgcctcagttttttaatctacataatggggataataaaggttcctgcttcatagaggttaaatgagttaacagatgtaaagtgattacaacagagtctggcacataacaagtggattttaaatgatagtcattattgttcctgttatttcatttcacaatggtactttgcaagtgcatttaatacaacactcatttgtttacctttctggctctactgctaagctgaattcagggatatttctcactcactctgcatcctctgagtacactgcctgatacatggtagagactcactacatctgagagggagagattgggttctggcttaccctaaggacaagcttattcttactgtgccagggtttgaaacctcagtcttcaagttctgcaacaattcttttctaattgcgcacgtttcctacctgtgttgccaactctaatagttctagcatttacttgcacttctgcattattcttagaattttctaagagccagatactttttaaaaagaaaatagtaattattggcttcactccaagatcataaacatcaagttcaagctcccctgcctggtaccgagactcatttacaagaagatccagacaactttcaaacatcatttccatgacctatccaatacacaccctctaactcaccttgtgtgtcctgtctccaagcctatgctaaagatgggccttcaccctggaaacacttatgtccatctgttcaaatcttacttgttcttcaagattaaaaccaaatgccatttcctccataaaaacacttctcaaaattaatctctacctctcatgtgttcccagagcactttttatgggaaagctattttattaaaatatttatgactgttttgacttttgttatttatatgtattaagttcttaaaggaaagggaccatgtcttaatcatgtctaaatccagaaatgtgcctagaacagtgtgctacaacctattatatataactttcaaacccgaatttaaaagaaaaaattaattgacatgtaagatgctaggactcacatctgtttacaaaaaaaattagatttaaataactaagttccaattatgtttaattctcagaattacctttgagcattagattcttgcctgaaccccttaaagaattaaagtctgctttatgtgctttccttgacacaacaggcacccaaaacatttgttaaacttaattgttgaattgtttctttctgggaagttcaggaaactgggtccatagaaggagtccatatgattatagccaccacccggagatggtaaaggcactacgtgatgacagcgagagaaaagaatagacaaactagcttcctctgctggttcctggccaccatgcaaacacatgcatcacttacagactgtctttgactttcccccatcccacccgactggagccatgactggtgttgggactaacaaagtcctcctgttgaggtctgcagggcaaggtgtgggtaccaagggcttcaatgacagagaaggcaattgcagtatcaatctctggagaattccaagatccagaagccaggcctgagaaagaaatgttcacatttaaattatgagctagagctcttcagccatgaattgctaaggggtctttcctaagatggcaccgtacacatcgagacagttggggagccatgaaggaaaatccctgaagtgtccgtttggtcttttgatgctgtcccataaatcctatatgtttttctcatttcttttgtttttttctcctctgactgtacatttttaaataacctgtcttcaaattcacagattctttcttctacttgatcaattctgctgttgatgctttgtcttgcattttcatttccttcattgtatttctcagtgccagaatttgattttttttatttcaatctctgttaaatttctcattctggttacttatcgtttttctcatttcactgagttgttcctctgtgttttcttgaggttctctgaatttccttaaaaccattattttgaattgtttgtcaggcagttcatatatctccattttcttagtgtcagtcactggcactttattttgtcccttgggtgaggtcaggtttccctgattgtacccttatggccacgtactgatgtttgtgcatttgaataaatagatattccagtcttcacagattggctttgtctgggaacaccttcaacagcccaaccagagattctggtcaggacatctgatgtatgatcagaagcccatggctgctagggccagtgtggcgctcacacaagttagaagcccaggggagcaccagagcaagctgaaagacccaggccactgagacctctgtgctgctgacaactgtctaaattccaggggtgctagagtcagcccactagagatgcggaccagagatcaagtctgcctcaaaagtctaaagcctggagctacagggacccacctgatgccaaggtgagtctggaggttcaatctgtgggtaccagccatagtcttgggccatggaggccttcctggttctgggctttactgtagtgggcctggtgttggggtgcaaggcaaagtcttgtgcttacttccctctcttttcccaaagtggacagtatctttctgcattgtgctgcctggggctggggtaggggtgatgcaagtgagtaatgtagaactgtccctcctaccctcttcaatgcatcttttcatattatgctacaaccaggtactatgatctctcacttggtttcctcagctcttaagaaggtattttcacgcatggatagttgttcaaattaatgtttctgtggagagatgatcactggcgagtcctattcttccatctgccccctctccacagcctatagcttaataactttttaactctgagagtctcaaaacttgagactcaaagttttatgttgctcaaaaaacccgacctttttaaaaaataaaaatgtgaatagagccttaagaaagtggtatagaaatggtaagagatgtcatgacaactgataatgaaccttgcaaactatttgttctgttttggttttccaggagggacattagagtgagaatatctgtgaattaacagcctgatttactttaaactttcatgaagaagcctgaaacaacaatgaagacataagttttcctaagagattaagcactgtcaccccaatatcctgatttctctacctcatcttacagaatatagacatatatccacaaggagcaatatgaaattggagtgagaaagtgagttagcttccattttcaaaaatgtttatttctgtgtttaaagtgaaacaagagccccagggccctctatcccagaggaagaccaacctgtgagcattctttagcatacaaggaaaacgcttaacaaagggaaaggcacacaagaaacatgaacatcctcattccaattttctgtaattctcaagaattaatctgagatgtctggatttttcagggctgaaaagcaaggaacatcacatgaagctactccaacttatcaaaatacaatttattgtcagagttatagataaactgagccactctctctcaggttgcttatagagaccgagcccaggaaggactggaaaccacttcagaagcaactcatagctactggctgcataatgaatgagaagatatcttctacagccccttgagtctcagccaagcatcacacaagccaggagggggaagttaagaaaagtaaagtaatataaaaatgttataatataagatagaaatatggtcctagcagcctgagtttcaagtaattctcagatagatgaaggttaaattggcaggccaacatatatgcagctataaaatggacagcagaataaaatattgtctaataattcaaaatagaaatgtagaaaacaatattgtgactaccaattgaccacacaagttgatcttgatcttctcttctttaatcaacctcactaaattgagttaagaaatttaaaatggcataatatcctgaggaggtccaaataagcctctttctaaaagagacaaaatggaagggtgataattaatgaaacagggcagaagaatctacagtgtagaaatttatgggcaggacccaattaatcttgcaaaactgggcaaaacttgagattcttcgaaggccagagaatgagcatgagctgtgaggcaggaaaaacaaattatctgaaatcatgtatgtgaggcaaccaatcattaacccctaccctatgcccctctccattctgccaactaataatctctcttttttctcctccctctcctcctctccatcaacccagacaccacctacccccaaccacacacacacatacaaaaagaaatttggagcaatcttttaaaaagaaattggaagattcagagaaaaagcacattcagacaccaactcattcaaatatcataaaacaaagcccacatagagagtcacaaggcagctgtttaatggcttcactcttaattatgaatagccaatcatggttaccagttatatgaagaaagcctccaacaagaaagaatacaaatgagatgaataaatggaggaaatagttctgaaggaaatacacataagacaggcaatagaaaagaatttcaaaaatttaaaagagagccaagaaaatattataaccataaaacaagaagagaatgctatgaaaatggaagaagtaaactagaaaaaatcttactaatagaaaattatttttaaaattaaatagaaggatgaatcagaaaagattctaatttctcacaaaattatgacttgatttcagaatttgaagttatcataaaatgtgtttccatataaaaagaggaaaatctgtagtcccagcactttgggaggccaaggtgggcggatcatgaggacaggagatcaagaccatcctggctaacatggtgaaaccccgtctctactaaaaatacaaaaaaattagccgggcgtggtggtgggtgcctgtagtcccagctactcgggaggctgaggcaggagaatggtgtgaacccgggaggcggagcttgcagtgagccgagatcgtgccactgcactccaagctgggcgacagagcgcgactccgtctcaaaataaataaataaataaataataaaaaattaaaaaaatagaggaaaataaagaaactggccctctacaaaggaataggaattagaatggtattagacttttcaagagcaagcctgaagactgcagacaaatgtagttcctactgagaagttactcttcccctccactccattctcaacacccactccacaaatgctgaagaaaggagctggacgaaaataattttcatcttagaattctatattcatcctaatcatcaaccaaagatgaaaatagaacaaaacatttttaaacattcaaagactaagaaaagttagcccctccacacccttttataggaagatcattgaagatatgtacaaccaaaatgaaggagtgaacctgaaatgaagacaggatagttttcaggaaccagtggatctgaaggaggaacttccagagtgacaggtaagcatcaagcctagggagcagaaagatggaggaacctgtggaggaggggctgggaaaaaactccatcaaagtgaacttggatgtcggaaaatgtcaaaagtggaagctgtgattaaagggtcaaaagcataagggaaaatggcatttggaaattccataaaaacaaacagccatacgaacaagaaaattaaactataatgatcattagctccactataaataggtcacaaataatatttattgattttcaatttttagaattaaccttttgataaagcttaaagacttaaatgtacttacaaaataaaatgaaatatcatgatctgtattatataaaagtaaaaagaagtggagagtgcaggggtgccaagagcctaattttacaaagtagggaatctaaaagatactgtttggtaataaaaaattcatcaagatgcatacttaagaagtaaacttttaaactatgaatgtttattgcagtaaaaagtagagaaacaaaaaacaaattatatcatgtgttcggagaaattggcatgtgaggatatcggaaaactaaattcctatctattttagcagaaagtctatgctttagattgctatactttaaatgtgtccttccaagttcatgcaatggaaatgtaatctcccatgcaacactgttgagaggtggaagctttaagaaatgattaggtcatgagggctctgccctcacgaatgaattaaagtgattatttcaggggtgggtgacacaggataaacgtggcccccttcccttctctcccttgtgcatactctcatcccacgtggtgccttcagccatgttatgatgcagcaagaaggcccttatgagatagagccccttgaccttgagatctcaaacttcctaggctccagaactgtgagccaaaaaacttctattgtttataagttattctcatttctctataaattatggcattctgttatagcagcacaaaacagactaagacactaataaattaagaaacaacaataaaagcctatttcattgagatttgaagataacattcagaatagctaaaagagaaaaaagtagttgcttttggggaacaggttcgggaagtattaattagaaatgtgttacttttagacaaggcctaacactattttgattaaaaaaaaaacaaatttcagagaaaataatattgtaaatgtacaacgtatcagcaacttaccagaggagtttctgtgggctggtttaggaaatgaataattgtttatagcaggggttagcaaactaaaccctgctcagtgcctgtttttgtaaatgaagttttaatggaacacagtcacacacatttgttcacatattgtgtaagtctgctttctgctacaacagtagagttgagtagttgcaacagagacctacagactgcaaaacctaaaatatttactatgtggccctttatagaaaaggtttacagatctctgatttgaaacactaattttctgggaaaatgttatctatagccaagctgactttttaaaaagagtcaagccagatgcagtgctgtgcacctgtggctactcaactcaggaggttgagttggcaggatcgcttgagcccaggattagaggctgcagggagccatgatcatgccactgcactccagcaggggtgacagaacaagtccctgtctcaaacaaacaaacacaacaaaacaggttctaagttgggggctgcctctctcatgcacatatagctcacccgatggggacgaacatgacatgcctcgagacctagtgtctaatgttttctgactgggacatgtaaaaggggatttgtgggccccagttgggtatatgcacaagatccctctctccctttcacaataatggaaaaagtctgtcatgagactagaattctcctaacctttcagatgacagtaagaacccagcccttgtcttttaattgctacatgctgtccaaaaaagagcagcctttacatgctcacataacaatgaatttctgcttgtttctcaatgtggatatgagaatgaagcttatcaacatcaacataagtattcagcattctaggccaaagactcagcagctgggcattcaaagatatcctatagatacttatttttttaaaaaagataaaaaaaatttaaaaacataaagaaaccaaaaaaagccacactagtctgaatgccatgaccttggtctttctcatcacaatcctttaaattgccatataacctggaggtaaatccaattcatgggaagaccaaataggaaagtaagtgatagtctgctaaggaaaccattaaaaaacaggagtatcctcccaaatgacaaggggtgactttgcctaaattatgtattaagaattaatatcaaacaatcatacctcttagcattagctagttcacagtaggtctttctgcacagaaaccacttgactgtcaaaagaacttatgcttgtgacaaaaacttttattccatatctgggattctcagtggatatgagatgttagagggtatagaattgtatcagaatttcagggtggagggggatatttttaaatgatactgccccaagttagtgagaaattgtacagtactgagcactattattgattggagcctgttgcatacctcaggcaggctgatgaggaagcattacacaattcttctttttaggggagaacaagtcttctagcaggatttcctaattcttggtatttggatgaagagtttatatgcagacattattggacaaaatcatgtctaactagcaaaaagaaaaaaaaaacctaaaggtaaacaaattttgaaagtgggatgttaatctattacttctagctttaaaataaactaaaacaaaagtcatctgaagatatctaccaagacatatttttaatgagatcctcctataaagtgtttatagtttgcttttttctatttactttgttttcaaatatttccatgtccataaacataaaattctatatatttttaatatcttcatttaacatccttgtagacagtttaggcttttggtcaaattgtttttagacacagaactcctaggtcaaaggacttatacttttttaggatatttgataacagctctcctaactgatcttccaagaattataccgatttgccctcccactgcaaatacatgattgtgccacatagccacccccttgccaactctggctattggcatccatttccaatactgctaatttaatgactctcaaaatggttcataatttggtcagggctttgagctgctctatccaaggcaactattaagtgcacttaacattttttgacaatagcaatgacgatgatgatgatgatgacaaatgcctttgttctaagcatttcacacctatcatttacttaatacagcaaccctacatgggggtattatgatcatctccattttgcagatgagatgaactgaattacagagagattatttaaattgcccaaacctacaaagctaataggaggtaaaactgggattcaaacacatgtagtctggttctagactccttcagaatctatcttactcccccaggtatcagtacatacctactaatagttcatgcaccataaagaaaaagatccatccactcctgccctcaggaaatgttacagttctacagttctataagtgtgagctaacttgaatacaattagccaagtactttcccatctggaatctgttcccttttgaattagaatctatgtctcgcacgttccctcccggctatgtggcactcatgaatggatgggcaccacaccccatatcacaccagtcaatctgccacatccttctgcttcacatctcttggcatggccttaacccttgcctaggaaccagataatcatgtgagtcttgactgagactcaacagttctcacagctgctgaccactgtagatgagaatttttgaactgggtgagaaaaatcttgggttctaagaggcaacagaataccctgtaccaggctctggcttcctgggtccaccacttacaagttatgtgtctttggatcaggcacttaacctctgtgaacctcagtttttaaaatctgtgaagtggagacaatatttacagctcatagtgtgatgtaaggaaatgtgctaacatgcttagcactgtgcctggcacatactatattgttggtcaataaaagttattgttatttacagatgtttcaaatcttggttccttttgttattcctgttgataccaacttgaaaattatcatgacactatgaagtctaaactgtctctaaattaaaaaaaaaaaaaactgtatccaaaagaatgatctttcagagataaaccaaaagatgaaataaaagcatccatcactttaaaagacaatgttgatatataacattatataaaatgttcttaatatcagatctataagctttaagactatcctgttaccataaatcagagctaatactttattactgataaagtaaaaatagatatttctctattactatatgttactatatatgctgttatgttactataatgctgaccatggctctacaggaataacctagacaaaatctagaacactcagtaaagcagatggtgcttaggaacctactgaataaacagtctcagctacactttcagtaagtatccctttggagaagctaaggaataatcatgtctttatggaatggcatagtattaaacaaaaatagattttatctattagtaggaaacattctggttcaattgagatggactagatctagggtccccaggttttgcttggatagaagttactttctatttctctttggcctcaaaaaaaaaaatggcagtctgaaggtaaagcattgtaatagaagagaagaaaggtcggtgacagcctcccatgccctttctcatataaaaaaccttaaagttggtgaggaagagaaatggcattacacagtcaacaagctttgaccatatgagaccacaatttttcaactagaagtttcctcagggtagcacagtatataagaactttgttttcaagacagaggttagttcaattctggtgctgctatttatcagctgtgaaatcatgagcaagctatttatcttatttaagtctcagtttcttaatctacaaatggggatagtaatagaatctaccacataggacttttgtgaggattaaataaaggaatacactgtacatacagtgcttacaggtgcttcttccacaaggaatgggcagtacactttaagtattatttatatttctgatatcccaacagttaacactaaaccgtaccaagtatacattattttgctctctctcacacaaatatacacatatataaacaagtcacacagtcccaaccctgaaggtcaacgaggatagtgtttgctacccttgtagagtacaatctttaaactgtgatgacaagacaataaattttcccaaccatttgaatgagctttggaagtggattttttacttgagcttccagaaaaaaagcccagtctggctgatgccttgagttagccttatgagcattgaagcagagaacccagttgagcctgactgaattagtaactatagaaatgtacactaagaaatgaaggttgattttggccaaaaaataataataataatggtaactgtgataatgtgaactggcatcctctcccccacttacagcagacttgaggttaatctagagaatgaattttgggctagaagaaatcatccagtccacaatcagtgtcttcaattctagaatcaattgaaatatttgcttatcatcaaaataacattttcttcaaggcattagtccaagatctgtatcccagcgaatcacaaagaggagaaagaagagccagcacagagtatttataggtcactgacttggtgcacagccagaagattttttttaaccaacatttctgccaaaggaactatctgcagattctcttaatggttttttgtttttttttttttttttgagatggagtttcgctcttgttgcccaggctggagtacaatggcgcgatctcagctcactgcaacctccaactcctgggttcaagcacttctcctgcctcagcctcctgagtagctgcaattatgggtgcctgacaccacgcccagctaatttttttgtatttttagtaaagacggggtttcgccatgttggccaggctggtcccgaactcctggccttaggtgatccacctgcctcggcctcccaaagtgctgggattacaggcatgagccaccacgcccggcctcttaatcgtatcttaaagcattttaaaaataacaaatgaaactgaaaaagataaatcgaggtatctaagcagttacactgaactcatttctgaagctcatggacaaactatgtaaaatctcaagagactgaaaactattttctattctcaagattcaaagtaaaaacttagaatacaaaactctaagaaagagaaggcagaatggtggcagctccagagggtgggcagaatcctaatcttacaacagacctgggcaattgctgctgttaattctaccagcagaatgatgtaggagggctccttacagcctgggcccgccttatattctctgcacaatcagagtggaacctgggcacctattagtccctttccatgctatcttcctgtgaagattcttatgaataagaaaacgtgacctttatcaaggaataattttattcaaattgtgtaaactggatattttccacagtttcttgtcaggaggtgggcagagaagttaaattttatacctactttaaaaaaaaaaaaaagcccctcatgtaatgttagcaactgaccaaatactccttggatttcgtgtctggagagaaggaactaagaaaacatacagttctctgaaatgtttcctggattctttcctctttttccacaaaaatagaactactctttttcttttttcttttttctcttttgatgggggatgaggattatacagaagatttggcaacctaaatgaacatgagagaaagccaatagtataactaaaggaaggggatcgccaaaaccattcacttaggggaatttcaaactttggtgctaaagcttccaaataatcagcatcaccattcaccaaggagcagaggagttcggtcttgctgactgccagttaagggctctgaaaaaagacagtctccttggcagccgttccaacctggctcctgccccctgtgaaccaaggaaaagtggaaatctaattccatgtagcctggaagaaaccttacaggtccagggctgtggagaggtcgggtgaggaacaggagttcccaccatgccactagggttctggaagccctgggaagctgccagtggcactgcagcaccaggaactggttcctagagaactgcctcaaatcagacacacataaggaagtcaggcagtgatggcgctgcatgggaatacaagcagaacaatctcctcagaactacttcgagggtactgtctctcagccatcttccaggttttccacaacccacaaaggtctttcaggtgggtataatttggggttacttgttaagatggagttacagcacagcttcattggcaaagacaatgggatctcatatctagaaacaaaactttctgggtttcaccatttgcccgttatcccctgagaaacatcagcatcacctgttaacttgcttgggaatgcaaattctcagacccaaccgagacctatgaatctgaaactctggaggggggcggcagggaggagggcaggaatttgtgtcttagcccctcattgttaagattctgatgcacactaaaatttgagaaccattgagcattctagagcaacacaatttcatgaaaaaatagctttggaaacagcatctggatattaggcaaaaatatgtgcctgaatagaagaaacacactccgttcatagtagggttctattccccaattttttaatttagtagttctttgtgaaaaatgtcctctcacatgcagcattttaaaatgagaaatctggggccttctcaaccaacttcacacccgctttccagggcagctcaaaacaaattactgataaatcaacatggggcactctgaatcatcagtccgtctttagaactccccacatggtcagctgaggcattccattgagaatgcatcatgtcttgacttctctctctggccaatcctgccgtcattgcatttcttaataaacctcctgcatgctaaaaaaaaaataaaaaataaaatcaaatgagcaatttattgcaaatagccagtcccaaagaaatccttttgcctttgttgtttccctcaaaattgcacattatttaaggggcctgtcttttacacatttttattagcacctagagcaatacaaatcctccacaaactctagcaaatatgtattaatacagtaataagtaattctaagagcaagcactcaaattagtaaggtctggtttcctgtagattactaaagcagggaaggagtaagggggagaactcagagaaagcgtgcgctgactaaaagacagaaaggaagcagaaaatttattctgagcagatgccaagactttgccacatgcttacagtaagagaaatggagagcagagaaaattatttttaaaaccttctttccttgagaactaagttatcatagccctgctttaagatattaggtaaatactttttcaatgcaagacataggtggacccagaatattagcaagaaatgtgccttaaattatttaaaggatacagactatttattttccatggacaggaatcatctgtcttcattcataaaattcaagctgataattttttgataaaactgttttctttataaattgttaataaataaataaattgttgataatgtatcatttctacccaagactggaacaaacacatcagccacttaaattcctcagcaatacttaggctgctgaatttgttatcagtggtaatatatgttagcttgcctgactttaactgcatctcctcaaagaaaaacgtagatgagaaagtaaaagtgtagaggtggtgtggtagagtggaaactgatgagcttttccgaagtagagctggatcctaatgccagcagctatattgttatgactaagttaattgacactcaggactgttttctcacctatacagtgaaggctgtggcacagtttaaatgtgttcatgtgtgtacagtgcctgtaagatgataaacaccaaatcagtattattattattaagaggcacccattttcattttaaatcaatttattagatgttaataaaattaacccctattcctccattctgccttccattatttggcagataagaaagctctggcccaattgttctcaactctggctgtatattacaatcacttgaaagttcttgtgtgtttttttaactgccatctcgccacagaacaactggatcagtgtctggggcaggccccaggccttggtgattctgatgtagtcggagagttgagaaatactattccaaatggattctttaccaaaatcacttcggggcaaattggctattctggaatttgatcatttgatggtttggcctgctcatcctgaaggatcaggaggatacagccttatcctatcttagcattcttgggagatgtctagtacaccctatggcaaaataaatactattccatatttcctggttagcctttgctggggagagaggggagaggggtatatgtctgatgatgagccattgaaggagaacatctgaattaactaaagatggtggaagagacaaaagattaggttagctattatactttaaaaacttctccttctcctccttcttcatccaccactgtaacagatatctgaggagtccctactatagtacttagaaaactaactgaaaataggacaattcatgaatgccctgactcgttacatggaaattcaatagggaaggatctattcaggtatctctggaagaagaaggtcttcccatacttctccacaatttaagtcatttttcatagtctaagaatataagagtatatattgtacagcctgggcaacatggtgaaacgccatctctactaaaaatacaaaaattagctgggtgtgttgatgcacacctgtaatctcagctactggggaagctgaggcacaagaatcacttgaacccaggatgcagaggttgcagtgaactgagattatgcccctgcactccagcttgggcaacagagcaagactctgtctcaagaaaacaaacaaacaagaagtagacattgtaaattgaaacataaaactttagaggcagaaatgtcaccttggagagcaaacagatatttaatatttgttctcaatcaacattacctgataccagttaccagccagggttatgcaaggtacttctatttacacaatctcatttatgacacaatgttgtagtttgaagagctctgtgtgctgttatagtcagggagtcctcttgtaatgatcaattgctacagcaatttaaaccttctttaacttaggtttatgatgctagaattttactttttgtattcatatctgtttttatggcgtactgttggtaagatggtttatatgatgccaagtctttggtcagaaaagatgctgctttcacaatgttgttctcatagaaaaacataaatcactttgtggtattgtttccaagaacatgctaaggcaagtaggggttttccctacagtcctcagggcaagttcaagattattctgggtattatatgctgctgcaaatatttcttcccataggccaactgaaaaactcaaaacaaaacaaaaacagaaacaacaaaaaaaaccctcaaaattgaacaaaaattctcattttcattgttaagaaaattttcaactattagttatgttgtcaagtcctatttttatcattgattcttttcaaattcaatatatctaaaatgtggactcagatgtatctaatcaactatttttgcagcttttcctttgcttttaatgcaaactctagaataagaacatttaagaaggtcaccccagctgtgcacaacctgaatccaacaggattccaacaggatacttggctttaacttagaatgttggctttaacttggagtaatggcatggaagtctcctaacaatttccactatgtgttatgaataatctagaactttactggagattttactctattttacagtgatatggctttaaaagactataagttttgattccaaacaaatctagtgcaatagcaggtcaactaaggtcttgaatttcatttagtattttattcgagatcagtatttacagtactgacaaaactatttaagatcatcaaagtcagtgaactccttcctttacatttatttgatatataaagggccaaattgttcaaatgatgcttgaagtgaatggtagaaccaggctagtcatttcaaaacaggatgctgctataaagacacatgcacacgtatgtttattgcggcattattcacaatagcaaagacttggaaccaacccaaatgtccaacaatgatagtctggatcaagaaaatgtggcacatatacgccatggaatactatgcagccataaaaaatgatgagttcatgtcctttgtagggacatggatgaaattggaaaccatcattctcagtaaactattgcaagaacaaaaaaccaaacaccacatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatttaaaaaaaaaaaaaaagaaaatatttgggtggaatgatcagttgaacaatcaattaaaagtctgacccacagaaacgaactttccagatgatcccagatttccaaggaatacattggtgttgtactatccaccataagggctggtggcatgaggaacattcaggagccacggacaacaaattatgctgcttcaagaagtcaatggctggccgagtgcggtggctcacgcctgtaatcccagcattttgggaggctggggagggcagatcacaaggtcaggagatcaagaccatcctggctaacatggtaaaaccccgtctctactaaaaatacaaaaaattagcctggtgtggtggtgtgtgcctgtagtcccagctacttgagaggctgaggcaggagaattacttgaacgtgggaggtggaggttgcagtgagctgagattgcaccactgcactccagcgtggatgacagagcaagactccatctcaaaaaaaaaaaaaaaagtcaatggctggcagatttgaagcactaacaatatttggcagtgtttcttgaaataaacatttatctatttggagaagtagaatgaaatgaaatctttttgaaaaaaaacatttaaaaaattaaatttgaatttgactcatagggattgatcacaattgaagaatttgacctgcagggacgaattgttcaactgatccaataatttaaattataatgtatatgttctcattctaagcacacttccgagagcagcagaagcagttcaagaggcataagggaagcttcacaaatagctcattagctcaagaagtagatgaagtgggggtaagaatgaaaaaatggtgaatgtcccaaattggaagttagaacacctggttctgcaaagactaattgtgtgtcctgcctctaaagtagatattcaacctctcttggcctttgaaagaacctgtaaaaagagaatatgagaattatgttctctaagattctatcatacctttaaaaggctatggttctaagttaaattggagtttggttttaataaggtcttaaaaactcttcatctttccagttaaaaatgttcagtctcctgtaaatgtcactactgatctgatatcctgccatgacattccagagatgagacaggaaaaaatgtgactggctcatatagattctattcctatcctctcactatcctgactttgccaggagcagttcagttctggaacacttcagaaaacatgtcttaaaccactaaatttttagaatagggattcaaatttaaagtgtaagagaaggctggttgagctaggtggctcatgcctaatcccagcactttgggaggctgaggcaggcagatcacttgaggccaggagtttgagaccagcctggccaacatggcaaaaccccgtctctactaaaaatatgaaaattagccaggaatggtggcacagtcctgtaattccagctactcgggaggctgaggcaggagaatcacttgaacccaggaggcagaggttgcagtgagccgacatggcgccactgcactcctgcctgggtgacagggccagactccgtctcaaaaaaaaaaaaaaaaaaaaagtgtaaagaaaggcctcggtttaggtctgagcctaggctatggtttcccacctagctcttctaatacgattcatttgggcctcagtttattcctctgcacagtggaaaaaacgaataattttgatgaatggtactagattttagtagggtaggtaatgtttttaggatagaagtagaagaggatgggaaaaacagcttgtagcactttgggctcttgagaaggcacgtactactctaaccatcaacagtcgatcatgcatcttcctgcaacttattattcccaggtgctcaaaaatacctatggttgaatgatgatgacaaagcagatgtcaacatttaaatttggtaaacatctaacaggaagaagtgtgacatatgggaagaggttcaaatccaagccaacccagatttgaatcctaccaccatcattaactacagagagggttatttgatctaagacaaattacttaccatctgcaaatagggaaataattttttctcattgactctattttgagtattaaatgacatatcacatgttaaggtctcagtagagtgcctggcacacaatagatatgtgagaaatggcaattattattatatgtcaaaatgaattttattaagaaaaatcaaatatgctgaacattagattccatgtacctgctactaacatatcatgggctacttttaagcctcccacagtcatctttgtaatttgccagaatcttatctttaagaaaagacaatctctgcagaagataggtattaagtatttttctctccatctgaaacttccaaatcctcatcaccataatgactgaatgtacagcactataagcatgaagctcacatatttatggagataagaaaacaagtgtggcaaattataacagactttatggaacgagtcagttcaatgaaaacagccagataagtaggaaggaaggaagcataaatcagatatgatgaattccatgacaagcccatagcaccaaaatgatcaacgatcttagtatgttagtttacccataccataaacactccacctatttttttttagaattccatttcaacttacccattgtctttttagctatggcttttagcattatttttttagtgttgttttagaggatatatatccttaacttttcacaatctacttagagttcatactgcaccacttcacagaaaacgtgcaaaccttaaccatatattccattaacacatcctcccaccgccatagtactgtactttatgctatggctgtcatatgcattacagctatgtacataataaatcccataagataatgttatagtttttgctattaatcatatgcattgtaaataaattgagaggcaacaaaatattttttatttacacagatatctgccatttctgatgttctacattactccttgaaatagccaggcttccctctcatattatttccctacagcttaaaaattttctttagcatttcttgtagtgcagatctgctgatagtgagttttcttatatttctttttatttaaaaatatttttgcctctattctcaaaggacattttcattggatacagatttcttgttcgacaggattgcattcccccaaaccttctagaactttaaagatactgttaaactctctgctggccttcatagctccagatgcgtgtccatgatcatttaaatcagttaccttctatgttgtgtgccattctcctctgactgctttcaagattttctctttaatttttagcaatttgactatgatatgctttggtgtgacatttttgtatttatcttatctgggtttcactgagctttctgcatttgtaaatttgtgtttctcattcaatttggaaaaatttggtcattatctcatcaatattttttctgttccactctttctcctttccttctgaaaccttaaacacatactaggctttcattctgtcccacaggtctaggatcctgttcactttttaaaatcctttatctccgttattcatcaaggatcctttctactcatttatcttcaggtttactgaatctttcctcattacttctactgtgctattaatcaaacccatacagaggattttttaaatttcagatattatttttagatctaagatttcccttttgtccctttttatattttatattttcctgctgaaattccctatattttcacttatgtgtacaagaatattttcctttatctcaattataagagttgctttagaatcattttctaataatttcaatatctggatcatctcaaggttggcttctatccattttcccttgagaatgggtcacattttccaggttctttgtagctaaagtaactttggattgtatcctaaacattatgaatattgttgtggagactctggattctattattttcctttgaacagtgttaatgtttattttaacaagcaattagttttgttaaactgcaaaccctgtcttgtgtgcaggaggcaacagatcaaatctcagtccagctctgttaccattaactgtgctgctttgattttgtccaacacatgtatggctcaagaatcagccagactcacgcctgtaatcccagcactttgggaggcccaggcgggcggaacatgaggtcaggagctcaagaccatcctggctaacatggtgaaaccctgtctctactaaaaacacaaaaaattagctgggcgtggtggcgggagcctgtagtcccagctactcgggaggctgaggcaggagaatgatgtgaacccgggaagcggagcttgcagtgagccaagatcatgccactgcactccagcctgggcaacagagcaagactccatctcaaaaaaaaaaaaaaaaaaaagaatcagccagagacttgggcagagtttatactcacaatcttgggctctccttgtctgactctctcctttctggttttcccctctcactcgccaatggccacaggctccctagactctttcttcttgccactcagacaagaaagtgaggagtttttaatcacaacttcggctgccctgtgtcattctgcaaaaacagacaactcaccccactaaagtccttttttccaggtgcccactgctttacaaaacctgtttgcctacttttttcactttcaaaaaccttcaagtagttgcttttttgcattttgtcccaagtttattgttatctgtggaaaggttagtgtgttcaaagcttattccaacacactagaggaggaaaccacaaatatcctgattaacaaaaaaatcttttatctatatatcaagaatcaaacttgaaatgatgaactataggttggctagtcttcctgtgcctgcagaagtctcattttactccacgcctacaagattcacaatgtatcttctattatgcatttcagctcatcctcaagcctccagccaaacctggtctccatttagtaagtcttcactcccaagggtaggatgtgcaccactggtaaaccagatgacttaaggtgactgagacagaacattaaatagcatggaatcacataactatggggaaattattttcaatttttttcaactcttctgattctgccaagcaatgcatctcagttttgtggtaatatgtctttgacacctttctaatagtggctagtttccccttttcaacacagagacaacaggtctcatgcaaagaactttctccaggaaatagcatctagctagaaatgaataacattttttttccactcaatgtatttttagagttaccttctatttgtagtgatattgttttttatttgtgataatgacataaagtttactttttaaaatcaaaattcataaaaaataacttgatttaaagaaaaataataggccaggtgcagtggctcacacctgtaatcctagcactttaggagatcaatgtgggaagattgcttgagaccaagacttccagaccagcctgagcaacacagcaagagctcatctctacaaaaaataaaaaatataaaactggccggctgggcgcagtggctcaagcctgtaatcccaacactttggaaggctgaggcaggcggattgcctgaggtcaggagttcaagaccagtctggccaacatggtgaaaccctgtctctactaaaaatacaaaaaaaaattagctgggtgtggtggcaagcacctgtaatcccagctactcaggaggctgaggcaggagaattgcttgaaccagggaggtggaggttgcagtgagccgagatggcgccactgcactccagcctgggtaacagagtgagactctgtctcaaaacaaacaaacaaacaacaacaaataaaacaaaacaaaaaaaactagccaggcatgatggcatatgcctgtaatcctagatacttcaggaggctgaggcaagaggatcacctgagctgaggacatcaaggctgcagtgagctatgatcatgccactgcactgcagcctgggtgacagagtgagactctgtctccaaataataatagtaggccagtcgcggtggctcacacctgtaatcccagcactttgggaagctgaggtgggtggatctcttgaggccaggagtttgagacaagcctggcctacacggtgaaaccccatctctactaaaaatacataaattagccaggcgtggtggtgagcatctgtaatcccaactactcaggaggctgaggcaggagaatcacttgaacccgggaaacggaggttgcagtgagccaggattgcgccattgcactctagcctgggccacaagaaggaaactccatctcaataataataataataataatgaatgacagtataagtcatatacagataagaatggggaaagattgtagtaaatagttctaattgctataacagatgtatccccatcccaaatctcagtagcttacatacagaatttcttactcatgaaaatgccaataacgctacttgggtgtttctagtttgtggtagttatccatgtgttcattcagagattaaggatgacaaagtctctgccatcttcaacagagatctcaagatcactttgaataggtctggccagggaagagagagagagagagagagaggaaaaaaaaagaatagcagacagtgtgggcagtttgatgggccaggcttagaagagatatatatccttctgttcacatattactggataaaactgagtctatggccacacttcactgtgaagcaggccaggaaatgggtctgacctaggagaaaaagtgttttgggtttccatgagcataaagtttaggtaactgccctaagatttggggaactatgcactaggttatgtttcttcaaagcagaggagaagaaggaaccatcatttctcagaaaattctctttgttttataaggatgacttaagatattagcatctctccttcctgcctgccttccagatcccatggtcaggcccctccccaagaaatgcagagactgacaggcagtcctccaaagtgttctatccatttcagtagacctccaccacgggaatctggggtgcccactgcagctccaagctgtcacatctcctgtcccccaactgccctttctttcccagcagctttgtaatcacaatttaccaatcctgcctctcaccctctccacaaagtctttgctttctgacagttcaattaggtaacttgaaaaagtagccagtgttcatgttaattgaaagctctttcttccttctctccagggaaattaagaacattttacactgtggctgcctggaggccacggtattgttttgagtgtgtcctagcaatgtgtggccaccacagaccagggaggtagccccatctggctggggggcaactccaccaaccccacttcttgaatatctggcctgttcctccgtggccacccctcacccaagagagagtgccagctctttaaaagcaggacatgcccctcccaggatctttctttgacgcccacagatcacagagggcctaatgcaaggtcgagtactaggctttggctcaggacatgtaactgaattcaaatgattgattcagtgtcactgaggtattagcagtcatttaagttctgttctatgtactctaaaaacagtatatttttaaacaatgtagaacagtatgtgtcaaacctttagttactcccaaaatgctataattaaagagtcaactcctcatattttgtcagatcacagtagaactcatggacttccagccttctctcagccacgacctgtgcttgacccccactattttaaattcctgaactgttggcagaagtgcctgggtagatattaatttctataaatatgttttggagagaggcagccaaggcaaattaactggtgtttcatgagtacacccataaaatgctactctagtaaaaagggcacctgatactaaatcctgaacctacccttccccccaacacaccctttttaaaaatggaacccctagattcaaagacagtttggagtggaggttccccagataatgtctgcttgcttgttagttacattgattttaagaacaaatccatttaagcgatcttcacagctgacttgtcctctttccatggactgtgggttctggagccagactgccaaggtttcaatcctgattcaccaccttctcattatgagatttggagcaagttacctcacaggatgtttaggacttgctttaaaattcttcattcaaaaaataaaaggggtggtggtagagttactgaaataagatgggcaaaatattgataattattgaagataagtaaggtacaagtcagttcattctatccactctcttgattgtttgaaattttccataataaattcttaaatgacacttttatctagaacacaagtaattccccaaggctttccctcacaaaacaactttctcctctatcagagatgaattgtagaaaatatattgagtattctatctttactttcaactatgcagaacaatttcttttagatttcgctgttctcataagttaataatataacaggaagaacttaattttttttccttctaccttcagctgtttaaacctaccaagaaatcaaattccctgatgtgcagtttaccgcagtccttgcctcttatgataaggccagtcaagatcctaggtatctggacacagctataatttggtgtcgttttcagtgttggctctgagatctcagtctctcgataactcccctttccaaaaggggaaagaccgggggcggaaggaagagaagacaagaagagagggaatgtactgcatcctatttcaagcactaacacaactgttttctcccccattgactcttcaaaacacagatgccatgcccatagagaggggagacaaataaggcgatatgttgggctcaatatatactttcttttgcacccccaccccaactttcacatgtaagtaatgcactgagaaaaagagatgacttcctgctggagctcagactgtgccaatagaaactgctggtttccctcaagtgatattaataaaactaactttattggcaactcctgtcagggctgcacatgataacgtcaaaattgtacagattggggaaaggctgtttaaaagttttcccccaaattatcagtttttaattatatcccaacaaaatattgatgtctcttttatcactgataggtcatataaaatttggagacagttttcctctatgtctttgagaaaaattaaacaatataattttattacttctttcacatatcttcatcagctaacttaacatggatctgttaaagcattttaagtgtaaaaaatgaaatttgagttttatgttaaaaatttaataattatatcaaagtaaaggttagaaactatttaaaaccagttaatatcaacatcagagaaagaaaaagtatataatgacagttctaattattacattctcttgttttgcacttctaaagagtggcaattaaatctctactttgacttatgtggagagtaaaatctgcacctgcaatactaacaccatttcatttcctccaagaaagggatttagttccttacaatatagatctggggttggaatagtagatgcaaactgcttctagaatagcacagtgcctctgatgatttaggatggtgttccaaacaccacttggtttccattcaatatgaacaagtacaaaatgatcctttgagtccccaccaaaatcagtacaggctaaagtgtgtgttggtttctatctaagtactgtacatggagcaactgtagtttctgaggtcaggaacactgtcattcatggtcttagccttaggtatgccccttcccccaaacctttttctaagggcaattacagtgaaagcagtttgtaaaatgttaagcattaacaaatggaactttttttgcgaatattcacttgtaaaaatacttagccagactgatagtttgactttggggaaatatatgtctgtggcagaaacaaaaatgcttattaaatattccctctgttccctcgcatgttccagccccttgcagttatgtcagatcacgtgatatagttctgaccagtaacttgtggccagaagtgatttgtgtcccttttaggccaaagtgtaaaagagctggcacatgatcttctggctgtgtcctttcttatcatggtgaactgagggggacatgagttgcagatgttgtggctataggatagtgaaactgctgccatgggcctgggtccctgaatgactgtgtggaatacaacactactaccaactcttgctggatatgtacaataaacaaaatacaaacctttgtgtgtaaagccaccagaaattggattatctgttcctgcagcacatctatcctatcctgaaaaaaataatgtgtaaggtctaaaagccttaatttttcacctaaccagcttcacaaaactctggatgcttcatttctgcaaacttcttcccatgctgatagatgagaagggcaatatgcaaggaatggctccatcatggcaccatggtgaccttgcacatccccttataggccatagaggcaaagcttagccacagtctgaccgaagtcttggtgggatgccctgaaattcctcctgaaatgaaggaagacaagcagccttgtggggagctcctgtgaggcggtttctcatctacctccagattttgtgggagactgcacaagacctttcccatccatcttccttgttttggttgtgtacaggactttgcatcttgcaaacccccttccccttagggcacagccgcaggcttctgtgccaataaaactacttggctgtaatttagaggtggctcctctagggcaaagtgacccacctgtcatgccacctgtcttctggcctctccagtttggtgtcatcctgtgtgtgggactagggaggcaaggagctgatggcatactgatcttgattttgctgtctgtgtaagtaacaaagctctgaattcatttgggcttgttgttgccttgccagacggatctatggaagtgtggagagccaacatggtagctgccctatcagtgaccacactgcagcttgggcattgcttaactacttgatacaatgaaaggtgacttttatgataactatttgttgctcagcctcagcttagatggttttctgatgggatatctttcttttgcctgaaagaacaaaatggggccaaccaggactatagctttctgatttgaagttggagaaaaaaacaagtcagataggtttcccactgcttcagcttcctccatattttaataaagctagcatcaagtttacaaactgagttgttaggaggctccaacaatccaggccctattgaagatatttggtagcacctcttcttgacagagtcttaagtgtgctgagtggtagccacaggctttggaagaacccatgagagaaagtcaacacctaacgtacaaggagacaatttatggcatttcatacttctgctattccagggaaccagaaacacctatcacagggatgaatgatatctttcaaattaaataaccaacaggaatgctaacactaaatttcctgaatattaataaacacgaatggtacacaaatgcatttacaaactactaaacatcaggaattgtgtgagaaagaagtctcacaaagataaatggagttccatctttagatgcaaactcaaagttctctaagacgggtaatgtttctgacttgggagtgaggtccagaaaaatacacgctgggtgatgagtctttagatatgagcacatttataagtaactttatggctggcaaacctatgtacctatgaaaatggtgcaaccacagcagcattctctgttggcactcacacagcacggtcatgccctatggggccaggaagaacaggagtatggttttgcttcttgcaagtttacagatatcctactgagagtgagaatcatcatgacatatcttgaaggttgtaaggaagaaattttctcagaaagagaaagggaaaaatgtatgcatctgacattatttctggaaaggagaacatcctttccttataagacctacaaatatgctgttttaaagatgattctgggcagagaattgtgagtgaaaaaaaaatctgtgctttcaatataaatgatggtgacagaagaaatgctgcatgctgataaaactcacagtgcatattgatgaaatattcaaatatccatcatattccgagggaaatatcctaatgttctaagcagatactgttagacctcattaaaaagaaatcgtcaagtactgttctttttatgattttctcaaccacaatgtttttctagaccttcctttgtgccaggcatgatgttaggcagaaagggcacaaagatgaataggacacatgtctgttcaattggttccttgatgcggtttctgccttgaagctccgtttccactctttcctggttcctgcagtaacaattagtgttcaattaaaaggctctggtcttcagcaaccatcaaaataaaaatgattcaggcaagaattctcaatggatggatgtcaaaaactttgggtaaaggtttggatcgggagagtcacagggtcctcaaaatattaccccatggattacttactaattacaaaaaagcaaaggagaaatctctgcaatggagaaatctagtgggtaccagtttaaccaaggatttcaatttagtaccaccaagaatgggaggagcaaacattatgtgactcctgatgtgatgcaacaagaaggataagcattgcctacatggtgctctggcaatagtaattaactggaatctaactgtgttctaactgtgagaaagcaagcagacagatacagaatgtagaacactgtatcaaacaactagctggactttttttttttttttttgagatggagtctcagctctgtcatctaggctagagtgcagtggcacaatctctgctcactgcaacctccacctcctgggttcaagcgattctgctgcctcagcctcccgagtagctgggactacatgtatacaccgccatgcctggccaatttttgtatttttagtagagatggggtttcaccatattgaccaggctggtctcaaactcctgacttcaagtgatccgcctgcctcagcctcccaaagtgctgggattacaggcgtgagccaccacatccagccttagcctggacttttcaacactgcactgcattattagataagacataaatgtagggaactcttctatactgaagaagactaaagagagacagaacaactaaaggcaatgcatgatcctggatcaaaagaagcagctatacagtaatcatttgaactaatggagaaatcttagaagggactgtgtttaaatggcatattgtattggtgtcaaattccttggtatttaatggtactgtgacatgttcttgttctaaagtgataatgctgaagtacattggggtgaaatagcatgatgtctgcaacttactttcaaatggttcaggggaaaaaatttgtgtatacacatacatatacatacgtatgggaggagacacaaaacaataaattggcgaaatgttcacattgtcaaatttagatgcaaagcctaccagtgtacattgtattactctcacaattcttctgcttaatttgaaatgttctattttaaaaggggtggaggggagtgggggtgaaaaacagcagctgactgagcttgggttacagttgtgggtcatggaaaatggcaatgctaaggggccacttggatgaagcctgtgttcttggcctcacaagcctgtctctgataggggtcaggcctcatcttaatgacaggacagtccaggaggtgcattcctagtttggaatggatcaagacacttcaactgccacactcaaagagatttgtctgtttagtgtatctatagacttagaataaatatgcttcagaaagtggataacttctcacttgttatatagaccaaagtaaaatagcacaaaatctacaactcaaatactatgaagtgctcagtaatcaacttcaggggcaatgtcagtgcatctttgggtcaatgtgggtaagtgtacctgtatccttgcattggtccataaccaaaccttggctccaatgggaacccgaacattagactttaaaattttcttttgaattatgaattctttgctgaatagtccagagcataggccttaaattctggcagaagtcctatgaatgaattcattatatgttttaaaggaaagtcattaattctttgtaaataatgttttagtatctaaagagaaaaatcagaaggtgttaaatgtttataaaagaatgagaactcaaggtctaaccttctaccctctctcattgcccttttataaagccctttgcacctgcaggaaatatagagctatttccatttgagggtctccatctcctccaccatctgctccacatccagcccaagtctctcttgctcaaatcatctggtttccttatcataaacagtctttccagttgtgtctacgcaatgcaaaatcagattcagattataatgtgcttattttttctttataggttgtcagtaattactttatataataacaaaattgcttataacaaagccagtgaagctaacaccaacttacccaacatttataaagtcaagcaaaataaagtttttatcacacacgtaaaaaataatattcctcctaaacttaaacagaatcaaaacaactcttcacttaccttttattgttcaattatagtgtaaagtaaatagacagttactactaggaaaaaaaaatttaagttggagacagtcagccctgcctctttctatgcttcagagaatctgaatattcatttccatccttccccaaattccagactctaaatggcctaatatatgacattagcatgatttcaattaataatctatgatatcttcatgtcataaattttatttgaaattttgaaacacatatttcaggtatcaaagtatctgacactggtgtagaactgattaacataagtaaaaaacatcttttgacagcccatcacacatccttgtttcactaaatacagaaaattattatatatgtaaacatatgcatatagaatatgtaacacttcaacacattccaattatattactaaatgcttgcccttccatcaagaatttggggcattttatggcatggccttcacataaaaaccttagaactgagcatcccaaggctcaactcagacttttttcctttgcatctccaatctgtcaaacatgtatatttcactattcttctaggatcaactcttcaaaagctactaggtatgagtaaacactctatacatagccccctgactccacctgttttctggtggtgttaagaaaaatatcattgctagcctatggtcctatcctcagaggaaggcaacaccaggacctatattatgactgtgagtcaggtgagatagtccgaggcaaggaacctttatagagtgtagactggatatgtgcagaggcgctgaagaacaagacagccaacatggattcacttccactgaagaaggcccgggggaggaagggtgacctgagttgaaccatgagaggaggtgggggtgggaggaatatgtgaaggaacagaggtgagaggaattatgtaaaaagagagaccagaagagtacatatggatgtctgcagggaaacaaggtggccacagtcagatgagagttgacaagtggcagaaaaatgcctgctgctaggtcagcaggtgccaagaatgtgaaagccccacaaggaaagcagaggaggagccatggtgatgggggaaaatggggccattccatcagagaaatgcaaatcaaaaccacaatgagataccatctcacaccagttagaatggcgatcattaaaaagtcaggaaacaacaggtcctggagaggatgtggagaaataggaacacttttacactgttggtgggactgtaaactagttcaaccattgtggaagtcagtgtggcgattcctcagggatctagaactagaaataccatttgacccagccaccccattactgggtatatacccaaaggattataaatcatgctgctttaaagacacatgcatacgtatgtttattgcggcactattcacaatagcaaagacttggaaccaacccaaatgtccaaccatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacaccacatgttctcactcaggtgggaattgaacaatgagaacacatggacacaggaaggggaacatcacacaccggggaccgttgtggggtggggggagtggggaaggatagcattgggagatatacctaatgctaaacgacaagttaatgggtgcagcacaccaacatggcacatggatacatatgtaacaaacctgcacgttgtgtacatgtaccctaaaacttaaagtataattaaaaaaaaaaaaaaaagaaattgaaaatctctgccacagggaaaaaaaaaaaggaaaaagtaaagaaaatggggccacagacaagctttaagtgagaagggtgcctgaaaacagtgctaataaacactagattaacagcactagtcacttagagagctaaagcataacctgactttaatgcggccagtacatagcacatattatttgtttctttcattttcttcaaccagaccactgaggaaaaggctacaatgagtgcaggaacatttgaggacctgaaacactcttttcccattaaagaaaatatttcatctgggccaaaagcaattgcaacaaaagcaaaacttgacaaatgggacctaattaaattaaagagcttctgcatagcaaaagaaactatcagcagagtgaacagaaaacctacaggatgggagaaaatatttctgaactatacatctaacgaagtctaatatccagaatccacaaggaacttaaacaaatgtacaagcaaaacacaaacaatcccattaaaaagtgggcaaaggacatgaaaagacacttttcaaaagaagatatacatgtggccagcaaatatatgaaaaaacgctcaatatcactaacaattagagaaatgcaaatcaaaactacaatgagatacaatcacacaccagtcagaatggctactgttaaaaagtaaaaaattaacagatgctggtgaggttgcatggaaaaggcaacgcttatacactgctggtgtgaatgtaaattagttcagccattgtggaaagcaatgtggagattactcgaagaacctaaaacagaactaccatttcgacccagcaatcccactactgggtatatatccaaatgaatataaattattctaccataaagacacatgcatgcatatgttcactgcagcagtattcacaatagcaaagacatgaaatcactaattgcccatcaatgacagagtggataaataaaatgtagtacatatataccatggaatactatgaagccataaaaaagaactagatcatgtccttggcaggaacgtggatggaaccggaggccatttccttaggaaactaacacaggaacaggaaacaaaataccacatgttctcacttataagtgggagctaaataatgagaacacatagatggaaagaggggaacaacacacattagggcctacttgagggaggaggttaggaggagggagaagttcagaaaaaaaatctgtcaggtactatgctcagttactcaagtcattaaacaatctgtacacaaacccccaaaccatgagtttacctatgtaacaaacctgcacgtgtacccctgaagctaaagtaaaagttaaaatttaaattaaagaaaaagaaaatatttcatatggatattcattcgggactctttcaccaactttgcatcacagatctgaaagtggggagtacaaaattacattttataaagtaggaaggcaggttatagatgccagctgcgcttctcagggcatgcaaaatgacttttaccaaatttaaagaagaaaaactaagcaaatgaaattttttaatctttccatttcagtgaccaatggtgagactcttaaacgtttggattccttttgaacaacaacaacaaaattatatttggattccaagtgcctcattcaaatgggctttcatgaaaaagcaaaatgacagggcctaaatgtaaataccactaaagccccaggaagctgaaaagaaaaacaaccagtagggaaaacgtgttctctgtggtcagaagcagcaatgattcccagcgattccatgctcggcttttcttaaaataacaaaccatctaaagagagaaggcaagtgtgttctgctgccgtggtgatgggaaaaacctcagccagcagcgatgggaactgactagtcagacttggcagacacaagccccgggaacaaagtcaacagcatgcttcatgttttagggaggcttgtctactgtgcatcttcagaaaaaagatttagaccgagaaattcatggccacggccagaggttgatagtaaaaaggtagctagtctaaaaacactcagccctaataccaaatcgtccttcacatacgtttccaaaacctattttctatttatttcttttctattaaattttatgggtggtggtgaggtgagagagtagtaaaaacaggctggtggtggcaaaaattgccattctgtgctaccactctgggcagaatctcaaaagctgaaagtcatgccaggctcaggatcatcaaatagaaaccctgcatccagcctcatccatgtcaaccaggacttcaagggaaggcctcttcttacatatttccatgtttagaaactgcacacacattccatgttcacttactctaaggggtcaagaagttccttgtgatatatgattaatatgcattctcttcattcatttgactcagaagtctaacctaatctgtgcaaaatagttactgaaagattagaaactattgaatttcgttctttgttgttttgagttttcttacttttttaccactagtagtaccaattccagaccacaagtgatttgtgaaattcagccttcattttcaaaactgcgtataagcctatttatcctggaaaaagaactgacagttgactaaatgaaagaatcagcacaatcatcccaaatcttgagtataaacatctcctgtcaatggtctgggatggttctcaaagtggtttggggacctctgaggatctctgagaccctttcaggggtccatgaggtcaagacatctttataataatactataatgttataagactttttcattctcattcttcacaattgtacagtgaaattttccagaggctatgtgccacgagatgacgttatcactctgcagctaatgaaatgtttatatattcttgtacttgaaaaatctatcactggaagaatcgatattgttaaattggccatcctatcccaagcaatttacagattaaatgctatttctattgaactaccaatgacattattcacagaattagaaaaaactattataaaattcatatggaaccaaaaaagagcctgagtagtgaaaacaatcctaggaaaaagaagcaagcaagaagcatcacattaccagacttcaaactatactacagtgctatagtaaccaaaacagcatggtactagtacaaaaacagacatatagatgaatgaaacagaacagagaacccagaaataaagacacacgcctacaaccacctgatctttgacgaagctgacaaaaacaagcaatggggaaaggattccctatacaataaatggtgctgagataactggttagccatcctgcaccccttccttacaccacacacaaaaatcaactcaaaaatgcatcaaaaatttcaatgtaaaacttaaaactataaaaatccttgaagaaaacccaggaaataccattctagacataggccctggcaaagattttatgacaaagatgccaaaagcaattcaaacaaaaccaaaaattaacaaataggacctaattaaatcaaagagcttctgcacagcagaagaaactttcaagaaagcaaacaacttatggaatgggacaaaatatttgcaaactatgcatctcacaaaggcctaatatccagactccatagggagcttaattgaacaagcaaaaaacaaacaccaccacttaaaagtgggcaaaggacatgaacacttttcaaaagaagacatacatgcatccaacaagcatatgaaaaaatgctcaacatcactaatcattagagaaatgcaaaccaaaaccacaatgaaataccatctcacaccagttagaatggttattaaaaagtcaaaaaacaacagatgctgacaaggctgtaaagaaaagggaatgcttatacactgctggtggaaatgtaaattcattttgccactatggaaagcagttcggtgatttctcaaagcacttaaaaacagaactaccattttgaaccagcaatcccattacagcatatatacccaaaggaatataaatcattctaccataaagacacatgcacatgttatgatcactgtagcactattcacagtaacagaaacatggaatcaacctaaatgcccatcattggtagactggaaaaaaaaaatgtggtacatatacaccatggaatactatgcatccatgagaaagaatgagaccatgtcttttgcagcaacatggatggagctggaggtcatcatcccaagtaaaataacacaggaaaagacagccaaatactgtatattctcacttaataagtgagagctaaacattgagtacacctggacacaaagaagggaacaacagacaacagggcctactggaaagtggaggatgggaggagggtgaggatcaaacaactatctatcatgtactatgcttaccatctgggtgaacaaataatatgtacaccaaacccctgaagcatgcaatttatctgtagaacaaacttgcacgtgcacccctgaaccaaaatcaaagtttaaaaaaatgcttcattatatttaataaactcccaattactgatcttacaataaacattggtagatataactaacataaacaaaagcttcttgaagtcctcagtaacttttaagaatgtaaagggtttctgagactaatagtttgtaaagggtgggggttttatgaagagagacctttcattcaaaatattactaaataataactttgcaatgtggtgtcacacaagcagctgggtgtctaaaaactaaaaaacttaaacatccttaaactatttttcttgaagtccagctttcaccagtagcccagacttttcctttctctggatttttgcttcctagttgtcctcttggggagaaaaactttatctcattcaccatctgctattcttcctctctgcttttgcaaagaaatcctttttctgaaatcccatcatcacagccactcactggagctcttaatcacacacttccttacctattacttaacttcttcccatgttagttaccacctttacttctttactcatttttcattattatttataacatacctacttttttaaaaaattgaaatgatccatgataaaagacacatgctactgcctctttggtaatacctcccatagctctctgcctggcaaactatatgactcacagttgaagctatggacttgtctggactgcatcttctccctccacaaacagtgggactgggctcatactgaatctaatgcagcctcttatagagctgctgagccatcatttttgtttacaggattgcaacccaccaagattatgagatttacagtcacaattgtaaatcaaaatttacaattttaggggaaatttttctttctcctaaaactagcacagaaaagatgtttgataaccaaatcaattaatgaatgtagggctatagatttagaaattaaaatttaagagagataaaagggtaagcaaatgaacaaaacagcaaagctacaagatacttcatacagtacattaaatctcattttggccttcctgaaagttaacagagaaaagaaaataagagtttggattcatttgtttccctcccctcaatttcttttactttttgtatgaaaattttccaattctttttcctattctacacagttgttaagcaatctcttgttacatgttcatatttgatatttaaataaagcttttcttttcaagcattataatacaaagtctactagtccctcaccttacatgttgataagcagagttaaaaaacaaacaaacaaacaaaaagaaagctgatagcacactctttagaatggctgcaacaagcaaaaatatttactttttaattttctttcaggaatatatcaagcacttatgaaacatgtgcttcccagttaattcagatcatgttctgtttccccaaatgtgtatatcttgtcagctcaaacacaagtggcccctgaatctcaatctccactcaccgctcctactcattaaaattctggtgggatggtgagaatgtaataaaaagatatatgtgagctttatttgcaaatataaaagcatgtccccacagtatagcagagagagagagagaaaaaaaattcaattcagtagctttcccattcaaagtttgttaatagacgggaaagaaaattcaactcataatacatgatgagaacctttttcactgattaacattatacgaatagttttgcgcgaagtatttgtgtgggtaaatattagcatacaattattattcactcacttgctgatgacagcacactttccagaaacagctgggaaatgcagaaggaacaagctcacgagtaagcacctactgtgtgctaggaactccaagtatatttccatttaagctccctaaacatttgagaagtatgcatccatcacttgtagtacatagatgaagaaactgatgctcacggaaactaagtaacttgcttaagatgacacaaaagagggaagaaaaaccagaattcagatctgggtttgtctgattccagagcacacgctgatttttctacattgggttgccacctggaagtaatctcttagtattgagaaccttcccccagaaaacaagcatgtcacctgagcccaactaacccaaaagtattcaccatcattctccaaacacttttttcctggctttcccattattttaacaagttatgtgagtggaagaatagaacaaatcacatcctttctttacaaaggaatttagagaacaaaacccatcattaatatttccctctttcatcatcaactttcctgtaattcagataagcaaaaactcagccacctagatttttatagccgcattggcaagagtgtgaaggattccagcagcaaacatacacgcaaggtcaggaagtgccaaagccaccaagagtacatgtgacttcgggggttgggggcgggtgcgcctgcccacccaccacaaatcttagccatctgggctgtggagaaaaaaagggaggggagacattttgtggcattgctctgcacttcctcagctgtccctaacggcagctccagattaaaaaaaaaaaaaaaaaaaaaaaaaaaagggctagactggcatatctgattttaaaaatatgtccacaaatgaatatataataagtttaaaatatggggggactggaaggaaatacatcaaaagattaataaaagttatctctggatagtgagatgatccatttgcgagctctgtgtttttctaattcttccaaaattatcagaaaaatattatttttatatgaaaatagttctatgtaactatatgtagtatattattttaaatatttccgttttcaaacttaaaaaaaacagttgcatctagagggtggtagcctgactatttagaataactgccctccgttaggtctcagataattgaagtaatactcaggttttaacgactacccacacaaaccactttggatgtgcccaaattgccttgttcttggtgggtatccaatgggtcagaagatctatttaactgggtgctttgaattgtttgtgccagaagttttcttttagctggggtctctttcctgtttcatcatcaatttttaagttcctaaaatacatccagtaaatttaccagtttccttcatctatggtgctgaaacttaataaattgctcttttttcagctggaatgtcacgatgtccagtttattcattcatggccttacctgtgtgtctctgacaatattactactttggctttcacaagattcatattcctgaactatggcttatggctcaaatccagcagctctcacacagggcacctccttgagtattcatggcaattactgatgcttaaagatgaaagtcttggaccacagcgtgccatttaatgtacttctgaccttgcagatctgtgtgtgcttaacttctccacgtggatctcgcatcctcccagggtgctacgccgaataagagattatacatcaggggaatcactttgcagtcaccgagacagtgttttgaaaacgaaggaagaatgcaaatgtgtagaaactactgaagagattttaccagcaggtagtttataaactcaaaaccaggaatattgcctctaaggattgcagcttgaccaattttttaaagtgtatctttgttatttttttgtgatactctctaccaacatttagctttctttctttctttctttctttctttctttttttttaaatagctgggttacacatacctagaatcacagaacagtggatctggaagggaaattagggatcctcaacttcaacctgttcatgttaaagattaggaaagctgtggatgtgaggggtcaggtgatgtgatggaggcctcacagaatgagtggcagagagggccccagaaatagcttactctgttttcctatcatttgtaggtagcaaagtatataattaccacttttgtcattagacagttgttacataaaagagtagtcttgcaggtaaaaataattctaataagatattcacttacaattaaataattctaacagtgtgaaggttcacttatgatttttttaaaaattatcatgaaataacaaacatgtagccatgttgaggtgggagaaaaggggtccttacgtctaaacagcaagagaaaaaacacacaagaagagccaatctgtcaccacgagagctgcactgagtccttcaatcttgagaataaacatggatagaagttccctctgaaaatgcagttatagtgctaaatgaatgacttaaagacacatctttcctctttgttttgtgccatgatctgagtgccttgagaactagctttcatccgggcacggtatgacatcatctgataagtgtgatgctctatagtcgttgccggaatgggctagggtacaaaacagagaaacacacaggcaggaaggaaggcagagaccagcgctaatttaaacattctatcctgaatatttcagttgctccataaatgtttaatacttggtgccatattacaggatgttcataagcacgcagatatatagatgaaaagtaaaataacataagcaaaacaaagctcattctcaagaggtgaggatggctatgctttctgttgctggagtccctttacaaccacatctcttagtgcagctgaagacttccagcatcagagacgatttctggattatgagaacctctactttagccttatccctctatactcagagccacagtggcctatctggccttccccctctgcctatgaccctgagacctttgactggcacctctgagcagtggtctcaagaggacagccttgaaaatatgactcaatcctccatgacagcgagaccagaagatccatgtagagcctatggctgatccagaggttctccaagttgatgttgccatcccatttctgcctctctgtaatttgtctaaagactcactgtggtttcacggatatgatcttggatgtataaaatgggaagtagctgctaaaagatgagaaattcctggcctaagtcagttctagtaatttcattcactcattaattcgcttgttcattcaagagatagttcctgcatgcctgctgggtgagtgtggttacctgtcctccaaaacctcataatctactagggaaaacccacacaaacaataaataaataaataataaaacacaataaaacgatagagagttatgaggcttgaggggatcatttatagaggtggcactgtcctgaatctagagtgaggagaaggattcaggaggcagaagggaggtcaggccgcaccccatactcatgaatatctgattagtgtagctttcaagtatcactgaacatctttgtcctttgcaaacaaaaagcattttaatatcacaaattcctgagtgctagggaactcaatcaacaactgtaaaatgttctgaaaatataaaatgcaacacaagatctaaaagtcattagtaacaacaaccacaaaccccccctcctgctttatcctgaagtgagcctttcaaccagagggaaaaacacgaattgcctgaggaagcaggggtaggagatgtgaggactaagattctgctttgaaagcagaaagggaagagttgccaccattttaacatttagtgactagcttatttatatcccccttggccacagtgacaaaaacacagctttatttctaaagacaaccacacgggccattattcagccagccttctcaactgatgatgacgtgaactgtgaatccacattttttcctgttaatagacaactgaaatggaacaaatatcctgaactcaccctgatctcttaccactgaagagagcaaacacaatactctattcattctttcatccaaattcaatcattgacccacacattagtgcaccatggtgttgtgcattaaattagttctcatgaacttctctccagaagggtgtattagttgcccggagctgccataataaactaccacaaactgggcggcctaaaataacagaaatgcattctctcacagttctggaagtgaggagtctgaaatccaggtgtcaaggtgtcattgggagttggttctttctggaagttctgaagaagaaacagttccatgcctccttcctaacttcttgtggttaccaacatttcttgacattccctggcttacaaactcatccctcccatctctgctcccatcttcacgtggcattccccactgtgtctgtgtctgtcttttctcctcttcttattgaacaccagtcaaactggattaggacctactctaatcaagtatgatcccatcttaacttcattacatctgcagagaccctatttccaaataaagtcatattcacaggtactgggtattaggacttcctcatatattcggggagatacaaactcatgacacagggcatttcacagttgttttatactactgccttcttaaccaagaaagaggctctcactggcgtcaaggagtttacagcctagagacagagacccataaatctgtcttccccgctcttcccatagctgcagttttagctttgtgggtttggtgcttatcaccttatcacccatctctgccagaagactgtaagctcccagagcacaggcagcatccattttctgcttcccattacattcccatcttcttgcacagtacaagataaagctttcaagaaataatcgttgaatgaatgtatggatagatgagtgaattacctagatacaagcagaaatgagaaaagcctatacaggcaataaaggtacacacaataggccaacaaggaggaatagagagaaagaaataattgattctgattagtagggatatagaaggtttcatgaaagaggaggcatttgagctcagccttggaggatcggtaggattttataaatgaataaggagtaaaatttattccctgctgaccaaacagtatgagcaaaggcctgcagacataaagtatggtcttcgggagaacagttaatagcccaggcaagctggagcaaagagtatctaaagggatttaaaaacactttggatgaaaaggggaagaaaggcagctcacagaggcctataaactaggctattctgagtgcagtaagaagccactgagctttgtggagaagggaaatgatttgctcctacctgtgcttcaaaaggaaaaaatatataggaatggttcatacattgatcttttgtgtcctcctgcctgaatgatagttcttatattactataaggagtatttgcgtattttatatttacccatgcaactactatttacttgatttgcctaaggaactaagaactatatacaagcgattacattttataattacacaattatatgatatatatcatataaaatatataattatatgatatatatcatataaaatatataattatatgatatatatcatataaaatatataattatatgatatatatcatataaaatatataattatatatcttttataattaaaagatcgtatctgaaaagtacttaaataggataatatcacaggtcctaaatttcttctccagagaatgacctggagtttaaggcccaggggaagatgattaactaccaaagtaataacaaggactttcacctgtaacaaagcagttgttccgggtcaggccaggttctttggtttaggtttgagcatgggaagtccacagaccaagtatattaacaatcaaggtggtgcaagactaccatttgttgttctctccaggaagcaccagggactccatcactcatcacaggcatctggatagcagccaagcaccatgatagtgggatgtgggagagacactccagctatccatggaggactgctcaatggctgaaatgctgccaaatggagagacatgtactatggtcttggtgccaccaaaagtcttcggtaataatgcaactattcttaggaagaagtattcagtcactcatctgtaaagggattcattatatagaactgttaaccaagagaaacaactacctctttgcccgcttaggcaaatgggagactgggaatctggacagagcgtgagtgaacagaatgaagatgacaagaaagggaaagaaagctcttttcacccttacgaaccctataagttaggccccagactttctagtttacagtcatcactttgttatttaggttataagacaatagaggggttaggattgtgtttttctgttcacattggtatccaggtcctagcacgtagttgtatcagacaaatgtgtgcccaaaaggagtgagctgctaggcagcgtgttcctattccatggcactttgagtatgcttcttggaacttgagaatatattgaaattgtgcccatgtgtctacctttcccatgggacagtaaccatcctaaggaaaggaaacgtgtgtgcttattactactatagtgcttgacatttagaaagcatctaattcttaaagctcagggggctcaaataacttacatgaagttaaatagctcataaacaagaggcttagatttgtactaggtctgtctccaccccaaccctatgctgcttctatacctcagtgtagaaagaaggagagtcatactatatagtttagcctgaacctggcctatagattgaaatgtctctggaaacaggtttgctgctgctttccagccttctaaatcagacagttgcataattatttaacatgagtgtttcaattatttaatgcctgatcaaaacacaggcgtaacataatttaaacacaagccaaagcatatacaccacaaaaaaatactgagtccaagtaatcattttccaaaacatattaaggtttttatttactaatggtcttaaatttctgtttaaagagaataagcttggttggccctagaaaatcttggagaaattcaaagcaaaatttcttaagttaattcttattgtatacataatctagctcttataaggaaatattgtaaacctgtttaaacctatcctcctaaaacccctagacatgttcttactcataaaagacagtagaataaatcttcaaaacctaattattttaaaactgaatgcagttctttacatggtctatcgattttatccttttgccaagatatcaaaatttttttaattgaaaaaaagcaactttgaaaatgcactaggcttaaacctccttttataaactctcaaattaacacatcttagtttaagcactaatgaaacacatttcattccagtgggattccaaagattaacaatgtatcaacacatatcccaatgagtgcaaaagaaaatttatcctagacttagtattaaaaattacatgccggccagcatggtggctcatacctgtaatcccagtgctttgagaggctaaggtgggaggatcacttgaggccaggagttcaaaaccagcctggtcaaaatagcaagaccctgtctacataaaacttaaaatacataaataaaaaaaatgtagctgggaaagatgattgcacctatagtcctatttacttgggacgctaaaatgggaagatttctggagcccgggatttcgaagctgccgtgagctttgatcctgctactgtactctagcctgggtgacagaggaagactctgtctcaaaataaaatataaaataaaatttaaaattacatgcaaaaacaccagaaatgaaattctatcttgagaaacgctttatcctttgtactttagattttttccagaatgggcaactttccatagttttatagaaaatgtttatattgttgggcaaaaattctgcagttaagttctaaccacagtctggaaggaatttagcatgaagacaagttaaaattacaaagagtgtttttccccttactgataaattaacaagtttaactactacggctaataaaacatgccttaaccatccttccttggtattttttaatagctttgggaagatttgggggaaaaaaaaagagtttcagagcaacatattcattgaggttagcaggttggctaggaggttagttgaccgggtaactggctgacccgacagacaaattttaaacatttattttgcataattgaagcaataaaatggatttatgagcagttgattagagaatcaagtttgttaaaattcctttatagccttacgtttctcaaggcattcaaccaaaaggaacgagacctttttaaggtaccagaaattaagaaggaaaatgccctgaagagactgaggtattctccaaaaggtcataaccttgttgtatatcaaatcattctaatagatattccaatgttgccttccagaagcattcatctgagaagacaggatgtcttaagtacctccttacaggaagggtcagtctctaaacactgaaatttagagcatcagccctcacccaatcttggaggttagctaaaagcatcttgaaggatgaccccgaaagcgtaggagaggagagtttaatctgtggctattcaatatgcacctgactgctcatgcctgcaaaataacccatttctggagaaagttgtatagcctcttccatttgctctcttataattgatcaagccagaggaaagggggtcctccatggttcttctggacccttccacgttggcctattatatttcagcagtttacctcttctttaattagcaggcatagctcaaagaacatagacattttgatttaaattttctaatttagtacccatgatgatattctaatgtgtcttgccctctgcctataaattgactaataaaattaaataaattgttactaggggcttcactaaaatggtctacaaataaaagattacatccagaagataaaaagaaaatacacaggaaaatgacccaggaaaaaagctgacctggtctgtcaatttgctcaggttgaaaatatgtggaaagaaatgtaattgtgttttatgacacttaaagggaaaaagtacttctgatttcagtactatctagaggataaagtcactacttgattctttgtttctccaaggtaagagtttcccatcatcaagatgtctttctcaaatacatgatttatggaaaaaaacaaaaaatgttcaatgagcatctatggattttgattcagaaacaaacaaacttgctaaatggtcttctaacaaaatactaataatcccatgtgggcatacttcacgcagagtaatgccatttggccctcatatttcttagaaagcttttgctgcattcacatgactttccaaaagataggcaagcaaagagcactgtaaagaggctgtgtctgagagaaaacacatagttggctattaatagtcccactcctgctggcttgcctaaacacaggactggctgtatttccccatcccagcatagaggaacaatgttaccctgccaatcaaatgcagcatactccaaccttaggcctttgcaacgaagcagggtgtcgggtggaagaccagtagctcagaggctgtgacatctgtaactaggataactccaattaaaagtagggggaaaaaataatttttaaaaccttatatagtaatgaactggaaggacggagaacaacgatttctttagcaacagctgtgcagactgatttctttgaaaatcatgcatatactttcaaaagcactcaatcacaactgctgccctaacactggcaaatccaagaaattcaagacatgtaatcaaaaatagattttcccttaaattccaaggtcaaaggcagcatctgttgtttcagagaacaagaaggactttcttttggctaattaacttattgcggttttctagcagaaaaaaaaaagtaaaccaaaattgtctaaatgtttcttcatcgtcttaggtcttaggtaatgcaaaacagaaaactgtataaagagcataaacatccattgttttgatatttgagttgcacagataaaaggcaggccacgctgtaatttttaaagctgacaggaaaattcatttttataccaagtccccctcatgccatttggctgttaaattattcaaggaattctctgcttataaagattaataatatcaacccaagccatttctgaaaagtactttcacctcgtgtaggagacagatggactacaggaaaacagcctattatgttacaggcagacaaaaagatttcagattaccagattaacacaccaggcgggaagggaatgatagaaagtagcgagatatgaaataactgacaaatagaaccaaatatccctcagagccactattttaaaaataaatatagtttggagcccattgtaattcaattttacctgtttcactcccaaacccagctaattagcataaatgtcagttccaatttaaccaaagactttgaaaatctggtggaaccttattaaaacacattggtatcaggggacaaagacagcacctgctttcaaggtcttttgtgttttagtcagaaatgtattctaaaactctgggtatatgggctgaatccagagtttagattgtgggattttattgtacatttgcattattttaaatatcaacatccctggagaagctatttttactcctacaaaacctaaacacttccttatttagcaatgctctcatagagaagggattttccaaaagctgtatttcactaagggtcaatatgaaaaaattacaatgtcattaaaatcacagattttttgtagattcacagaagcaggctcagtgttttctttcaataaatatcttttttttagttcaatacattactaattaattttaatttcacaaatagtgaaattatctgagcaagaatcattctcatttaaaattgtcaaataagtcagaaaaagatcaatatctcccctgcttcaaaaatgacactcccaattttcacaggtaaccactgttaacatttagtaaatacctttcagaaccttttacaagcatatataaagtacatcatttttgtagtataatgtgttttctttaaaaaaataactgggaccatactgtattttctacaatttcctttgatcattccaaattgctatgaaaatatgtcacacgtaacttgaaaacttggtctacttctaccatatacgcacatatgcaggtaggcaaacatacagaaaaacacaaaatggtgtaaaaataagccactaagaaaaggctctatgtccctcatttcagtgctcaggaaagctataaggctgataaaatgaaagtgccccctttcctcaccaaagctttggctttgttattagtgttttttttgttgttgttattattgttgttttcttttctttttttttttttttttaagtgcaaggttgtgaaactctgccaagtggttcaaatcagatccactacctgcttttgtatagccagtgagttaagaatttttttacactggtaagtgtttggggagaaaacgttttaaaagaacagaatttcatgatatgggaaagttgtatgaaatttacattttggtgtccataaatgaagtttaattggaacacagccattctcattcctttgtgtattgtctgtggcagcttttgtgctacaagagcggtagttgattagttgtgacaaagaccgtatttctagaaagattgaaatatctactctctaggcccttatcaaaaatgtttgccaatatctgttttagcacatgaaatttattttcctaacatcttacttgcaaagtctttcttcatattccatgttgacactcagtgggtaaagatgacagaagtatgctggggggcaggagtagaaaatggtcccttcacataacccaacacataggtaacttacgtatgcccctcctagaccttcagaaaactctatcaggcttaaaaattacttgtaatgtattgccataagagtgatttgtggattacaccgcatggattacgttgccctagaatctaattcattcatctatctggtgagcacctactgtgtccgaggtcagtgttgggcactgacaatttcggggtcaagaaaatggacatcatctctgccctccagaactcccaccccaatatgttcattacaatttcgcgaacctatgaaagtacatatcaggggaactaaacacagtctgaagggtggatgagattagagaagatctgaagtaatttcagtatcatcagattgaaaattctttaaaaataaacagtgtgaagatactgcacaggaatccaagtgagaatgacagaaactgacaccacctgactgtctctgtcttcaaactctgctcttcataagctatgatctagagcaaagggagcattttagcctctgattaagatggtatctccttccagttaatgtcaaatggttagtgcttggtaccatcaatagattgagagtttaaatttgattttcttagtgtttctaatccaactattatacccaaaacccctccacagaaaacagaaatgaaactgccaatccctacagtagctccagtaaatatccattggcattttaaaaaacaaaacgaaaacaccctgcccatgctgcaatgtaatcccagtagctactggcagtgacagctggtcattcccaagcagaacgtcacccaaataaaatgtgaaagagaggagggaggaagggcaaaaccaagatttcagcaatattctgcaatccaggaacctatggagcatttgggtaaagctctagtaacttcaaggctctgtgcttttaaggcttgaattcttttgagtaactgaactctgtgaggacatttaaattgggtcagagtctctcactcttacaggcttccttggtatccgatgttcctgttgacttcatagagaactaaacaagcataaaaggtctctagagagaagcagcaactggaatctaggacagaaagaacaaaatgactttacatggctgctactaggtttctgttattttcatacaaatggctgagtgagccctgttgtatctgacactatctgcactggtttctcattagaacctgagctggcgagggtcaggtgttcttgttcatctaattgttggtaattagatgggccacccttacctacacaaagaactctgagaactaaaaaggttctattattcaccaaatacaaaaaaccatagaagaggactgcaggtagctaagctttcgaaaatgtcagttttgttgttattgttgttgttttttacccacacatatccaaatatcatctagctccaaaaggaaagatttacgtagtcgtcagaaagagaccagtttgttaaagagaagaactcagggccgggcgcggtggctcacgcctgtaatcccagcactttgagaggccaaggcgggcggatcacgaggtcaggagatcgagaccatcctggctaacatggtgaaaccccgtctctactaaaaaaaatacaaacaattagctgggtatgctggcgggtgcctgtagtcccagctactcgggaggctgaggcaggagaatggcgtgaatccaggaggcggagcttgcaatgagctgagatggcgccactgcacttcagcctgggcaacagagccagactgtctcaaaataaataaataaataaataaataaaacaaaagagaagaactcagattggctggtgctgtttctaacaggaaagcctttctctctgcaaacaggacagagaccaggaagacaaacaccaacagaggagaaaggagaggacatccaaaagtggagtggcaattataaagtaatgatggttttataaacagagaccaaaggcaaaatgcctttgctgactagtggctacgtctagggattaagaagctctggacatctgagtagcctccaaatatccctttgccatagtcacatgagttgtggctaataagaactaattaacaagtaaaacttcaggaaacacaattaaattttagataaagttagtatgtcctgtaactattatgtaatatggaacatacttataatgagtataattatctgttatctgaaattcaaatgttcattcttaattctaaattcaacttaataaaatattacatacttttagttatggaacacacttatccttaaatgttattgtttatctgaaatttaaatttcattgagggtgttgtattttatctggcaactttaattgtggccagtacaaacagccaaggtcagtaaactatcaagaatttcggggagccgataacagttttctgatatgccagaggaccactctggaaagggtttatttggggatttgattcattaattgatgtttgcacaagggctaggaggtacatagtactcgggggaacctgcttctacctcttgaatgaaaaagagacaaactttgctgacatcagggacttttgtcagaaaacaagtcccagagcccttgcagaattgtgcccactcttctcgagcctcatctgctctatccagaattcataacaactgaggtccataatgatgcccttgggtcttcgtgggttcaaatttgtttagaagtgttcactaagacagcatgttatgtggcagggaagaggagaattggaaatgtttccaatatcaagattatatatttcaagcccctaaaaattaccccacccagaaccttgaatagaaaaagaggaaagttaccaaaagtgatcagtaaaaccaagaggaaaactacaaaggcattgaatcaaccattggttttaaatgtttttaaaatttgttagtgtatttctttggctttattatgtagtatatacaaaaataattgttaatctttgaattgcctttatctttcaagatactgattctcgttacagagtattatagacagacacacaaaagcagcagccatttaacctaaaacgacagaagcgtatataacaagtgtcctgaaaggcttatgtgcatttccttctcccacaagaaaaaaaaagaaaaaaactcccactgaggttccctaattacttagattttgataaaatgataatcagcaggtaaaatctatcccagtgattctcaaacattggtatgcatcagaatcacctggtgggctgcaaagttttatctaaaatttaaatctaacagtttgtcctgaaacatagattgctgcaccagaatttctaaatctgtaggtctgggatacagcctaacaattcacttaaaaaaaaaattccagataatgcaaatgcttctagtctggaaatcatcctttgagaaacaccagtctgtgcaattataggtaataatattgtttaatttatttgttcacattgagtatttaggatttgtgctaccataggagcaaactacctctgcccttgagggtgctcttcttaggattcatacctagtctgcttatatttttagactgtccagaaagtccccaactcacaagcaccatacttagaatcatctactcctacaggatgcctaccctactctgcccctgaaaacccctgctgccaataatgcaagaagcattgtaaaactgttaaatttttagagaatctatggtaaagaaaagacaaaagctaagctatccctgggatgagactcctactttaagataaaaatgatttctgggacaattagggggtctgttatgcaattatacctcagtgtgacttagttcaaccaaactggttcttcctcatgctaagctgaaccagggttgcagagaggtaaatgatcctgagtatgaagtggcttgtagtatcaggcagactcaagtggaaaaacactggtgacctgcaaaaaattgcatcaggcagtgcactatgggttacaattgtagagccaatgccatgtgggtgttcaccaactatttctcttgcctcctgagcacacaggagagctacctttcccggtcccctcatgtctaggagggaccaagggactggttctacccaatagcctatgggctggagggctggacagtgctatgcctggccgctaaaacaccccacaaagatggatacgctctctcttcagctgactctggaggcaactctgaggaggccctaggggacacagtgtgactggacaaaagttaccaggatgcccgtggcattgcctggaggaaagctgctcatccagaacagtagctctggagtctgcaggagaaagccacagaccacaaaatattaaaccactgagttttggtgggcggggtgggagcaaaggggggtgtgtaatgtgttaccgcagcatagcctagccttcctcaactaatatagctgcataaaggaaggtgtaacgggtgccccttcatcatcttagccagaccaaactgttgctccactccattgttctatattacatagagccaatatcaactttataccagatctgtggctcccaaacctggctcataaaaaaaaaaaaaaaaaaaaaaaaaaaaaaatcacttgtttggaaaaagaaccctgaaccctatttcagacctactgaatcagaatctccaagactcaggccaggccacttcttagacaaactgcatgttataaactaaatgtctgtgtctgcaccccaaaattcttacattgaaatcctaattcccaacctgttggtattaggagatgcggcctttgggagatgattaggtcacaaaggctctgccctcataggattagtgcacttataaaataggtcccagagaagccattacccttgtgaggacacagtgagaagactatgaatcggatcatctatgaaccaggaggcagacccttaccagacactgaatctgctggaggcttgatcttggactcaccaggctccagacctgtggcaagtaagggtttgttattcaaaccacccagttcatgatatttttgttgcagcagcccagatgactgggacactgcagattcgcctgcgtggggctaccatgaaaagtccctttcaaaggaccagtttgcccctatccagagactgggtgatatttctgcagacacacagtttaggttattgtggtaggtttactaatccttaccaaattattttaaagtgaggattttaaattatgttttggcaggaatcaaatattcaagtgtaatgggtttaataaatttaaaagcttctcttttaagatgacgcaataattggcataaagccgaatgcctgaaatacctaccagtgagaaggatttaaatgttcaattaaaatgatttgagatttattgcttgtgaggaagatatttaaatatgtaaatgaaactggctccccaccctctccagtgtgggggtggattctgcctgcctttcctcatgccctctaagggagtctctctgccccttgaggacaaaggcattcaaatgacagagctggtggctgtggcaggaagtcactaaggaaacaatggagggcgctgtggagatggccacttccttcttcctcaaacacagcaaccccacccacctcagggcctttgtacttgttatttctgtaatcttcatccagatgtctgagagacctgctcctgcactttccttatgaaatttctgctcaaatttcatactattcttgatgccttctctgaagcaagaatcccttgctatatacacacacacacatacacacactccttacaccctattttatttttctctgtagtagcttcactatctgacacgttaactattacttatttgtgtatttgctgtttcctatactcgttcataatgcctggtccctactaagtgctcaaataaatgttattatcattttaaaaaattatttaataccatggtaagtatttttcattgtctcatgaggcaattaagatttggcaatattacttcagtttaattatttcccactaatatatatcaaaaatatatatttttaaatcaaaagaatgtaattgaaaacagcagggcctccagatagagaaatgtgtccaaactgcagatcttttctaatgagctgtgtgtccttgggtcatttaccttaaactctgtgagcttcagttccctcacatataaaatgagcataaaaattccagctttcagggttgttgtgaaaatgatacatgaaaaaattaaatccctaagcacatagtgtgccccactgatattctaaagaagtagatggcaaaataaggaaaataagagaataaatgcctttttatttatgccagtcattagctaacaatcaaccactgtgaatgaaaaaagcctagtaaagtcaataaaatgtgaagtgaagcctaattcatttttacaatatgacctactttctgctatttttgattcacatgaacaactgaagttgcaaggagctgatcctgcaaagacttcattaaaagcatattcttttcttttctttatggcttccagctttgagggatgcgaaaacagatttttcacttacaagcctcctttgaaagaaccctggcactaatcttacagtacgactttgaaaatctgtgcaatgtcaaaggttgtcacagatgggggaaaggagggaggacctgaaggaaagcggtttttaattctactcaattatgcaacttccattaggcagttctgactgtcctaaatagattattcagatcttaacatttgaaggtttgcaaaaataaaattctgaatgatcttcttccttcgatagacctaggtataggctctgtggagaaggcctagctgtgctggtttttcatctgggaaatgcgcttattagatactgaccccaaatcagtcaagtgtcattgagtcttagacagcaaaatagctgaaagaaaaaaaatattttcggctgctttggaatacctttgtaaaggccattgtcttttctttcatggactacagtattctttaaccaacttaatctacctgctaacaaagatagaagaaggaaggcttattttcccataaggctaaacaaagattaatgatagccaaccaaattgtctcttaattttcttttcttctccctctccagctggccttctagagatagagtgtatagatttttctcttagttaagaacatttacttagaaagcagcagaatactaataacaaaagagtagggggttgttttgccctacacatcacaggaattctgccttgtaagctggaggaggtataggggcattttattgttgggggattcttaaccaggcagatggggaacctagcggccaaaaaccttcttgggtgaatcttacatatgatccttctgttcccactatatcctccaaacccaaccccaatgagaaccactactctgcccttcagaccctgacctacctttcgaattatgattgtagcaaaccaatttgtcatgccatgttaatctattcttaccctacgaccccgaattaaaacactcccaggggccccacccaaagaagagtaaatgccaagtgagtggatggaacaggtccgtttgacctcatttcaaaatataggggaaaaagacatggatggtcctcccacaaaataacaccaccacgagttatagaggtgcccatttcgcttctgtgacaaaattttcaaattgaacaatctaagcctttgaaatcctcacatgaaaacaagattttgtgatgctctgaaacagcagcacatgttctgatcccttgctgggtgggaagcactgggggtggttaatgagttctcacaccctctggtgaaccagctcctttcatttctgagtgaagaaaggggccctgacagtgcgctactccataaattcaaaaacaggccactttctaccccagatccacagccactccctggccctttcctaaagggttcccaattaggaatatggcaaagagagccctgtaaataccagttgctgtcatttcttaatattttctgtgatggcttgacttgctaaaatgacaaggtgtattatttttagcttccagttttggcgagttgatcagtcaaaacaaagtattaaaatagcatctacttggtaaattcaatttcagatgactgcatctaaaactcatatccattatagactcatataaaactgacttatatggctaaggaagtctgagaaggaataactaaatatatagctcaaggaggaaagatgaataacttctttggtctcaaatacaagtctattttggcatcaaatccaaaagcaagcctatgataagcaatggattcatttaaatcactttaggacaaatgatttaaagagggttttctaacgctccagtgttccatccaggatgtgtgaaatgcatgagatctcagttaaatgtagcatttttaataaatatagtctaagtcacacgggcctttttgataatgtaatttttttctttgaacgcctcttttacaatatacctaaatgactatgaaaagctatctcgtgataatatatgctagaaaaccccattttatattatttttaaagtaacttattctaatttttaaaagtaataaaagtgtaggggaatctggataggtaactgcaactcactactatctttgcaacttttgtatttaatttaatgtaaattaatctaaaattaaaagttatttttttaaaaagcaatatttgtttttactgtagactatttggaaaagtatagagaagacggaaaatcacctataaaaataggcatacctatatctaactgtgtgtatatgagtaatacatcctatcatcttttgattatatggtatttcccctaccattaaaaattcttcataaactttgttttaaaaggccacttatcattacatcatatagctagcccaaaatttgtttaatcattttcctacgtggaacatttaacttgtttactgtttttggctattggaattagttttacaaacaatataattgtgcataaagccttttcatatttctcattatttcctcagagatggatgaacatttttaggcatagccaaacttctttccagaaaattagccttttcttaaagagcatgcatcacccaacctcagctcgcagtgccaccatttatgacaaccttccaaaatggccggaacgctgccagcttcacacaccacggcacttcctgggaagaacctcaggacagaatatctgctgttgagtcagggctgctatagccagagaaaggtgtgagatgtgtaactgtctccaggtaatccttctgccagccaactacctcctgattcagctataacctgaaggccaggtgcattcacccaaacaaaacccacagaaatcagaggaagggtgactgaggataagaaaggctagacacataaaagaatgatgtgaaatttagcttttaccaagaactgaagtgttatatttggccggagattattcccagcaaaggaaacacaaagatgcttgggtattatctatactaaaactgggaaaacctcagctgaccctataagttacttgaaaatttggggacatttttgtcagaacgacagaaaagcaatattggatgggactagggggtggaaatgctagaaatctgtgatatacagtgagtgccacaaaaagaaaaattattttgccccaaatgccaaaagcacagtgatgttctttgatgttacagccacaactcttagggaagaggccccagttgatggccttcgaactatattctgcttgaaaatattttgtttgatcctaatagttggtgttgggggtgggagggagtgtgtgtgtgtgtctctttttaattttaaatatgaatattttggaacttttacataaagtctagcttttctaaaaaaaagaagaagaatctaagatctgacaacaggccgggcgcagtggttcacacctataatcccagcactttggtaggctgaggtgggcagatcacctgaggttaggagttcaagaccagcctggccaacatgatgaaaccccgtctctactaaaaagtacaaaaattagccggacgtggtggcagccacctgtaatcccagctactcaggaggctgaggcagaagaatcgcttgaacctgggaggcagaggttgcagggaggcagaggttgcagcgagccaagatcgcaccactgcactccaacctgggcgaaacagagactcagatgtctcaaaaagaaagaaaaaaaaaaaaaaaaaaaacctacaacactggatccccattcccacggcaataattggaaaatgaggagtggctgtcccctttgggctgagcaaactggccatttcactcatgagaattacatgcctggccctctggccatcagtttgcaacccctatcctactacaaggtctttcaaagattttagcaaggccccagatagtaacctttccctttccccatcgtgctcagcactcagttactcgacagatacagcacagggagcgcctcccgccaaaggcagtttttttctccaactgcgtatttgtcttttaatcatcatttcctttccttccctggccaaccacactggacaacccaggagcctgttccaggagctgagagcaagtcttcaagtaccagtgccttgtttcttcaccagctctcccaccactgttatcatcacccctcctaaaccacctcccaccaacaaaagtatctgactgaggggtgggaagtgtcaagtacagcactggacagtgggtggggctgatcacaatgactgtgcaccagacaccagggtgcttgtcctagaacaaattaaaatggaaagaagggttttaagaactggaagaataatgtgagatttggcttttaggaaaatcacccaagtagcctgcctgtttgcccttgctctctctcgctctctcctctctgttcacacacacatacacaatcctctgcactgtgaccgtagaaactggaaggcgccttcctgaggatatggagtgagtggaacagaatgttggaaaagatgcctgggagatggaggagaatgacagagaagagagggcagcacagaaagcatcttccgggaggactggtggccatcagagacctgcgaggacctagagctgattcatggccacattagggcatccagcaatggcttgccctgccaggctctcaaaaacctggcactcaggagcagcatggaggagccttctaaaaatagtctagaatcaagctaccttctggctcattccgttttccttcttttaaagattaactaacctcaggctgtgccaaaaaagactagagggggagaaaaaagactcatgaagtcttgaacaggtgctactgtttattcacccaagtctgacatcaccacattgtttctagggactacagcaagtttctgggcttcaaacactccagtaatttccttagggaaaagcagagtatgaaaggaaggtagcttgtattaaatttaaaaacttgaatcctgtatagttgatctttataagtttcttttttttttttttaccataaactgtgccaatccctttgatgacagaatctattattctactagcgcttacaacagatcactgtcatttgaagtgactttcagagtcttcagagatacaaataaacaatgcacccttccttccccaactgccaaaaaaaaaaaaaaaaaattgtctcctcctgaaaaccaatcactagcaaccttctattagcttggagaatctttttaatgcaaaagggtctggaactaaaagtgatcagggcaaggatctcattttattcatatttctatccccagggataagcacagtgcctggtagactgtttgcgtgcaagaaaattttgttgaaaggctggacaaataaaagaaaatgcataggttgtttattaatttagtaatgcaatttccaaattttgttttttcttgttgaggtataatctatgttaaaattcacccatcttaaatgtacagtttgatgaattttaacaaatgtatacagtcacataaccaccacaattaatcctaaaaagttctctcatgcccctttgtagtcacatcacctccccataatcctagttcattgatctgttctccatccctatagttttgccttttctgaaatgtgatattaatgggatcacagtacacagccttttgaggctggcttctttcacttagcataacaattttgggattcattcatgctgttgcatgtatcagtagctcattcatttttattgtttagtcgtattctgctatatggatgtggcaagatttgtttttccattttccatttgataagtatgtagatcatttcccacttttggctattatgactaaagctcctatgaccattcaatacagatcttggtactggcgtgtgttttatttctcctgggtaaatacctgcaagtagatttgccaggtcatctggtaggtgtataaataaccataagaaactatgaaagtgctttctaaagtggcactttagaatgtatcattttacattcctatcagcaaggtatgaaagttccggttgcttcataacattggcaacaattgatattgtcagtctttttaactttagtcatacagtgcgtagtgtatctcgttgcaattttaatttgcatttgcctgatgaccgatgttaagtatctttacatattcatacagcccctttacaggccaatcagatagcttctttggtgaactgagtatctagtaatggaaataaaatctacattactcatttaaatttctccaacatattttgactgatatccgttaataaccttgtcaaaactaacaaaatgggtttttgttttcctccattttccacggcaaatttcctaagatgaattacacacttcctttactccttaaagttaaccattttcacactaacttaaggccttttgttccaaatatccttgatactgtgctgtaacaactgagcacactcttaacctcctatcagttgactgtgtgcctttcttttaaaaattaggtctgtgtttcattttcagtgtttttgtctccctcctctctctcagggtctactatatgctgttatctctgtgccactgtaacctgctgtatgaccacataagtcaagcttctgtgacaattttttaaaaataagcataaacagctctgaggaaaggcctaacagtctaagaacaaagaccatagtcccctcggagggacctgatgacatacattttatggcttatttccagatcatggctctgcttgagaggtaggcaaagtccattaataagtgtccttgggatcagtgagaaaaatctccatcagcatttccaggtgcactagaaagttttgtgggtacttaccaaccaacagtgatagatccctgaaggggccagtttttccagttccaattgtgataccaaataaatatcatgtttaaggtcagcaaagtgaggtagaagtagggttactgctctaatgcagtgctctaaagtaagacctcaactttcctttttgttcattttaacagcacagccctttggcagggagcttcatgctccctggaatcctagtggggatgagaaacacaagagctcctttccctgtggaagcctctggattctgacacagcttcacctcttccccacagcctcacctctctaagccagtttcatgactataaaatgaggataatgaagtacctactgcccaccccagagcactttgtgccaaccaaacatgaaagagaacgtaaaagtgtgctgtgcactaacaggactccaggagatcagcattatcacagctcaaaggcaagcctggccaccaggcatccatggcaatctcatgccaggcaggaagttcctatgaagaaaaacaaagacacgaataccccttagctggaaggagagaaggtaagagcctccaagtgagaatggagtgatagtctgtgcttcctggacagaggaagtcgcaagaggaacggaaagcaggttttgaacagggagaaagcaaaagacctcagataagcaaagatgaggaagggacatgaggtccaaacgttgaataaagaaacagtaatactgggcactgtgggacgcctttgcatgtaaatacggtttaagcctgggcatcctatttgggcggatatagttacaatgccatatttcattcttgaggttggtcagcaagactttccatgaaacttctgctcccttattcccacttactgttccttatccataacgatagatgtgtattacatatacttcttacctgctgactggatcttctgtgatcacacctttcctaatagaatatttatccaggcctgagttccatagtcaaagaaggtagaagataatctgcttaaatgaagtgcctggccatttcattcacttctagaaatattttctcaagattaccatgcaagcaacagattttcaggaggcagaaaagatttctagactttgcccagagggagaactacaaatgccctcaggataaatagtgctccaatgagcagaagcccaaacaaaataggaaactgatagagaaccctagctctagatctttttgtcttataccatcctagcataagcagaagggagagaagctgttctaaccacgattgaagaatgaagctatttagcagcttaatcgaaactacgtacctttgaatctcttaattttaccaggctcttctacgtggacctatatttcggtaattataatggtaatgtggattgcgggaagatatcttcctcttatggctccccactccaagtctttgatttccaatcaaccaacaatttttttaagattatttatgttaatccttccactcttcattgcctcatttctaaactggagaagccctcatttcagtaacaacaacaacaaaagtgacatgtataggggtgtgtgtatatatgaaatcccaccatccttatgaaagtaatttttcccagttttctaggttcatgacgttaagaaagctgaacctcaccagagaatgtgtaatatgttaatatcccccaaaagccaaacattaaacattacttttattagctaaaatttattgaatgcttactatgtgtgccaagaaatgtgcttaactcttttttattattttttctgttggagacaatgtctcgctctattgcccaggctggagtacagtggcatgatctcagctcactgcaacctctgcttcctaggttcaagtgattctcgtgcctcagcctcccaagtcactgggactacaggcatgtaccaccatgctcagctaagttgtttttttttttttttttgtatttttagtagagacaggatttcatcatgttgcccaagggtctcaaactcctgaccccagggaattcacttgccttggcctcccaaagtgccgggattacaggtatcaaccaccatgcccggccctaagtgtgcttatctctttataggaattgcctaactaccgtacagtgcagaaggtactattattagcccaatttacaggtgaggaaactgaagacagagaatggaagagctaacgtttgaatctaggactgtctgactctgcccaagctcataatgactatgctacatcaattagtattattttctgtctcccatgccttccccatgatgttcgtctttcttttctcctaaattcatgcatccctttaacaaacctttattaacaacctaatataatacatgctagtcagagggctaaatacacatttctgttttctccatttcactcattggcactaagttacctcccatctcctacaaccaggtgtaaaaattcaggtgtcagccctgaacctgccatgtgtgggctgaggcaaatcttcactgtttggactaatatggccttaggccagaaagatgcacttgtaggctctactctgagacttgataagtcatccttgccatgagtgtggctctagccatgtgtccactctgatattcagctcagttcattagagaagccagtgctgatcactggcctctgccttgttccctttacctgagtctatcttgaatatactcaatatccagttcctctagaaccagaatgccacttcgcttttgtcagtccccatccatggaagcttttcgtcattagaatatgcattccatgaaggcagagatctgcgtctgtttgtggaagtatcccaagctcccagcacagtgctggtacacagtagcccctcaatgcttgtgggttgaacagaccgaggtccttcagctgaatcccaggctggctgatggccaggctgcttctcactagacttcctccctcttttctcagtcttaagacatctaagcagacttcttgggaaactccacaagctctctggatgtcctgatgccaagtgctaccagaatccggtctgttgctgtaattttcagattgtgtgccttggctgccagacgaggccttctggcagcacctgcaaggtgtgtttgttggcatacaccagctcatgggccggtttccagcccctcccagtctgcctctgccttattaggctgtgttaattggtttgagcctagttatatctagaaatagtgtccatataattatatacacaaattatgaaaaattcatagagatttatgttcaaagatataacagcaagaaattggaatgcatgataaaactgtcatgtaaaggacagtagatacatacaatctacttcgattctaccattaaaatattataaagaatatttgatgacatgaaaaaaatgctaatatttttaaagttacaatactttacatgaagtatgatcctaaccatgggaaaatgtatttttaacaaaaaggccagcaatagtctctaggcagttggactatgagtgattaaggattttcattttcatttttctacatatttctacatttccacaataagcattcattacttttgtaatgtaaataaaatgagtgtagtattgtaaaccagttctaaagcagatatgacaatcccttgacaatacttagcccaaacatctcagccattgagatctgaattactaacctgtgattatcagtaaaccgaatacataaacaggatgagtgcagtttgaattttaatttactcccatttcaagttagtgaacaaatctacagactgaagtagggtactgcctgatcccatggcacacaactcaagtcttctgaagtgccctgcatcgtgccttgttgattatacttactcgtggactttactcctttctcccacaaggctacctatcagctagctttctaaggatattcttttagtgcctaacacagaactctgtgtttaactggtgtaccacaaatgcctatggagcaagttaatttttgaagtgtaccgaattgatttcaaagcagtcagcttcttccaaagttgtcctggaaaacagaaaaacaagaaaacaggcagtccaattgaaacaatctctcaaactcttctgtggtccaaaagtcactcctctgtctgtttcaacacaatgacctgaggactcttggtatttgggagggaaaaaaaaaaagcctacaaatttggaaataagtaagctgttctcctccaagaacaaaattctgaaaggatggaagaagagagctattggagaggtagctaggggttactgattttaatattcattggaaaatatataacagactacaaaaccatgagcttatggctattaatgcagttgtaaatgggacaaaaagagtcaatttaaataaatctattttgttagtatagtacaagtacctgtatcaaatccactacaatgtacacttaagaatcacatattttgggccgggcacagtgactcatgcctataatcccagcactttgggaggccgaggcaggtggatcactttaggtcaggagttcgagaccagactggctaacatggtgaaaccccttctctactaaaaatacaaaaattagccaggtctggtggcacaggctgtaatcgtagctatttgggaggctgaggcaggagaatcgcttgaacccaggaggcagaggttgtagtgagccaagattgcaccactgcactccagcctggccgacagagcgagactctgtctcaaaaaaaaaaaaaaaaaaaaaaaaaaaaaaaaaaaaaaaaaaaaaaaagccatatattttgctgtatgtaaatttcatctcagctttttgttttttgttttttaagtaagagaataatagtacaagtgctgtgcagatgtggcagaaagcccaaggcattatgcggaaacaaaagcccaaaaaataacgtgatcattttacaaacattcactaaacacataccctgtatcaggcactggtctacgcagtggtagtagcctagtctttatccttatggcagttacagtctaataggagagaggcttaactcaaaaataatccatacgttcattccagctcaccaagcactgttgaatccaccatcttatttgatcccaacagagatctcctgaagttggcagagctattgctagaagtttgcaaaaatggacccagtgtacagcaagccctataccccatcccaaagtaatattccttcatatccatgtattttcaagatgttttacatttttattatgaagaaaaccaaccatcttggtttaaagtaactttgttaatgttttgctgtggaacaacatataataatttaaatataaccaaaagatccattgagtttggcctctttatgttactcatataaattacgaagactagatctgaaactataaagcttttaaagctgtcaaactttagtgtgcatgggaattacctggagggtttgttacccacaaacagctgggtcccaatcccacagtctccaattcttcaggtctaaagtgggaccagataatttgtatatctaacaagttcccagcagatgctgatgttggtggtcccaggaacatattttgagaaccactggtctagattaaattgtgaaacaacctgagtctcagtggctcaacagagttttgtttactcagtaggaatacgtgttctccacaggctggcagaaaggctttgcttgttgcaatcactcagaaatcatcactctcaagcaccttatggtaccagaaaatgaggattcctttcaaaaaacaaaaaaacaaaaaaagagggaggtgtctctgtggcaaaggggcacagcagacaactgagagtttccaatggccaaagctggaaaaatttgagcaacaaaatacataaggttgtattagaatataacccaatgtacaaaataaaatacacatgaatctatattgatatgaataaatgaatgaataaatggggcagaaaagacaaatctcctatgcagaagaattcaaataatgtatgcagttactctatccttgatatggtttggctgtgtccccacccaaatctcatattgaattgtagctccctaatcccctcatgtcatgggggacccagtgggaggtaactgaatcatgggtgttggtttttcccatgctgttcttgtaatagtgagtaagtctcatgagatctgatggttttataaaggacagttcccctgcacctgctctcttgcctgccaccatgtaagacatgcctttgctcctcctttgccttccaccataataatgaggccctccccagccacatggaagtgtgagtcgattaaacctctttttctttataagttacccatcttggatatatcttcatagcaatgttgaaatggactaatacaaccctcaaggtagagtctaactccccacttcttagctgtgggctgcacatagggacctgccaaagaatacagcatggagaggggtgagccgtttacagtagagaaacctgacagtcactgctgcatcagcctcaacagggataactcattttgatagtatgttacttcaatatgatgtaatgaaaatgagactaaactagtgaaatcccaataaaatgagactaaactagagaaatctcaataaagcatcaatcttacttataattccaaaacaaaacaccaaggctccctgagcagccaccatctctcaggttgttggtcaccttcactggggaaagagaagcctgaaggatctggcaccagtaattaaatgtgcccaggatggagggagtacagaactatttgaacagtatcaatgactgccacagcacctgcttgcaattctttgaaacagaacctttgttcacttatgctgttctgcagattctctggagtcaacctctaggtgaatgggcattgagactaagcctgctgcatggtttccaggcagagattatttataccacatctcatattttcctgcctctcaaagtgcctctagagttatatatcctaatggagaattctagtctttcttctccaatgattcttttgatttatctccaaatcaatgtatcatcacaaccaagtaggttattattaaagaggtgtttggtggtttacccaaaaggcataaatgagtttagatgcctcactcacttgtttcagtaaaacaaaagggggagttccttcctcatatgactctgctcaaccaatttacaaaccaagccttcgacagtctagtctgagcagaaatcaacatttcaaactgaatgtgtttcctccctccttcccattgctcaacttagttcttaaattctgtctcttcctagaaagtttcatttatttctcatcttttctatgcctccccaaaaaagcaaaaaaccaaataattttcctttaaaccccatcccatatcttgcccctgtttgcatttctctttatatgattgcagcacagctttagtattcattttacgttcacatttctgggagttacaaacatctgaccctcagtgggcaattctggttacctcttcccaaaggacaagatttgaccttgagattgcttgcaaactccaaagctgtctctttccataaataaatattctttacattttttataggctattgaacaaccacaagaaagtcttgcttctttgtaggggttctgaggtgatagtaggggtgatggtagtagcagtggggtgtgtgtgttttcattttcctttttctcctaatgcagtgtttttatgggacagatatgttatggtcattcaaatttggaaagctgtattaatatcacacaagaaaggtactgatgaccttatttctgctaagtattaggtgaccggaccttcctattttgcacagctcagaattgtgaaagtgacaggctaagttctataaacattgctccaaaatataatcacaccaagatggaacagtgtttaacccactaagtgtacttttcttaaattacctctttttacaacattacgaaattctcgtttttcttaactgactcctcctgcttgaaacgatccccatttaattacaacaaattcactaagatggctttgaatttttagccttgccaaaattatagatcctattttctggagtgagaatatttaactctctttatatttgcaacacagttctcataaggactaaatgatttaggagctgccgagattaataactcatttgtatatatatatcatctactttggcccaggctccaacactatcaacacttaccctaaattgatgttccctatcctttataagagataatgaattcgtctcatggcctagagcacacagtgacatctatggtctcaactgatgtgaatcaaccctctcagggttgggaatatgtcttaattgtatacttgttcttcaacacaactactgcttccatttgatttcttcccccttttacttactgaaatgattttcattcttacctcactcatcaacttgtcaattagagaacaggagctatttccttttttgtttgggattctggctgcagcccaggcaccattttccaagtaattaatgagccctgcaatgtcctggcttgtgaccaccagtctcttcctttgttatattacatcttgcctggagaaggactcaatgcaagagcaggcaataggctgccacttgacaaagagcaagctgttatttttaggtgaaaacaccgagttttttttttttctttacttttgccacatgacaacataggtgttggtagttaaatcttaggctcacaaagaaagccctagaagcagaagtatctatggttatggatttctaatagactgtcaagagctgcaatggagcatacaatcatagggtgggaactcgaccttcaccctcaccctcaagcctaggctatttgcaccacatcagcatatgagagaaaaaacaccagggaactcagtttttggtgaagggcaagaagaggtcaaaaggtgaaaatggactttttttccccttccttattccttagttgcaaggggataaaatagtaagcttttcttcattatgatcattcatgcattcaaaaaatatgcttttagtatcatctagttgttttaacattgttttaggtgctaaggatggagtactcaacaaaaacagaatccttatttatctacaaggcacagtctagtgaaaagagactgaagtgaacaaatgaatgaatgaatgatgaatggatggatggatggtagatggtgatgaatgctacgggaaaaaaattaaacatggtaaggggaacagggaatggagagggtggggtgttattttctataaggtggtcagggaaggcctctctaataaaatgacatttgagtagagacctggagaaagtgaaggaacaagcaacagaggtgtctggagaagaggatcacaggcagatgaaacagcaggaagaagggcactgcagtcagactctgcttggcgtggttgatcattaattactctaaaagcttaacaatctatgcagaattgagtcactgtagataaatgccttcaagtctctacactgattttatgatttttgaagaaaaatcactgaagctgtattatgtaaccttgtgccctattaaagatatggtccataattaaacattttctgatgacttggatatgtaagtatgattccttatttattcatatacaccttgcgcatgtcatccttgcactgcactctacttattctttaaattattgagcagccagtctttggtaggtctgtgctagttactgggaatactgtggtaagcaaagtagacaagtctctggcctcatggagcttatagtctgataaatatattattcaaccaatgtgtatcactataatctgagtttagcaccccaccagaatgtgccgggggtatgaaagcccaaacggggcctgggatcttctggaggatgaagaacagttttgtgagaaagtgacatggagttaataacaggagaagaacattccaggagcaggaatgtgcaaaggtcttgaggcaggaggaagcaaattaggttttctgtgtaaagagaaagcagtatgtctggatcccagagagtgagaaagaacagcactaagaagaaggttgtgttcagatcatcctgggccttgtaggctaagtttactcttgatcacatgggaaatcattcaaaaggttttaaacaggagagagacatgatcaaataagcattttaatatgactttactggctgcacagtaggaatgtaggggctgcaaggataacatcaagggacagtcctgcaggcgttcatatgagagatgtgcaatgcctgtgctaggacagtggtggcagagacagaaaacagaagagagaaatcaggaaccatttaggaaataggatcagctgggcttggtgatgaaattcaggagatgatgtcatgggtgactcctagttggttcttggagttgtgataatgcccttcactcactggttcatttgctgaaaaaaaaaaaaaaagaaaagaaaaatgacaaaaccctagctcaggcaccaaacacatagagcacactctcttctctttgacagccaagctagttctaagtagcatctagatgcctggtatacaagtcctaagtgcctgcagagctggccctcagctgagaagtgcctatcacacacacacacacacacacacacacacaagtaaagagaagccaacaggctacattagattcaggataaatgagctagcccaaatgacttcttctatttcaactccactatcattgcatttaactggtcacacctacaaagcaatcagcaaactgggtgactcattaggattttcttttcaagagagcaaagaacctaaataaagatccttgaatttagcgtacaatacccaggagtcatcggagcagcagcaatttgggggaacttcaagtgtggtatttcggtttgagtggggaagttagaaatcagaactgatctcacaaacaaaaagcttttataatagcctgtcctagataagagagtaatgagaggacaaaaggggaaagccatccccctcttaataccaaggaaacctagggaagtgacttcttaaaaaggaggtaaaagcagcagttttagtcactcatcaagagtgactgttcttcctctttgctagaaatagctaagagagtgtaaatcactcactaggctctaagaaaagaagacttacaaatgagcttgaaaccaaatagtgctgtgtagattcttctaccatcttctaaagaatctgcatggacttacttattcactgttaaggttgtctgtgcatggtagccacagtgctaggatgatatctatagtttgtttttgacaacaagtaaatccattataaacccaatttcttctcttgagcacaagtttaaaaggaaaaaaagaaaagcttttctactttaacatgcctcatgcctgtgcttccaaaccagagcacaagtactccctggggcactcagctctatgccaagtattacagcagcaggaaaccatagattttgtttaagtcaacctttctatagtaatttcattaacataattttaaactgacgcaacaatgattatcatgtggcataaagagaatccatctaaattttaaggatataacagaagattccaaatacatttcatttttgtggtttccacaccaccaccgagtgaagcctttagatctcttgaagaggatggggtggttacaggccaacgaacgtatccattagatgcagacagcacaggacctagagcctacagtactttttgcagtcaacaaaaaattattcttattttaaaattagaagataaaaactaattcttaggccaaagaaaatgttttaacatataatatttgtcttacaccaatgaggttataaagcctaatttttaactttttgttgttttatttttcttggagaaaggggcccacggaggcaaaaatggggagggcctacaacagtcatactacagcaccgggtagtgctttcatttgtgtttgagtccctctcctctgctatgctggtaagcctcaaacacaaatgaaagtgttatttcttaaagtatagtggtccaaataccaacatgatttagtgagacaagggcaaatattttaatttaaaaagtatgtactatatttttaaatatagctgaaaatattgagtttctcatttacggtagcaacgaattttctttttgaaaaatttaagtaaataaaatactttaatgaaaaatattaagcaaaaagactgcaagttctaggatgaacttggaaaaaaaaaaagaggttggtattgctgaatggctgaaaactagtgatatcctagaatcctagaaatactaggattcagactctcagctataacacccaaaaaagtttccatatagatcatcaactaccttcatctctcaagaaaaacagtaaaacatgaccagaacttccaccaccaatctactgggaaaattagaaattttggatagtggtctgagtgcttatttatattttaaatcacatatcatatttttcagaattagtggttcacactggcaagagagcaagaaatatttgttggttggtacaaagcacctccttttactagcccatgaaacaatcctacaataactcttgtattgtacaaagagaggcagatgattgataaagattcccacaagaataagacattcacagaaaaatgagatcagccactgcagtcctaccagctgggataattttacaagggtcagacagctccagggcataaactaatcacttcagggtgaggaagaagctgactcctgattcccaagaggcagtgtcacacaattagattgtttattctagctcaacacaaatttgacacatttccccaaaactgcctgtctagggtcctgtcaaaacaggatgatggaaagtcagaataatgttttagcccagtatttccaacattcctgtaatccattccatttcagtcatgttttgatgtaaaggatattttccccactaatatttgaaagctatccattcttgcgtattctagttacaccgagcatacattcattgtggaataagcagcagccaatggtatccaggatcttctaaaagtagtattcgagggctttttttgtatgtcttaaaattgttaaatctgagtgaatgaacttatctactcccaaagcaagatcttaagttgtttttagtggccaatgaaatctttcccagggagctagaagatgggctacccaaaggaaaatattctatatatttttcaatgaacatatagaagaattacagaacaaacaagacataaaatacaacattatagcaaatgtttttgaggagggtgaatgagattcttaattagttcttttgcctctgccaatattgtctataccattgtccttacacaatatttacacaaaatattgcagctaataagcagaatcaaaatttgaactcagatctgcttagatccaaacctatggtcttaacctctgtatttgttccagaacagttcctggaacaaagctggtagccaagaacaaacctggtagccaatccgtatttgttgaatctgaatctagattaggaaccaggctgtttgatccaggattctgaggtgtttctagagctctttacaactaatctcaacacccagaatgaaaaagctctctatgacatttgaagatattagatgactacatctgataatgccacattcaaatattttctgttaattcttctccctgttgaaatccaattagcatgaggaaaattaactactgcaattaagaggaagaggaagtgaaagatttccatataacaagtttaaagctctgttgctaaaaaaaaaaaaaaaaaaaaaaatgcccaaagaaactcaatcctgtaactgaatttcagataacagagtatactgcatacataaaaactaacttttttgagtactcactgtatacctaaaattcttctaaatgccatttcatgtattatctcatttaatccttatgagctaggtactattattcctaaatttcagaagagaaaaccaaagcacaaagaggttaagcaatgaagcctaggtctaccaataagtggtagagccaagattctggtcccaagggatacaaccccaaactttatgcttttaacctgctgcttcccataataataacacttgctggacactttaatctgtctcatatattcttttttcttaacctccacttcctgggttcaagctattcgcgtgcctcagcctcccaagtagctgggactacaggcacgtgcctctacacctggctaatttttgtatttttagtagagatgacgtttcactatgttgctcaggctggtctcgaactcctgagctcaggcaattcacccacctcggcctcccaaagcgctaggattacaggcctgagccaccatggctgggctgccctatgtattcttcatgcaaactatgttatttactttccccaacaaccatagagaaaatatatatatatatgtatatatgtgtgtgtgtgtgtgtatgaatgcatgcagatataggaggtgtgtatatgtgtgtctgagtgactattctctatcctatcactgtaaaaacacttgacagatctctcaaccattgaaagaaggtcatcttagatcttctatataattaatcaaaagaactattcatacaaaaattgcattatgtgtcatcttcatttttcattaggtattttgattggatgttgtttttgagaggaaaagaattcatttattctcatgttcttgttctttttctcattttaatatgaaataacagcaccagagaaagttccaaaatatcttgaaggacagagtttcagggctatcattgcatttgtaagagttgggaggaaaatttccaattcatagtagtagccaaatgttgcaaatcttcatgtaccctccacctaagtattacagactctgcatcatgtaacctggttactgccagaattgagatctcccttctcctcttcacttatccaaatgtgtgattcatctctgtgggatatgacaaaccaaccacactgggcaaaaaggccctgcctgagccctctcagttcccaggagaaccattcaacacaaaagttaaatggtgcatttcaggcaccctgcccatcctgaaccctggatttatgccaaggaaaggcattccactaatcaagctatctctagtcctcaggaccaaggagatggcctaatctcatgcttcccaaagttaaatgggcatataaatcacctgggagtctcgttaaaaagcagattctgcttcagtgggtttggaaaggcctgagattctgcatttccaacaatctcccaggaggtgctgatcatgctgctggacagcaggccacacctggagtatcaagggtctagttcatacacaaatgcaaaattgggcttcaaagagaagtgtttgattttttgaaaggttcatcctgggttctcatccagggtgatccataaaattttccatatcttcatgtggcattaaaaactccagacaatcctcagaaaaatctattcaccttttaagcctttggattccacaaggctaccacaccccaagtatggagggagaccattattccatacataactttaaaggcatcccctttgtgacttagccacatgttcttttgtgttatttatccaaagaataagcaactgataatttcagattttccaaaatggcgaatgtttgacataaatgtgtttaatactctgcaaagcctctccaactcagtgtatttgggatgcaagggttggtatcactatgtaaataaggaactactttacagtacagtttaatgaaccaagtacatgcaggaaccctatttaagtgaaagtattaattccttggaggaaatgctttaatactgaagaatgacttgtgattagcatatcaacaagaataaacagtcttaagatacccaagggtacttaaggacagaagctttcaacaaacttcttaaactcctgtttatactcttaaattgcttggtaaacgcctccttctaaggtactttaaaaggtcaagttttgcccaagtctcctctctgaaaactaatgaggctttaatgtattcagaaatgcaaaagtaacatcaaagttatttgattgacccaagccaaagaaccttctagaatagcaacatattttggctgggtttctaccttaaagtcacctctcctcctaaataggataatttaaaaaacatttatttcaacatattggcagaattactaggtcatttgtgagcagaataattcttttctacctttttagaatggtcagatatgagaaacaaagcatgtaaacaacactaaaggtggctgctctactttacaaggatcctaagaactagaaatagtagtcttcagttaaaccagaaaattttaaattaaaggttagatgactgaactcttgcactgagcagtcgaccccaccatgctttcattatgccaatgaattatatctgtttcaatcactggtgtcaaaaggttgtgggttcaactccaggttgtgccacttactgtcagtgtgacctagggtaagttaaattttgcaaggtttagacttttcatctgtaaagcagggatactaagcagtaagtgcttactttatgatgttgcggaagcctgctaccgagcctttcctataatgggcatagttactctatacatatactatacatacgggattacatactattgctacttttactgtgcacagaacaaggtcggtccttgagcttttaaagagacacattaacaagtaaagacaagaactgccaaccaaagcacatactaaatctatgaaacacctgactacaagagatgactcaggattaaaaaaaataaagagatggctcttaaactatcaagagttctgaactcatcttaacctctgaggttcaagtctaggaagacagcaatattcttctgcaatgtgaccttccacatgggtgttttgcctacaaatcaaagtttttattttggatgcccagccttcatccaagctgagttaaaaagttaacttattttttcttctcttagtaatagtaggcagtaatgattgtggtcctggtacttcttcagagttaatatctatgatttcttaaaatgtttattctggagaattttttgtagatatcctctaccctccaaatgcccccaaaaggtgtatgttagtataaagtgccattattctagcaaaatcagcccttaagaccacattcatgtcttagggtgacactgcgctaccaagaaaaaaaaattttcttgaactgataacaatttagaaactcactcccagtaaagcatagaactcagcacaaacaccaaattcattatatatatgtaatatatatgtagatttacacacctttgtatagctatccttgttttaaaaaactaattttcagcattaggcactttcactgcttctgctctaacccaaattgctgattgtaaaaaggggattttctcccctgtatttactttggaaacagacaccagccacggagaagtagttgagtgcaactgcccacagactcacactgaaattagagcacctgagctggtccactacctgagccgtgttcctcaaggaaatttcaaaagaaaacctccaggacctcggagggccaaaagggcagcttgtagcaggactcggctgacacaagactaaagcctaggagttctctgtgtccttacccttgggcttcctgagaaacaagatcctgagtcagacactgaaatcttatgattatgagcaaatgggcctcataatcccaattaatctccagagttgattgttagaaatgcaaagatactccctagagactgttgcacagactaaggagtttcttcaacactgagaatgtagattaagactgctgagggagaaataatttaagtagtgattgggctgtgaaagaaaacattgtcaatacctatcttacttttagctattcacaaatatatagatttcagagagaggtaacaccatgatgcatagtacttaggccaaatttcaaagagcacatctgaccatagtattactcatcaacttaatcaggtagccataaatctcctatgcttctagactagaaaacaatactcaaagagcgttctgttttcaatgttgctattctgttttgggttctgttagcagacttttttttgtttttgtcttttctgtcttgtattttcccccatcccctgtgaacactggattcttggtcacatcttaatttatgactatttactcagctgattaaccgtaggcattcgtcttattcaagcaaatcttgttctgagcaacagataaactggaaccccaaggacagagcagccatggctccgtattaatcatctgctcatcccatttccccatcctacagcagaccatgaaagctggggttgcctcagagggcttggcttcaggcacctcctccctgaagcactctcagaggggcatattcatatggagcaggagggaggctttggtgattggcttctgtgataggtttcttgagggaatggaaaggttttgaagttctgaagtatttgaagtgtctcttcataagttcacaagtgggtacaaaatggtagaacaaaatgtactaaacatttaggccacaaaacattcattttctccagctgaaatcaccagaagtgttagctggggagaaatcagaatctgcctaatttgcaactcttttgaagagaatataaaatcagctttgcctccacccaaagaagaggacacactgtcctgttttcactaactttcactattttgacaaagagaaagaatgagataactctggctaaaacttgtcatgaaagtatctgatagaggcatctctagcattcctgggttactgatgttatataactaaaacctgtaaggaaaaaagtgaataatgtgatccttaatggaaacggaaatagagagtcacaggtattcctaacttgcagtcatgcaaattatccaagagattacatctcggtattgtagccaggtcatcctcctctacaatacccagaaattctttctttccatcctctatttcattgtctctccccaccctcaaccccaaacacacaaacctaggcatccctgtaaaggaggaaatataaaagcaaagagtaagcaacttgctacaatgccacaccaggtaacaggtaactggccttccccctgcttggaatagaggaaaagtacaaattatacacctggcaaatatttgcgtggtctccagagcagtaagattcatccatttgctcacaaaatcacacaactgaagctgagcgaataaatcaattcaattcatttcaacaaacatttatcaagctccagtctgaatatagagtttttctggggggaaaaaaaaatcataatgcacctggctattggagctgattttttaagaagtctagaaatttcttcctcctttctgagaaacgaggcaaccaactcccttaaataatcaacacagatgtattttatattgtaaaatgtaagtagcccaaggtatgccgcttccttttttgtaggtggaaaagaatccacttcttatctttctgggaaaacacaattgtgtttgttgtacaaaaacacagtgtccccatttactaagaaatcaatgagtaatcaccaagccatgaatcaccttttagtatttttgctataaagatgagaagcactatatattgaaacaggctatggcatcgctgctctatagtataaattcagacttatcaagaatctacttaaaatattctaaacatgcaatggaagggcagggcaaaaccaatctttgccaaacatttaaggagatgttatacacaaatttcctcctgggaaacttctgagtggaggtaagataatttaggcgactcgatcaggagtcatgctctactacttacctgggggcttcaagggaagacatttataaactctcagacctaaatttctctcctttaagacaaggttaatcatacctcttctatctaacttatggggttactgtgaaggtcaaatgaaataatgaatatgaaggtttcaaaaccattgttttatgttttatgattgatatcagtgatgtcaacgtttaactctacagtcccaaagacatggtagaagatggaaaacaacctccaaaaacccatctctgatatcaaaagtgtgcaatgggctatttaaaagttcagatgagctgtggttctttgtgcttagccacaaaaacagccttagaatcataaagccagttttaaaaagaagggaaaacaatttttttctttgtcctattctcttctgtcatattagatggtaggcggacactgtttttacttatcaggtatcaaactgctgttggctactaaatattatattttgtgtcagtctccttaatttatatactcaaacagttgagatgaagcaaacctaaacatatctcactgagttagggcattccaaactcagcagaatttttttttttttttgagatggagtctccctttgtggcccaggctggagtgtgcagtggcatgatctcagctcattgcaacctccatctcccaggttcaagtgattcttctgcctcagcctcccgagtagctgggattacaggcccagaccaccacactcagctagtttttgtatttttagcagagacggggttttgccattttggccaggctggtctcaaactcctgacctcaggtgatccatctgcctcagcctctgtacttttttttttttttttttggtacatatttataactacctactctgtattggtactagagaaacagtaaggtaatgtccctgactcagtttggaataggagacagccagacagaggattacaaacaggtcagagtacggagagaagaggcagggaaaaccatcaaaccccattgggcaggtgctgcctgaaccaagtgttaaggatatagtatggttgctagccaacagggggtgaggaagggcacagcacggataaacagacaccgtgtgcagtgtgcacgaatgccccgcaatgtgctaccatagatggacacagtgggaatcaggatgggccgtagatgaggctggagggggaggcagaggtcatgtcataggaacctgtgactggggatgtagaactgtgctccctggagctccaagtgtggggctactctgtggagggaggtagaggtgcatcggggagtgttgtgtcggcaaagggacggctccatgaggtagatcctaactatcctcccagaacatcctgctattgtgtcaaatactggagtttcctgtgggggaaaaatgttttgctgctttaaaaaatagttgatacatttaaggtaaagagaaatctcatttgtaaaattgtaataaaaataaccacagcccagacattttaatatagaaaatgtattagtctgtttttgcactgctaataaagacatacctgagactgagtaatttataaaggaaagaggtttaattgactcacagttccacatggccggggaagcctcacagtcatggccggaagtgaatgaggagcgaagtcacatcttacatggtgcagacaagaatgcttgtgtagggcaactcccctttataaaaccatcaggtctcttgagagttattcactacacgagaacagtatgagggaaactgcccccaggattcaatcatctacacctggccccacccttgaccggggattattacaattcaaggtgagatttgggtagggagacagccaaaccatatcagaaaacatacacaatattcttttaggattcatacaaaatgcttgcgtattttttgtggacttctacctgagaaggatcgttttatttagatataaacagggtagaaaaatcaagggcttcagctggtttcagcttcctagaacaagatgcagccctgcagttgtggggcggtcagtcacctgcagataataaagtgggctgttggtgaggtaccttggaggaacgccaacgtaaggacagacagacatgcagacccatttcaagcttgttgcagatccagtgttgcaggacatgacccaggaaaccaccacctctataattaagttttaagtttactaacagtatttttttaaacagagatcagggcatggggtggagtgagggatagtagggtatggggagttaatatttaactggttcagggtttcagttgaggatgatgaaaaagttctggagatgggtagtggtgaaggttgcacaacaatgtgaatgtacttaatgctgctgaattgtatgctcacttaaaatggctaagggggtaattactgtatgtacgttctacgataagagaaagaggtaccactaaaaagatttccagtaagataaattcagctaggagcctcataccacctccctgaatgtgatgcacagatcaaaactgaatttctcaagccatactcgaagtatcaactcgaagatgttaaacagtaacgggcaagttttctaaaacaagaagtcaccttctccttaaaggagactgagttcttcacatatggagttcctaactcttccctgctgtccacaaagatgatatggttattattatcatgattgttgtaacagacattttgtaatttatctagaaaaattgtgtaaccagctgctacacttgtctgcctttgttgtagagaggaacaaaatggacacagtagttctgtgcttctccttgcaaagtgagcaacaggaccaagatccgaagcaatatcagaggccactgcacccagcagcagaggttgtaatgaccccattctagaccctcaccaccaacaacgctcctatgtagtagtaagcatatatttgcttgccgaacagcagatatttctttttgcatatgcaaaatatccaagcagatttaatgaaattatacttaaggttaaactacagagataagaaatacaatctcaataccacagttaattggttattctttttattaaagagtctcaaatgtttcccatgtacaaaatagttaaaaaccgtgaagagccctaaattctgtgcctgtaatcctggcggggtttcattttacaggttacaaataacccagaatagtaactattgatggtttaattacttgaaagtgccttataatcacgaagtcattaagggtgttatgagatctaaaaactacaagtcatgagggggttgtgcatcaagttatttggcaactcattgatacaatatgaggtggaatgaaagtattttggactaaagcattctaaatacttcaaatcaaaattgagcacacgagtgccaatccatgtccatccctaacagaaaatctcatcctcttttcatcactattagaaattttgtatcatcattcactgaggcagtgagaacctgctaaaaccttgcggctctgaattaatgagagaatggtataaaatgtgcatgtgtctacatccttcaacacatcaactacaccaagcaatgccaccaggccacatgggtaccttaataatgttaggcattccgtataaatcattttgctaatggtttagagtattgctgtaacagttttgcagttggaaaagcacaggctgtaagtggattcatggaagcaacttgtggaggttatccagactagtgctctacttagaattaaaggatgtcatatctagaaggaactctggagaccctctagccagacctcttcgttatacatgaaaccaaggcccagaaaagctaaatgacttgcttaagctcacacagctaatgagtctcaaggccaagactcaaggccagaagagccatctgtccatgtctgtcttaaaggcttcccagccctacttcacctcaggttattgaccctggcccaggccatcaaaagcagtcaagcctttggtaacactacctctccctagagtacctacttaattccccttccacatacatctattcatcttttaagactccactcaagagtcacctttatatgaaggctttcctggtcttcccacagcccccacagatttggctctgctctgtatactcttgctgtggtgcatggaatacaacattgaagtgatctattttcatgtctctccacccagagacttcaaacccttggagggcaaggaccatgccacatgtttatctataaaccatgccctgatggcaatgccaggcagttgttagatacttatgaaggctgacactgaataaataaacaaaggtaaacaaaaccccaagatagagctaaaaggggtagactcatctccaaagacaaagatacccaaaagagcacttacactacagacagcctcagcccagcagctctctatcctggctgtgcattgcaagcatctgggaaggtctggaataaaaccttccccagcccaacatcagacaaaccaaaatcaaatttttaaagaaaggcccaattatctatagttttgcaaaattatccagatgatttctataaaaagtgaaggctgcgaaccactagtagcaataagaaatcccacacagtccctgtatcaagttttggtagcaactctacaggttcaactacctagtagagcaatcgacccacccatatggcatctagcacacaggcacccacgaaggtcttccctccatgttcacatgacaaccatctaattcattatactcaacagatcatagcacaaggtggcatggtcttcagacaaattagatgcaaacaacttggggatctatgaggatgaaaaattcatcaagccaacatatttcaaaggtgaatgattctcctacttattggagaatggaagtaaaattgttacctttaattctagcaaaactacactttaagaacagataataaagcctgaggatgaagaagagaaataacaacataggaataaacttccccagaccccaagataacaggaatctgccacctcctattgtaataaatgacaatagcagtaatcaaaccttacatgtacataggaatttatatttaacaaaatactttcatagtcattaattgatttcaacctcacgatagcttcatgggttatatcatgaaaactgtttctttatattctaattttacagatgagaacaactgaagttccaaatagatctatggcaagctcaaagctaaggcaagttaagggtagaaccaaaaccatacaacgggtcctcaatatctaaatgaggttcttgctgctccacaccccttcactaatctcacaataaagactctctcctgagaccttatgctacctgaagaagaaatactgttgcttctcctccaaaacttgtgaaatataaaattattcagaaaccattttcaccccaccaaagttccacagtgctgcaactgattcctgtttcctctattaacctatcttctctttacacattattgagacattggcttttttaagcactaaagaccaaatataatatccaagtggcaattatatcaccaaatacaatgtaagaattgtattaggttggcacaaaagttactgctgtttttgccattaaaagtaatactggtattaggttggtgcaaaagtattgtcgtttttgccattacttttaatggcaaaaaccacaattatttttgcaccatcctaatatttaatacaaataatgccattctaagcatacataaaaaccaataaatcaaatgtagaatgtggagcacaaagacatgtgtttctaacttcattcctctatgaatgtttcttttaggtcataaaatgttctatgaaagcaagaccatgggaagaactggcacatgtgtttgggaagaggaaaaggttattgagtgcctactatgtgtcaggcactgagctgaatgcttccacatattaatgttttatacttgagttttcattaacagctctaatctgtactattaataaaagataaagaaatccaggctcacagggtaagttgattatcttcacatgactggaacagagcaaaaccagactaggaatccagctcaggcagtcctgctccaaagtccttttcattatactctttccacttataaaaatgctcaattacactcccagatacagtggaaatgccaaagcctctaagctttttccaaacccacatcttgtgcccattcaggtccccactctgcctggacagcattaattcctaaatagtctacactctcaccatccccacttgcacctcaatgttaagagttttgccattctgtgtgatttttagagcagtggttttacccccacagaagacacaggaaaaactggagacattttcagctgtcacaacttaggggtgctgctgctttgtagttggatgaggccagggaggctgctatatatcttgcaatgcacagtacagcccccacaacaaagaattatccagccccatatctcaggagtgctgaggctgagaaaccctgccttacagtgataatgtgatttaataaatgttcttcctccccagtaaaatgagaccataaccaccatgaggaataactgagacaatatacataaaaacctctggtgcacagtgaacactcagtcctaattagataatctgattacgcacttcttaagagtaggaacctcctcagttagctctgcattattcccatacaaagcacagggcttttttcatgggcactcaacaaatgtgaaagaatgtattctttatgttagaaattcttgattaaaaaacaaacgccactattatctataaaacacaccattctcccatactcactccttgccaaacaataagtgaatagtataatacatgattcattgcagcaggctatgaaaagctacagtgcatccaggataatgttatagaatcacctccataaataaactattaataaacttgctattgaaatgttttatcttattttaacagaaggttaatgaagagatcgtgatatacagatttgagaaaatctccacccaacaggccaagattttgctatataaggtcagttttgacaatattgattctcaggtcttgagttaaattattcagctttaaactgtaatcataagcatatcaaataaaaacactgaaagtcaaatctttgaataagccaaaacaggcgggtatcacatctcagggcaagatctttgatttttgcttttctcagtttatgtaagtttgagtcagcatggaaatcctaaaataaatgattacaaaaagtataggattagcattcactcaagtgacctataacaggataacatacaatcatttttgcagtttctggaggtgcggtcccaggaccttgaacaacagaatgagcatttatacttattaaatgttcaaagaggataccccagacccactgaatcaaaatttcagaagttggagccgggaaatctacattttaaatcctttcccaaatattcattttacatactaaagtttgaggacctctgccaggagaccagaccccagaaaattgctttgcctcattttgtaaatttctagcatagtcttgcttctgcagactactggtaattcattaaacataagatccacatccccatcccattataaaaaaaaaaaaataggtagaggattttgtttattgcttttgtgcaaatatatttttctaaagtacaaagattaacattttatgaaaatgctaaaaaaaatttaaaactgggaacaaatatagaaagaattatcaaggaaaacatagctcaattctgggccccagaagtgtcaacatttactgtgtgccagactagggatagtgatggcctagacagactaggtctctgacttaattttcccttgacttatgtatttaaattgctaaatacagacataaacaaggaagtaagataattcagagagtggcaataccataaaaacaataaagcaggttaatgtaataaagaaagtctatggcagagggaagcagaggcagtggctagctgtaatagacacagggatgaaaagtggcttccttgagaaggtaacatttgagctgagacctgaaggagaaggagccagccatgagagggctgggggaaagtgttctaagtagagggaactatgactttaaagaccctgaagtgagaacaaggtgctcattctaatatagaaattaaataatatattcaaaaggttttatggaatataaaactatttacaagcataaaacacgacttttagtgacagaatagttcgtggggataatgaagggcctcagctctatgccataagaatgaatcaagcaactgaggctacattgcctggacaacaggagatgtaagtatatgtttggaggaagaacggagaaattttcttcaaatatcaaaaggactacacaaaaggactacattcttttttttttttttttttttttttttttttttttttttgagacagagtttcgctctacttgcccaagctggagtgcaatggtgcgatctcagctcaccagaacctctgcctccctcgttcaagtgattttcctgcgtcagccttctgagtagctgggattacaggcatgtgccaccacgcccagctaattttgtatttttagtagagacagggtttctccacgttggtcaggctggtcttgaacccctgacctcaggtgatctgcccacctcagcctcccaaagtgctgggattacaggcgtgagccaccgcgcccggcccaaaagttctacattcttgtgaaagaatatttaattttaaattttaaatagctctagaggtatgaaatggggttgaaatggtaaacattttaagaaggcaggatctcagcacaatgtgataacattcaaaggaactgcaggaaaatggactgacagaaaagtaatgagttccacatgactggaggtcatgaaggatgggctgaacagccagctggcagagaactcagaatgaggactatgaagactcttatagcatgctggaaatatacacactcacagcatctgtctctcttaagcacaatagccaccacgacggcctccctactttgcactttacaaccttaagaagtattgaaaagaaatatgagaaatactgaggaatccttcatattcctaattcacattatcaccctgggataaaatatgtcttcatttccgtaataaccaatctatattcaaaagggcaaattaggagacaggaaaaaccaacatttatttaaaacctgtggctaatttgtagtggtatcttaccagtaaacattaaacaattatttcaatttattaaaagaattactctattttaacaaaaatgtgtccagattccattaggttcccaatagatggcatgccaataaacagccaagacctttagtaaatgggtatgtggccttttgttggtttattttttaatgcagccatgaacagaaggagatggtttcctcattaaaagtcctgagagtgaatcactattctttattatttacctatgctcctcggtaaataaagcaaaaaacagacattgaatcactacttgattagatgggactaaaatgctaaagataaacaaatctaaccttgcccaaaacaggaataagctaaaattgggagtaagactagaagcaactttgaaaaactaaacattattaaatggcttttatataaaatatttatatttctatatctagatgtacctgactcacatgcagatatatttcaaggtgttctctgaatacctacatatactttttatttattatattaagtatgtttctttaaaactacctgtaaacaaaattatattatgactctcttagggcagcttataaaaaagaaacttataataaatttttccataaaataagggctatgtccatatacttattcataaaattatacctgactttatgaaaaccaggaatgccaaaagagagactttaaaaattaaaatcaaaggcttagcatttgatatggtttggctgtgtccccaaccaaatttcgtcttgaattgtagttcccgtaatccccatgtgtcatgggagagaccaggtggagataattgaatcatggaggcggtttcacccatcctgttctcatgatagtgagttagttctcatgagatctgatggttttataagaggcttccccctttactgggcactgattctctctcctgccaccctgtgaagaggtggcttctgccatgatcgtaaatttcctgaggcctcctcagccaggcagaactgtgagtcagttaaacctctttcctttataaattgcccagtctcaagtatttcttcatagcagcgggagaacagactaatacagtatttaacagaaagaaaatacttatcatatgattttatgtataaggacctcctcctagagctataacatttctatttatacctacagtattttagaaacatacatattccataaaagttgcataatctatagtgcaatcactttttaatgtaatttacttaggctcacatatcttttagctcgtattttgctattttattaaactttaatcttttagaactcagaatgacagcaggactggattagtggcctcaggaaacacagggtctgctcatgagcagtgccacctaacatcgtctggttgcctagaaaccaaacccttaaataggtaggtagggagttataattctttaagtaaatcaacacaaggccccatagcatttttttggggggggggggaggggacagagtcccactctctcgcccagactggagtgcagtggcaagatatcggctcaccacaacctctgcctcccaggcttaagagattctcctgcctcagcctctcgagtagctgagattacaggtgcatgccactaccacctggctaatttttgtatttttagtagagacagggttgcatcatgttggcctggttggtcttgaaatctgagctcaaatgatccatctgccttggcctcccaaagtgctgggattacaggcgtgagccaccgcacctggccaggccccaaagcatctctaactacattctcatttgactaatacacagaaaagctgtggtggctacaaaacaatggggctggtaaaagagagcaaatctcctgtcccaaagttcactgcattcaccatgaccattctttgcagaatctcccttaaacttggaaggtgccatagtactgtatcaaccaccaagagaatggaatcctttagaataataatgttgacaacctagctgctaaatatcttccctctctaaaaagatctgagacctcttgccatttgtttccttgcctttttcaaataacaagaaattatggataattctggattttccaaatattctcatccttaattgaatctcttggtatctcctcttataagactgcagagtttcacctcttgaattagtgtaccaagctgtgaaatgtctcccaaatgtatattctatgggtgggaaacataatgaaacggaaaggctctaagaaatggcaccataaaaccaacagcatgctacagagttgctccttcatattgacagcaaatcagaagtaattttgtacctaagtcagagcttaattcattagttacttcacaagttcaatccagtttctcaaaatgcagtaacacaatcttccaacctaattatcttcattgaaagtatttaaaagcctttgctgagacacatttctttctgtgtcagacaggatcaacgtcaagtgagcaggttgggtagactacattctgtctaatggtaaaaggtgtacaatttaggaaataatcgtttcttgcaagggagaattttcccctggacaccaaaggaaacctctcgtaaataaacatataaatgtgtatccacttagaatctcgagaataccctataaataatacttttgacattctgcagaattgaaaatattacaacctgaatgatttctataataaatttaattaactgagagaagtttagggctcaggaggaatttttaaaaatagaacacgagataatttgtaatggaaatgccatcccatatcgctgccactagggaaaatgatggatatttccctagaaattatcatgaggaaacagttggtttgttttgatggcatttcaatagctcattcaatgaaaccccaaaagtttcagtccaaaaacagttcactttcattttttttgtttttttttttgacaatcagaaaaggaatcaactcacattttcaaccagccatttttcgtagattatacttggggaaaataccttttaaaaacactttttgagtgaatttgtaagcagaaattagtacacaggcaagcaagacttcttattccacagctcagtctcaactcaagtttaacttttaattatttcctaaaattcgtcgctgctattaagcttttgctttgtgaggtaacccagttttcttccaacactgttcactccactcatttaattcatgtcctaggccaataacacatctacttttccagctgtaatagtttaatagcttaaatttctgaagtagatggcattcttttctctttcaaaaaccagttctggcagtgattaagtaaaggaaactgaacgcttgaagagcttcaaatatgtgccatcagaattcatgtgtcacatacaaacacagtaatatataatgaagggaaatacccaaatcacagaatccagtttaagcaacataaccacagatatattttaaaagatggagagtcaatcaacaagtatattaattcattttaaatttgttaggagccatttatgagccagtatagacagcactgcaatttgtcattcatgaactgaaaccgtacataagccactctcagactcaatgtacttaccttataaacttgcccgtatgttccatttccaacaagttccaccaattcaaagatccctgcggggtcctgaaagaaaataaacaaacaataaaaattcaaaacaatattccaggcattgccttaatcaaaagcaaatacttatttaaattaagcaaataaataacaactttagcttcaggggctctcatgtgttaacatttaatactatcaaaattttaaaatttaagtcagctgcagctatgaaattagccaagttctattttctttccattttacatttctatgaaatgtgtttaaatcaggcaaaaggagatgctttttcaagtgaaataataaaaaagaagtaacacatttctcactgttaaatggaaaaacacacttgcaggagctacagcaagataaagtgaaagactcatcatcctgagaaggttctaatgttccagggtatttctctttgaaatatccgagctgttcattgtgttgagtgagccctggtagctaagaagggtgttcgtgcattgtggggcaatcttacctatggtagtcaacagtttccaagggaaaatagagtcaacttaactacctctctcagaaagtttttctttggattcatctcttctgtaatactgcctctacaaaatatacttttgaggatagcctccagttcctgcagtacctgctgagtaactgcaggatttagaatgcaaactaaattggagaattattcaagttcttaccaccaatcagttgtccactaaccccaggagtcagctaaatgttacagcgttcaataaatatccaaaattactgctattataactgaattactatcccaaaaagttgaaaagaaaaatcaaagccaataaaattctattcagaggcagaaattgactttcaccccttactgattcctaactggacagaaattgcttctttaaaggcataaatctaggagtcacaaacttaaatgtctacagaggccaggccagtaacataaacaagtaaagtggtccagttggggcctgtggcaaactgggcaacccgagcctccttgagggaggtagggtatggtatggtagggtggggtggggtggagtttacttagctggagccacttgttgtcttgtcaacatatgagcacaatattgccaggtctaaagatttttcaagagaaactgaacattgtatttaatgtgagatctcctattttttaagttttaggcacttaatttaaaaaacattcttaggaacaaataaaaatagactgcgcctttggcctgtctctactggacacttacataagagcaatgccatatattattacaatgggtggctaagaggcagggagggaacagcctgaacttcagattcagagagacctgggttaaataccagctgtgccttgaccagctgtgtgatcctaggagaccccgagaaagcaacatattgtctgggtctgcagggatgacatctacctagccatgctcttgtgaagaataagtgtgggctttgcacaatgcctttcaagtagtcggaaatctattaacacctaatagtaatcacttttaagctgagaaattccacaccaccagcaggatttaaatgggggaaggggaaaatgagtttatctgctattctggggaaagggaaaaatgagtttgatctgacaagtcaggatgctttaaagtccaatctgtggtaaatcaaactcaagaaaagcccctgcgtaggtgccttcaaagattccacacagagaacaaataaaaacaaaaacaaaaagcaaacaaagcacccaacagattaagcacttagtcactgagaaagattggagttagcactacattacctgctcttacaaagccagaagggcaagaaaccacactccatgctcatgtcctgaaaaatccagaagtccagaagttccagttatgccccacctggtctgggaggtgtggttccagacagaaccacaaaaccggaaaacactcttaagggacttagagctctgagtcgaccaacaccccatagttagaagacaccatcaaggccacctgggaggcctcaggatcgggaagaaaaattttgttggttaaactactaggccattagagcagcaggttttattacaaatggaattagaaagaaatgaggaaaagaaaaaaaaagcccataaatggtggcagctgctgtttgtttctaagctgtgcttcccagtagtttgtttgcttggtggtgtttctgcaacatatttggagagaagtcctacatttgcttgaaatagctcaattgtgttttcaacattcatttttcttaactaaaaaaaaaataacagaaagagaagagatacaggacagtgatgagtggctgcctcaaggaacctgggaatcaaacagggatgtgagatgagggcaggagcacaaacaggtgcagagcaggaatcagcttctacatccaaaggtcactcgcctcagggtcccctctcagagctggggttagtaggtaggtctcaggaagatctggacagctgacttgtgaggctcttttctctccttgaataatctattcttgggtatatgtcccaaccaatcaaaaccaaggaggcttaatgctgagcctttagttcaaactgctaggagaaggtttttgctggacacatccaagggcctcagaagtaaagttcagaggaactaaagagttctactggcaactggccttgcataggcaaccaaactggaaagaatcatcatatcagatgggttccccaggaataaaacctgagactccctgagatttatactgtgtgagtttattggggtatgcctcagaatcaacacctgccggggagtaaaggaagaactggactgagccaaaggaagagctgaactgaaatgtagtggtaacaaaaacttcatctgatccatggaagtgctggagctaggacagccctggagaattatcctacctggaagcatcaggactttgcatcccatctccattgactagtcactgcatgtgggatgccccccaatacccgtcccagaggtaacaatcttaggtgaactgacactgttcagctgaggacatttttcagatgaacgtcatccctagctacctacactcccagaaggtggacaactgagtgcctcagcagtggagaactgagctctgtgtgacataccacaacatacactacaagcaccatggctagaaataagaaccagtctggaatcaaaagagaagtctataagcatctacagtctacagtatcctgagagtaacaaagcaaaatagcatgagtcatggtatttgcaaggagggggctctttgaaaccctagatatggaagtcagaggtattattcagtgacacctcagtactgaccctaggctctcttctctctttcccccaatccaagcgcctggagagctgaatgtttgtgaatagtctttcacacaaatgcatttcatcattagttacatccttgtagaattgtgatacagcttgaacagtataagcatttagctgttttctccattctagagtacctctaaagtaatttccccaaaaggtcaccatgaacctcaatttcttacacatagtggttgcttctcagtcctgtcctagttgtcccttttgaggcatttatactcctgagcatcactactcctgttgaaaatatatccctccaccatcttctatcatacctcttagtctctctcacagattctataatatttcttctgctcacaccttctaggtaccttcccctaagtttccacccttgtccaccactcccctaattttgttcactaagtgtcaatgatcttatctccaaatgtccaccatatccatctactccactccattcacacaacaggcttcatcatctttttctgggaccatttgcttttagttaattctttcttccttctaagctattctccatactgatctttctaaaacagacatttctaatcatgacactccatgatttaaaataatacaagatacggttcaaactgaaagtcaaggtcatgtcattcttaggcctggcctcgattcccagccttgtgttccatcattctgtactataaccaacacatgtccctcatgtccctaacataccacactcagctcttggttcatactgcccatctgccaagattattccttctgctttctttatgaggcaagcccatccttgaaagcccagcttgctgcctcctttctgaagcccttcttaaatcagcgtcactgcctctctctctctgcagccgcaatatgttgtgcacagctctatgataaccattttcacatagtgctagcctctcttacatttctctcccttgatgaattacaaatgcctcaagagcaagcactgtaacatatttatcttggtatttccagcacttagcatgctgtccaatacataactgctagatataactatttactgaataaggttgatgtcccactcccaattcttcaagacatgtatagtgcaaatcacaaaaaatgggatcagaatgtagagccaaaggtctagcaaacttacatcatttcttttaaatctagacaagttgttttaccactgtgccctctatcctccttaccccaatcccaaatggacaaaactgtcacatgtaaaagcccctgtagtattcccagcttaaaaaaataaaatccatagagcctgttgtagtaaactgtgcctcacgtgcattgagaagacaggctgtcagaatgtggccaacagaatgtgcagcaaggagaggaagctgtacctaataatcatgttacaaagacaggaaagctaagagataagaaatccacttaattctccctcttgtgtttgcttagctgctcttaaagccaggatgagcagcatggaagaaagttacatacaccaaggagaaaagagcaaatcattgacatttaccaaagtcaagaatccctgttggccacacatgcctttattcagatcttaacctttgctgggagggtgagaagagaatttaattctaaggtagagtagtttacattatttcataatgaaatataactacatatcaaaaggtagactattccttgaaagaaaatgtaatttttcagccagtactgataaaagcaaacttggttagtcatgacaataaaaattacagtaatagtgaacatttcatgaggacttatgtgtcagaaacgattctaagcatttttcatgaatagctcatttatcacagctttatcaagtggatgctatcattatctttgttttacagattaggaaatggaggcacggagggattaaatgcttagtcagggtcacactactaatgagcggcagagccaggatgttgactcagatggtcagactccaaaccttgagttcctaatcactatatcatagcttcatggaaccataatccccagcccttggtttaccacctggtagctctctaaccttgagccagtttcagaactgcattgaacctcagtttcctcatctttaaaatgtggacaggattacctcccttgggagatacaatgagaactgtgagtgtctagactagcttggggcctgatatgtaataggactttaataaatattcattttcttcctcccttttctttttcatctttgaaaatgagttcatgtaataaacaaagaatatgccacagtaaaattcagtccgcattttatagattttcaactaaaaaagccaataaaactaatctggccagtaaacgaaaacctattgcttttcaaccaataatattacccaccacatgcttagcaaacagagtcaggtatttatggacaaaatgtatgtctctttaaaaattagttagacaattgagaaggcgcattaagttttgggggttccttggatgttgaaataaatactctttctttcagctgatgaaatttagatggcattggcaggctcaagcccagcttcacagcagagaggagagatttaagatctagggtttgatattccctgccactaggttatgctttaattcctccaggtcctctgaatgatactggatttataagaacactaaataacaccactgggctaaatcccaaagattgaaaaaggcaaacttaagtctgtaactaggatgactatttccttcacatcataaaagatgatacatattctttccaatgcctccccacttctttgaaaatgaaattgacacggatcatgagcaaatggcctacacagactctagacacccctcctccaaaacgcctcttaaagacacagccgttctgtgacagaatcttttacttgaggccaccagtcctctggcagggtaaaatacacccaacagaatacggatggctgatagtgctcccagaatgactgctacccccggattccctattgacatctgccaaacgactgtgcttactctaaacttacgggccttaagaagaccaaaatgttatttcttttagaaccatatttagcagctgttttgtttggtttcagccctaactgacaagcatatgcttacaaaagcaaaacagaacaaagaaaacaggaacagtaggagaactctccacatttatcttgaggcttcaggcttttcaacatcatcttcgaaagtacagcattaggaaactgtgctgactcaacaacccccagattctagtttatgctgcactcacagccaggcaagttccctcaaaggtaattttttactttaacttcccctcttctaaagcagtagaggtttgcagagtcaaaggtcttgctttacacagtaagatttatttaatccctgactgctacctggcaccctccctcgccacctactgtgtgttatacactgtccaaggtagaggcagtggggtacatggcccctgcttcatggtgcttccaatctaaggaaggaagcagacatgagcaacttactacacgtacatagtgattagatcatcataacgacaagcagcatatgagaaaaggtgctccaagagtattgatccaggagatctggaatatagcccagaagcatatcttcattaacctgctggcccaaagaagtcatctcaactggaatagataattcaagtaaaaaacataaatatatacagatagatagatagatgatagatagatagatagatagatagatagatagatagatagatagatgagagagatatggctataggtaggtaaaatactgattgttgatttttcttacttgatcatcagtgtaggacaaattaaactatgcaaacctatcacaggactggtccaaaacaattagggttcaagtctggattccactccttactagagttctttcacccctcatattccagttttcttcatctgtaatttgggaaagtgccctttggcctgcatttttacaatgtcgcatcctgcgtatgaatgttctaggtaactccccagctccctgtgtcaagcatcgtcttttgggaagggctgtcctgagtgtaggctgattccaggacacaaactgctccgatagagctgttcctggctagtgttggtatcctcttactaataccagctcctcaatgatcagctggctactggcagaacacagccaaacctccaggaactaaccctcgatactggtagcttccagtttggctttcatctctcagaacagggagactggagcctcctcacctcctgtttggtttgcagtctgcttagtttcacctgctaatgtgcagcagccagcagtgacactgctttagatcaccctccccgctcagctgcttcactcaagaccctgcagctccagcctgtcctcacaaagtcggcctttagaactggatttgaaacatcactcctcggattaatcactgcaaaaccttaagctatacaataagctataataggcattatcgttgtcattgggataggccatagcctaaatgcttttcatacattttcatatttcttccttatgcaacctgagaaataggtattactaaccccaattttcagatgataaaactaaggcgtcaaggaattaagtaacttgcccaagattaaacagtaagtggtagagacagcagccaagaccagactgtaaagtaaaggtaaaaatacctgtcatggaagatggttctgagaatccaaaacaacatatataaagcatttagcacaatgcatggcagtgcttaataaataatggctacagacatactgctcttgctggtggtattaagagaagtttcccaaggtgatgacaacattggttcatagtagagccaggattcaaatccaggtattttgaatccaagtccattattactcatttctctacaaatggccaatgctgaaattaacctggggttacggggatgctgaaggccttgtgggttaacaatagagccagagaatgggcagtgacctcaggacaggaaaccacaatgagccaaatggctgggagcatagaagttttctataccatggttgcttggtgtccctgcctcttatcagagccagaagccccagagagggagagcaaacaggctctcagatttctatctaaagctagtttctttttttcctactttgccattagctaggatgaatgctaattactttaagctaaccaattaattgacagtgagaggcggtatagcataatagtgaaaaccacagactctacagccaaaagcctgaatcgaatcccagcttcaccattttctagccatatgactttgggcatgttatttaatctttctatgcctgtttcttcaactataaaatactgataatggtagtacccactttgctggattacttgatataataattaatatatataaaatgtgtaaagcaacatctagcatattgtaagtgcttaaaaagtgttcgctaaaaattctttactcaagaaagaataatttctttactccaagaatgaataactcttattggttttgtccactgcagtatctccaatacctcgatcatgactgggacatcagagatattcaataaatattatctggatggagcaagtcctcacatcaccacttcttccaccgacagccacaatgcggtaaggtctgtgacatttgcagcgaggatttctgagatcatatcaataaaatatctctacccattttacagaagagcaaagagaggcccagacaggctctatatacttatgcagttatagatttctccagcaagatagtttaggtgatttatctgaggtcttatcctagttagtggcagagttaaatgaagacctatgtcttttgacttctagtttttccttctgtttgatttcaccctttagtaaaccgatggaatcacccattgcctttcaaaaagtggacctggaaaggaaggaaacagggacagtaggtaggatgggcaggccctgctgttcttttgcaaaatctaggtagttgggttaagaaatcgatttcattcatttccagaaatgatgtaagaagatttagtgcacatggccagtttgacagtccatttagtaggtcacatgcatatatatcagcataaaagataaataatattttcaaaatatatttttctcggttcacagacttagcatattcatactcacagttagctcagttcaaaattatttccttacagatgaaaacaaataattctacataaattgattattgtctactagcttacattgcataaataagtatatacaactaagaatataaaactaaaaagagaacaatccaaggacttcttgtaacactgacttgaatattttttctgattttggtgcatagcacagctattttaatcctttgtcagctgctgggattcactggccagcccttctcatgcttcttgacctgaaattcccaagtcacgactacaaacctgcttgtgcacacaaggaatgcacaagccccaactgtgtgttcagagactgttttctaacacattcagagtcagagaaaggcacaccaactccataaggcaagttaagaaaactcttcagggtactaagccacaagacagatattggagaaggatagctctctccatcacctcctgtaatttttctcagctcttctaaaaaagtcttttaagaagcatacatgcaggccggacacagtggctcacgcctgtaatcccagcactttgggaggctgaggcgggcagatcacgaggtcaggagttcgagaccagcctgaccaacatggtgaaaccccatttctactaaaaatacaaaaattagctgggcgtggtggtacacgcctataatcccagctactcaggaggctgaggcaggagcatcgcttgaaccagggaggtggaggttgcagtgagctgagatcacgccactgcactccagcctgagcgacaaaagcgaaacttggtcaaaacacacacacacacacgcgcacacacacacacacacacacacacacacgcaagttgctttaaaggtcaatatgcacatgaccacccccaaccccagcccctgctcaacctggtcccttccctcccatcatcaggttgttgcagagattatacagctgtttgggaaaatgtatcatacagtttacaaagatttgcaaacatgggatccttccagacctgtcaggacagggtaactttccagtatttccagcaaaacgaggtggaaatgatgggaaccagactagcaaatattttggccttttgcctttttgaagatacttagatgaagaaaaagatagcaactgcaggagatggatttaaagacaagagctggttacctaaataattaagaaagaaagattaggaaacaattcaaggttctgttttggaagaagagccttaacgggaccattcccccagagatactcatttaccacctgcttacaacagaccaatgacacgttatttgcttgaaagaattttcaactgttcttcctacacctataagcaaccatgaagttgattacaggcagaggtgaaacttttaggtaaaagggacctaactctattctaagtctaataggagtatgaggccccctttaccagctgcctacctgtccccacccctcttcacaatacagtgagcttccttctttgccctttgcagagggaacctctgatgagggcaagagttgtgcacactgaaaggggcagggttaatgcctttcggccaagggcccaggacttttctatgagtagggaaatattggctggttgattagatcatctgttactctcccatttccagagaagggtgagatggcccagagccatgtaggaacagccaggagcccaataatagctacctggagcagggacctgtcatctggcagaggtacaaaccaatcttagtccatcacttggtgtcaccagtaatggtacagatggctgaccaataccaactcttataaatctcatacagatgttaataacagggcttcatttgcatctatttttttttcaagcttttatatctatggctaggccaccgtgaaggacatacaaatttatttgcttgcttattagttttgcaaggcagataacattttggaacgggggatttataccatctgttcaaggatctaaaagctttttggcagactcaagaagctaaagccagtccttttgtccctccagatttccatgggtgttgaatttccactgtcaaataagtttgggaacactaggttaaaaagattagcaggttaggggtttctttactgcaaggcctctcaaagcttttaatgtgttaatgtaccctgtgaatctccaagacagggcaaagcttttcatattttcctaacttgtctggccacagaacactccttaaggaagctttgtatctcctctaagcactgatattctgcagagcatagaatggaaaatgacagtgtatagagcaatcttttctgtgtcattcctacttaactaaagcttgcatcttaagttactgtaacagagatggatcaatgccacccaatattcattctccccttgctccttaacaaaaattccaattttatttgggaggaaatgcacccagctcaaaatctacatgcccttgtcccactgaagctaggaatgaatacatgactaaattctggccaatggtatgtaagcagaattactgtgtggggcattcagaagggctgcccaaatggagctgacttagctgggagaagggttcttctgtcttcctccctcctccttcctgctgcctggaatgcagatgtaatggctagaacactacagccatttctgatcctgaggtgaatttaagaatggaagccttatgctaagattgttatagcggaacaataaaatgatcctatggttctgacgatcatggagctaccatgctaccgctaagctgcctatgtctgaacttctttatcttgaaagagaaacaaacttctatcttccttaacccactaatattttgagttttctgtttgaagcagctgaaatctaattgatttactttgaagtttactgttcagatatttttattcatttatgtttaactaacattccttctttaaaggactcttctccattagccttttgctctttggtagaggtggcagtctctaaggttgttgaatacatcttttttttttttttttttttttgagacagtctcgctctgtcagccaggctggagggcagtggcatgatctcagctcactgcaacctccgtctcccgggctcaagcaattcttctgcctcagcctctgaagtagttaagattacaggcgtatgccaccatgctcagctaatttttgtatttttaggagagacagggtttcaccatgttggccaggctggtctcaaactcctgacctcaggtaatcccctcgcctcagcctcccaaagtgctgggattataggcatgagccaccgtgcccggcctgaataaatgttctatttctcctcctgctggcatgttataggatggcacttccctacccctcttgaagctggctggggccacatgatttactttggctaataaagtgtgcatggaagtgatgttccacttccagatggaatatgtgactgacagttcaaatcattgtgatgactgtggaagcatatgtggacatgatgcctccattagtctggtacttggatagctgatgaatggagtcctctactgacccactctaggcatgtggcatggtcgagaaataaactttagttatataaagcctctaagagtgttcattaccatatcctatcctactctactctgactgaaagaatagaaaagaccagaaactgatgataataataatcatattgtataatgctttgtaacttttgaaacaatatttgagaagaactgcttcacactgaatgtctccccatgccccagacattatgcagggtattttgcaaaggttattttatttcatctctgcatcaatcctgtgaagtagattgctcacaagagaaaaaaagcgaggctacaagagcctccaatgccaaaacatacattctcctcactgtctcccatgtgcaatatctgaaggcagctcccagaaacagtaaaatcccttccaaagctggctgatgatacagggggcaaggaaagaccagaatttttacaaggtgcctacgttcacaaggctgactacacctacatggcctaaaccagagcatgctggagcttgtggtctctgcaccccactgagggcaacagaattgcaagtcctcgactgctcttttttgagtgtctttgaactcaaaacctgctttttgagccactgtcaaggtaacctagcagctgagaataactaattgggcaacgttctctgactgctggcatgaacagttataatctcagcatcactgtggcaacctgactggaatgctggttattcacacaaagaaaaactggtctccattcagaccagaattgcattttgtctttgttccacttttcccattacaagttgctactgaaggaacaatgcttcttttaagaagaatgtgtattattggtctgtgcaaaagcagcattttcttagccaaaaaaaaatttggaaagggaggaaaaagtaatatgtcctatattgccaaaggcaaagagactattaagaaagctctatataaacaacagtaaaggtcatcttggggtaattctgtggcgtttcagccaggccacagaattctgtggagatctcaatggtgcaacatgggcaacagatgactaaaaactagattacattcaatcaaccagtgcacatttcctgagcacctacaatgtgctatcacagacactgtcctccaaatctcccagtggttccccggtctactctgctctcccatccaacctcagcctccctttaaagctacagcacacctctccccaggcatcagctacagcctccagctcaccattcccagaagatgttctgtacactcccgcattctgtgtccttgttccctttttgttcttgctatccaaaaagtccttttgtcccatctttgtcagtcaaagccttaccagtcttttgagatcagattcaaatcatagttcctacctaaggtcctcccattacactccattagagtaaattccacattaaagtacattccaaagatcgctttgaatgtatctgtcttactgcacttggaaggcaactctccagggagcaagatcagcatttgaataaggctttaccacttccagttgtgttatctttgaaaaatcacttaatctcttagagccaaagtctcttcacctataaacagcatgctactcagactgcacccatgaccatccaactcatctgggaaccttgttacaaatgcagaaatctgggccctgcccagacctactgcatcaggattaacattttaataagattcccaagttatcccaatgcatattaatggtaccaaagtattgataaaatctacccagcagagatatgatgagaatgaggggaaacatagaaaacatccaacggggagtctaatacataaagactctcactaaatgaggaaatgactacactttatatccaataaatgtttggttaagttgaactgtttggtgttttaaaggattcagatatttatggcatgagctggccctcaagtgacatgtcagattagtaaaaatagattaaaatacatgaaatataaatgaagagaagcaaaagaactgtgttttagaagagcacatgactgaaaatgacttcatcgtttataatttttctgacattgaacaaggccactaatattttttagcctttggtgtcttttcctatcaagtagaaataagaataaaggcagcctgcttgcctctcagagttgaactaaagttattctaaagttaaaatgagctaaagagaatgaaggaattttgccaaatacaaagaaatgattaagtcggtgtttatcaagtaacactaaaatacaacatacccatcacaaactgagctcacactcaaaggtggccaaacatgaagggcacacggaggtcaaaacggtacattaaggccactggtttgaggatggagttttagtggaaagaatgaagagtgagccaaaggggacaagtagctctgccttctcagtgggctgatgactgaggtatctactgctttgaaaatactgggataggagtgggaggggacaccagctgggccctagaagaaaaggaattcacagcaaacctggggccctctcagcctaggggttaagagagaaatcagaagggagtctcacgactgtcagggcagaggcctgagactagacggaggtgtgtggcagccactctgacgaggaacacagaggaaacatttgctggaggaacctccatcatccatttctcaagaaccctgctcaagaaaggagaaaggatggagtttgggatctctgctctaacaagtcagacaagcagaacataacataaatgcaaagagagttcagacaggcaggaaatcgatacaaactgacacagtcaagcggagctgaatggaaaaggtgggcaccaagctagactttaaaatacctgcaggatttgggtacacagacagagatatcagtagaggggataaacttgctttgttaatagtattattttaaaagaacacatgttaattgcatgtatcatttctgtcagaaatgataaaacaatcctatcacttataggacagcatatgcattcagcaaactttaaattatttctagaaatcaggattccgtaagcatttcataaggcaaatggatttcaagtattgaacacacatggctatgacaaaatggcagacatgcatgcgataaagaatataagccagtcatttttttgaacaaaatgctgtttgaggcctcacttctcccaggcaaatgaacaaatacataaatgactctgatgtaataacttgtttacatccgtattccccactcagctatgctcctgctccttccaaagctgaagctgggctccattcatgttaatatctttagctacatgcactgtacctaggctacagggggaccttcataaatgctggttaagtaaataattttaccaagatcaacaacaagaaaatatttataagttgttgtttactttttcttgtgaaataaataaataactcggagagagatgaatacatgtatcttcacatcattaaatataccttcctctgagagtaccagctgggtcccagagaatctgtgaagctgcattcaaccacggcatatctttttggaaagcctattttccataaaaactttggtgttcgtggtgttttttaatatgttaaattaaacatgaataagtttgtatcaagtttaaaaataaaacacaaagatgctaacaaatttctggtttgcagtggaggtttctcagtcagtccaccagaatctctagggtttccagtttcctcttctttacccacagggatgttttgataaagacattcagaagtgtattgctcacctataccatttatagccctaattttcaaacacaataaatgcttcttatttcacctctactcattcagaatttgcaattactgaaattagagctgaacagaagtttaattgtctattgtccatatagaatagatttcaagaaaagtaataacataaaaaaggaaatctcatttttaaaaatcttcagtcaagtatcattcacatccagtcacttgctaattacaattagacatctctatcaaagccagtgttctctgctaaaggtggtgttccaggacctctgttgaaaaactttgccactccagggtttctcagttattgtctaaacctaaaagggaataagattcttcaaaaattattattgtcttacctttcagcaatataaaatgtccctgctcctcccaggtctctggattagggaggtttttctgtgaggcaaataatagagcaattctattccttaaatagagagatggtcacactggtgctaattaaataagctgagcatgtttgctttgtgcacttttcagtacatattttacaatttaaaagtttgaaaaaataatttaatcattaagagggcagcttcaatttagaagaatgaggaaacagacataagcaacccaacaattaaactatcagttccctgttctaggagtggttcaaagttcagaaatgaaggcctacttgagaggcagtagaggtaagtgtcttttattagtgcagaaattctcactcttaattactgaattccactcagtcattaaccatactatagtgcaatgctaactacataatgctagtagatagagtgtctcctacattgagataccagtgtttgccagtgtgtgtaactaaagcaagcctacagccacatctccaaaacctgacatcggctcttacatcttccacattttgtttcaaatctttctagggatagttctttcaaaatccctctcatgtgcccttctcagtcactatactcaaatgcttttatgagataagaaacttaaggagtatgtgtctggggatatttttaggaagagatggattttgtgcagctgattattaagtcaaataatgaattaagaataatgacaacaattgaagtgaaaaatctgcgtcattacagtaatctttctctcttgaacagaactatttggcttaaatcaaagccacctgtaggattatgaatttcaaaccactaggagtgaggcatatgaagtttctaattagcactggccaggaaacattagttctcccctttgcggtatcttacaggtggggatagagtgattgtatgttctcaggagaaatttgcagttaaaatggcctagtggttcagaacttggactccaacagaactgaaataatgactgtactatcagaaaaatataggtgagcaaggagtgtggggggaggggacgggggggagcagatctttccaaagaaagattgctgccagtgaactaattgactatttaatgtgtttattttacttgaccatctccaggagtgatacaaaataattaaacagcctgtatgtattttggtgatttccatatatcctaaagtactcaatacaaagactggcctgggccagagctggcatgactgccctcagcttccagttctagtgccatcttatccctcctaatcaatttcctctgggcagagatgtccaacaaccaccacagaaaggcctggcttagaatcttatttttataaaacataacaacttcccattgacacacattattgaatagagatactcttctgaaaaggttaggggtctctaagaagtaatacaaagaacactttaaaatgtagtaacttacatatttttaaaattaggtataaaaagatgcaaagagcactggtcattgtagaaatcatttcagtttaaaattcaggtcctgccacgcattagctatgtgactgagcaatctatgttactttgttgagtttcctagtgtcttggggatgaactgtgtctcccacaaagggtgacttcttccctactgcttcagcactcacataggcatccttacacacacacactacctttgtgttctacttcaactgctttcagttagtctgttcacaaacaacttccttaaaaactgatttccatcttcaaatcagagtaagcatcgtgtacacaaagcccttcctaaatcccatttcctcctccccagcagagcttagttgcttctcctttgtgttctaacagtatttgactatagcacttgccatgtattgtaactatgtgtttaagtgcctaactccacctctagactgcaagctacttgaagtacatacagtttttgaatgttattggtatctctagttttttaacagtatcaaaactgacagtaagttctcagtgttacacaaaggagttgattaatagcagtgttcatttcttgtatacttactatgtgctaagcacttacatgcattttctgtaatcctgacatgaactctctaaggtggacattagtattttaattttatagaagagaaacctgaggccccaaaacaacaaataagtgattaaagtcaggatttgcccaatctccaatctgttcacaagggatctagcacaaccacctggtacttattaggtcctcaaaaatgccatcttttttcctactgcccagaaaacaatgggaatgtgacttctgcaatggaagtaccagaaactgtgtccgttggtgctggctaacactattacttagaaaattttgatacaaaaagctcatttcaccaagtctgtgtcagcaaccataaacagatttttcaattgcacattaataattcccaaaaatattttccgagtgcctgctctgtgccagttctgtactgtacactaaagatctatgaataaaaagtcaagaccccagtctcaagaagcagacaccacgaggtaccaacatttgtagagcacttgctatggaaactttagagcacctgggaggacataatcttaatggacagatgttacatgcccattaaacccatcattaggggatctatgaatcatttaacggaacatagagtagcctgttctgtgccatgtatgtggccacaggagattcttttaggaagataatgtcctccatttgccaatgtttgtgttaaaattgaagtgcagccagcccacaggggtactcctaccagcatgtacttaggggattgatcagggtttccaatgaaatggcaatatggcagccacatagtgaagcagagagcatcaagacataaaagccgttcattattgaaactttacaacaaattccctgacaacctttccctggagaagccccttgtttctgccaacccattacatctattttgaggctggcaacctgatgtgcctctgcacacaaccccaagaggcacccttcatatacaatacaacatgatgcaaatacatcttgattggttcctctggagctgtgtgacaaggtggtcctgactaccaaagtaattaaggttctcatgcaccttcagttgccaagccattatcaacacatttgattttcagggaacatgtgaggagacctctgagcctttgtggcacgaatttaccaaaggggagcaaagcctagtgagtgaggtgcctctttctgcccaaaagtgcaagtgcatgatcagccatatggaagagatcccgggtaattactctcggtactttcgtttagctattaaaatgccacccaactgtcaaaccttcactcagtgttaattactgccacaccgtgtttgaatgcagcacaagtaggactgaaagtagaaaataaataataactatgcaaggttacagcctctttttgtacctctggttgcagtaaccaccttcgatctctttttaaggcctttcgttctcaccgtcattccctcatggactgagcagttgtttacaaattgcaaatgcctatgaaaagcccctatttcacagggtctcgcacacagccactcaattaatggaactaaatgccttggttaggttcacagaagctgctgaataactgccatgctgcacttggcatttgcctccagaggaagaacatgatgctgggtgatgttggtgatctcacctcttggtacattagctttcagctgaaagttcaaggccatcaagctgcttctctgactggcagagagggtgcatattaacctcacacctatccttcatgagataactgtgctggcttattctgctcttggactggagctatattttatccagcagttcttaacctgtgcccatggatgttgtgaacctgctaaaactagatactatgctttgtgcatgtgtgatttataggaaagggagcccaaacactgatcatctgaaaggactctaatatctagaatcttaggtgacctttcaacggtccttcaacacaagctgggcaagtgtatattcacctccatttcataacagaataaacaaatgctgagctgtgacttgcctgagtgatctgagaataagttgaggcacttttccagtactaattaacatcttcccagaggatgcatctaccatttgtaatatgtgagatgcatttatctcacataaatcaccttcgctgggatgatttgtctttcatctagactgtaagcccaaaagacaaaaactatttttgtctgtcttatcatctccatgtgtgtgtgtaatagaggaacagtgtttgtaccgaaggggatcaatgtttgtcagtctaaaacatgccatgatggcataagaattattttgagctaaaggcaactgacaaacatcagatgtatataaagctgtctactccccttgtatctgcctaaagtcagggcataaattttcctcagtgaagatgttctctctttcctctcccataccaggaagaggaggcaactcttattgctgaagatggcactgacttcaatctgcataaacaaaattgactgtaataaatcttatctttcattagttttccccatatacttatcttcacataaataagtacccctagaagtccaaaacccctttcttttctcttgtcatattgccacaatttattgttctttgttaagatggtatatataagcccccaattctaaccacttccttaagttatatttctttgtgaacttccatgcatatgtatgtaattaaatctgttcttttctcttgttaatctgtcttttttcagttaacttgtaggcccccagtactgaatctaaaatagtggatgaaaaagtcttaccctttcctatagtatataacaataactgtgatcagtgaacagatgcaaaccaaccttcagtttccaaaaatatttatttctgttttctgtcacaagacacctgtaggacaattttttttgatgaccataagatgtaaaggacaatgcttagaaaaacctagacaccaagaaaaacctgctaatgtctgcaagaaaagaacttcataatccagaagttcccaaaactctataattgctgaagaataactagaattttaacaaattgctcaaaatctcctttcaagtcctcacaaaatcagctaattcattaaaaagaaattacattatatgccccattacatttcataggacactggagatggacacaggcactcaggaaatactgggaaatagggacagtgatacaaatgacaataagataaaacaataaggatccagagaatggcatttgaaacttgaaaactgtatattgaaaagggtgattccagaaatttaatctggtcacaatgtctaaactggtggctatgagaaaggggaggagagggatggagtcagcaagaccagataaaggcagaatgacataattaatgtgtagcactttcagcatatgaaaacagcacttccttcatcttcccaaagaccatcagcgttgatcatattttattattaagaaaatacaggctgggcacagtggctcggcctgaagtcccagcactttgggaggccaaagtgggtggatcacttgaggtcaggagttcgtgaccagcctggccaacatggcaaaaccctgactcaactaaaaatacaataatcagcagggtgtggtgggggatgcctgtaatcccagctactcaggaggctgagcaggagaatcacttgaacccagaaggtggaggctgcagtgagccgagatcgtgccattgcactccagcctgggtgacagaacgagattctgtctcaaaaaaaaaaaaaaaaagaaaagaaagaaagaaaatacagttatcatactgtattcagtgtattcaatgcatactttgtctcatcagtgaggaaattttcaactattttctgggcaaaaagagtaataatccttggtagtaataaccatttatctgaaagaaagcacttccacaagctttctgtcacattttaaaataaaaaaaaaatgagccttctccctttacaatgcaggcatttctaggaaccactgtaaaagggcccactttttcagtatgtctaagagcagacagcactttccaccacctgccttgcccactctctcctagctcagtgcactttctcaggttgcacaagtacgaacacatggagaatgcaaagaatctatctaagtttggcagtgcttgctgcattctgcctgtagaagtgcccccaaatggtgcaagctgaagcaaaacagccgcagaagcaaaatacaatctcgcggtcagtgcagacccagctgcccttgtctcttagacattcctggctggaatcccactgagcaaatatagggggaaaacagacaagaaaggccctagattcaggaaatacccagctgctgcaggagagagcagcttacaaacagcaatttccctttaaaagtgcccccaagggcagatctctaaattatccctcgatatttcttttcaatcatgccatgaccctaccactggtttttaaactcctcctcttgaaccatatgatggacctacaagcagccagtaggttctcaaacacagctttcactattaggcctgaaatccaaagggaataacgttaccctctcatagcatagtttcctcattcagccatttctcaaaccttttttctccaaaattcttgctatcaagagtgactgttaataccaacagaaggacaagccttcaaggaacacagtaactgatctctttcgtaattttcatttgtcaaactaagggaagctatacaacttagaaatcaaatgtcatgttcatttatcaggtatttattctattccaaatctacacaggacacggacagaaaagattcatgcattcttttgaccgatatttattaagtacttactgcaattcatcaagtctaaaatacatattttttcacattttgacatttctggaattgggatgcatctgaaaattaagattctggttttcttcttttagtatataaaataatatagcatcttacaatcaattgcacatgccatggacgaaatgcttaaaacttctcaaatgagtacagccatcttttcccttgaacttgtcctcctctttcaaatgcatcctcagaggctggtaccagagtaatttttatctggggcaaatcttgtcctgtgacccttccccctgtttgaaccagccaatgaattccctttacctatgggtaagcatggagtcagaggtccttcatgacatgtcccagaccaacactggcagctcatctccccttgtctcctgccaaattataaattttcctcaatataccaatttctctgaactcaatataacttttagaattctgctcaagtattgactacctgaaaactttctctgacacttctatccccaaggttgaagtaaatgtcaatcttttgaggtcccacagcctcctatgctttattatattattaccacactctaatttggggctcttgatctatgtcccccaaaagaccaagatctccacaaagggaaaggttgtgccttgcacatttctgatgaaaaaccccagggacactgcctggcatggagttgaagatcaaaacataattgaaaggatggatgaacaaaccttatgacatctcatcctcagttcataagacacctagcttttagagatcatcagcaaccaaacaggatttcaattcttgttactcttgggttttgtctaaaaaacaaatgggaattcaagaaaaattgtttcttagtttctttccattctataattttgttatttgtgctccactgaaaattacctgctattctatccatctggcattgatcaaatactgcctttgcctatgaagcacctttttaaaaatggattctcagattggcaaaacagtctcgcacctaagattcttgagctgtgtgtgtgttgcagggggaggagagaacatgtctaaaactccggggaaatacgtcatttgagagcacatatttggtttaattttatacctagaaaacaaatgctctctgcattataaactaaacaatatacggcttgataaggtgatcttggctgatggagaaagaaaaaacgattgagattctcaactggggaaaagacatgatatttttatgaagtttatcaaagggagatatgagttttagaagttcaggaaaaactggcacagtaaaagctaatatggcataatcgttaacagcagattctggcagtagacagacacggggtgaaattccggatctatccctcgctaactggctctttgattctgaacaatttacttaatctctccaagccttccttttgtcatcagtaaaacagggattatcaggcacacctcatagggtcattataggactcaaatcaaagattgcatataaagctcctctaaccgtgcttggcacttaacaggcccctcaaaaatggtcgcaattattacaactattaataacatctcttctccagttaaatacagagcctacattatatgtcccattacattgcataggacactggaaatggacacaggcactcaagaagtactaggaaataggcatggtgatgacaaatgacaataagataaaacagtaagtatccatagaaagacatttgatatttgaaaactgtatattgaaaagatatcttttctacgattaaccaggttttttagattacagttatttttaacttatgaaatacagataccatgagcatttgtgacatatgcgtgcagttcaaataataataaattgaacggagtgaacatccgtgtacccaccaccctgcttaggaaacttaggaaacagaacgttaccacttggaaatcatctgactgtctttccctgatgtaccctcctctcatagcccagggtaatgtcttgaattttatgtttctcgtgtttttcactccttgctttttaaaaaacaggtttattaagatataattcataaaccatacaatcatccaatcaaagtttacaagtcaatggtttttagtgtattctcagatatgtgcaaccatcaccaccataaattttaggacatttcatcgcctcaaaaagaaaccccataccctgtagctaccactcctcagacccctcatcctcccacccactgcccccccaaccctaagcaatcagtcatctactttctctacggagttctctgtcctggacattccataagaatgaaatcatacaatatgtgaccttttgtgactggcctctttcacttagcataatgttttgtaagttcattcacatagtagcatatatcattacttcattcctttttatggccaagcaacatgccattgtttggagacaccaaactttattcctccattcatcagttgatggacattgtattgtttctgtctttaggctattacaaataacgctgctatgaacatttgtgcacaactttttgtatagacatattttcatttcagttgggtacacaatacgtaggagtagaattgcctggttatatggcaattgtttaaccttttgagaagctgaactcaccagcttttatactgatctccaggtggcagaaagctaaaagtatgtcagtgacttatggtgctaaaccaacctattcagccaacagcaggccctcaatgccagtgaaaactcttcataagtagttacacatcaattattcataggtgtgcaaatcctatcttctaagaattgaaattttctagcagttaaagaaagccagtagcaagaagagaagacttagtagaaacaaggctcttccacttcctagccattctcagttgattcttttgactctcagactaccatttttaaggtatttttcatgttgattcagtctactgtgtctgtgttgacaacttcaatgatgaaaccactaaagatggaatataaaaatggactcatattgaagacctacagaaatatcaatgcattaggtacagacaattttttcagaccaatgacttccagcaagtatgtttataaaaattaaatctacttctcaccaagagtctgaattgccagaaatacactggcatgaagagaaagcaggcaaggggtagaaggaaagagattaaggagcagaagcttcatctgaaagcctctgaaatgtggcatctggaaaatctattcacaccctcacaaatcacttttggtctgatgtgccagtctctaaagcctttgatacaagagtgcgaagggcatctgtctctgattttcctactcaacacttgtcttgttttctacagtctgctacactccccttttgttagccacagacagattgatggacagagtgaggtgacggaccaaggagtacattattcacctttacattagctatgttggggggttaaaaagttggccaacacagtaacgcctctgaattttaacacagtatttctgaatgtctttgactcaagtaaactattgctcagagagatgtagactaggaggacctaggaagcagaaattctcagtatcctatcgtgactggaatgaaaacatgctgactgcccagctacccatgtgaactccacattcccctcatcttgaagtgaaattagttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagacctagttaaataaattatgactatctcaatgctagagaatagtaggcaaccgataaaaaaattatgttgataagaattttttatggcaataaatattattaccaaaaaacaaaaaaggaataaacaacactatatacagtttgatccaaattttacttataaaaacatatatatgtgtgcttgcaaaagtaagaagactggaagaaaatatacgtgtttagtggcatgtatatctgagtgacattatagtgataaaaaatttattttattctccattctctttcagtattttccaagttttctgtagcaagtatgctttacttttgtatggaaaaatcaggaggtggggaagtaataaaaatcaaagcagaaaggagtaaaaagttattattgccgagctgttctactctgggctgcatacagctgtccaccaatgttctgggaagctggcccattgtcaggatcacaggacacagcaggagtaaggctctcacaggaatatacaccctgggtgccccagatctgccctagactcagagtggacccgggacctgatgggttttcttaaattggtagaaaccatactctgggcccacagttcccttgccatctaggacaaaaatctaagacctaaatctagttttctgaatttgatttgcaagagtttcaagaaatcatgccaaatttcccctggtgttctcattttcctcatagaaaatgctagattcaggccaggcacggtaggtcacacctgtaatcccaacactttgggaggccaaggcgagaggattgcttaagcccaggagtttgagaccagccgaggcagcatagtgagacctcatctctacaaaaaattttacaaaaaattggctgagcatggtagtgcattcctgtagtcccagatacttgggaggctaagattgaaggatcatttgggcccaggaggtcaaggctgcagtgagccatattgcaccactgcactccagcctgggcaacagagtgagaccctcctatctcacaataaataaataaataaataaataaagtgctagatccagaccccagccagaaagacatttcctccccaagaatattcttccacatcctcctttttgtaaatacagttccatattattcttaatgttgctgaaaaatattttttggaaacacttaacacatgaaagaaattaagcaggacaactaggagtggatggtgtcacaaagacaaggaaagagtctcctaagcaccatatgcccccaaagataccaagatgagacagatcccaaaagcgtccttcggatttggcttctactggtgctgatgatctctaccagattcagggaggactgaagtcagaataacaaagtggtgtgtatacctgagtgatgttataatctttctttaaggggtttgcctgggaatagcaggagaatcaggccagtgctcacagggttgagacaaacacatatctagttggaagctagtgaagaatacagggaaaagggggtcaatgaaaactgaggagagacaggaataatgagagcagatctagtcctgaagaaaacaaaaaaagaagaagctgggaaccagagctccatatttccttctctcctgaattttcatttaggagaggtgagggatcacccttgaatgaaagaggtactttgtcttctggaacctgacccagtgattcttaaccagggagcccatcagaatctcctgtggcaattttacagccaacacaggcttgggctcctcctcctcctcacctcaccagcagacctactgaacggtcctcttcaggacgaggactaggctgagttatttctaaaagctcccaggtaattaagatgcacaatgctgtctaacgatcactggttagaaaggaggaaagggtgatgatggtaggaaatagcttcataggtgtaagagcaggaaactgaggaaggagagggttcagggttctctcaactaggaggtaaggtcaagaagtagagggcttagggagcagtgaagtcttaaaatagtctctgtgcactgctcagaacaaggcatgtgggggcaggaggaggggcaacactttatcaaatgtctaggagcatcaaggtacatcgtggagtgatttttcccaggagggttcagaaatgtagaaagcaagtgagaagcagatggtcagattaatctatatgtgggagtttcagggggatttggcatgaaagagcaaggaagtaatttaatatcaacctcatagggctgttggaagaattaaataatgcatttaaacacagtccagtgcctgacacaaaatgagagctcaataaatgttagctgttattgtcattgctacaaccactgttgttatttatttctggaaccaagcaaagtgatcacgtctgtttcttaggaatctatcaaatagaagtcagcagttgcttctcaattaacagaggaaaaattcgaaagctatgtggggtgttaaacccctcaaacaagaaatgctaataatcatatatttctgtaggcttccattaacttagttttgaatagctagttgttgagcattcttgcaataatgactaacgataactggtaccacttttactataaatacagcagcacaaaagacttaagaaattgaatggaaaataatgctctctttagaaagcccatgtgaggctgtttaaggtaagacattctgaacctttattccattactgctgcctccatccattcaaaaaggatttgtggaagttggcaaagatgcatacaaaacaaaattaagaaaagaaagtaaggcaaccagtctaaagagaagtaaagggtaaggaaaaatgtattcggtgtccaatgcacaggcaaagaggtccctttcacaatgctagttgtgggtctcgaatttggctgtgaaccacctggcagtggactaaagagggaaacaggaacagtactcacagtttccaaaaccaagggaaatactgctattattgttaataaagtgtgaaaattttttccttcatagattgaccgtgatatagtgaacaatgtctataatatccttacatcaaggtttaatcacctgactaaaagatacccttcctccagcttcaaaaaaacatccttaacttctggtagaagagacatggtaccagaatcaaaggttagctctccaaaatttaggaattttttctatgttatttattagtccttatgttccatcaaagacagaatcattttgaagcatatccagctcaaataaattaatgttcccattttttggaggaaataagtttacatacttaaatatgacctgcataatcactcatctaacagtaaagtatatttttcaacccagaattattttgcccagccaaagtatttttaaaaattgtaggaacaccataaagacatgctcagatatgcactgtctaaaagttttccttcctttctctgaaagctactgaaaaatgtgctccatgaaaataagggagtaaacaaagaaagaggatccaggaaatgggagctagcacaaaaagggaaaaggatgacggtgaaaggaaatcccagtatggcaggcctagggcacagatagtccagcctggggctggtcagaggctccagaagaaatggccccaacaagatgaaacagatgaatagctgctgtggctaaatacgttaaagagaacagcccacacctggggaagagtgtagaactacactagtgatgagtacgctgaaaaccaagcaaacaagagcttttgtcttagaaaagggggtgaatggccgggcacggtggctcacgcctgtaatcccagcactttgggagacgaaggcaggcagattacctgagatcagaagttcgagatcagcctggctaacatggtgaaaccccgtctctactaaatatacaaaattagttgggcgtggtggcacacgcctgtaatcccagctactccagaggctgaggcaggagaatctcttaaacccgggaagcagaggttgcagtgagccgggatcgtgccactgcactccaacctgggcgacagtgagactccgtatcaaaaaaaaaaaaaaaaaaaaaagaaaagaaaagggggtgaatagaaatagatccatttgcttgcacaaggaaacaatggaagcataagaaactaataaagacagcaacttacaggagatggagaataatggagacagtagaactagaatagagtgaggttttttaaagtacactttctatgttgttttaatttctaaaccatgtgaaagtactacctgttcaaaatcaaataaaaataaagttctaagattgttttctgctaacagtgtccagaggctttacttgttcttttgacagcatcaactgctgacccacacttggctttctgtattgcacacatctatagagaattagaggcaaagaggtcacaggatatggctacagccttgaaaataaaatcagtgaagataagagaagtgggagaagcatcttcaatttatcaaagcatgaagtacagccacttgttttctagaaaaaatagtactggctatgtacctacagtataacccatataagtgtatagaaatcagatgtattaacaagttgtttttaatgggggctctatgagaattttgaccatgcagttcttcctcaaattcccctgtgcgttttgaggagtaaggatccctagccactgtccaccaaatgtcagtgtgactcctcagtcactgaggcaataaaaaatgttccctcctccacatttccagaagctcatactcccaactgagaaccactgtgaggaataagtaaaaaaattaaaaattaacatttgtcaatttttttccctatcactgccactaatttttatcagttcattaatttaatgaatctttataacacattcattaagaaatcatgaacaatctgatcttccaaatgcttgggtgttactaaagatagtttgtgccttgagtttgtttttttttttaaccgagctagagaaaatctgaggaatctagaatccctgccagccttcagtcaaagtcctgcttcacaactgcagagtatgcagtttaattttttttaagttcttatatattctctcattgacaaaggctaattacttctcttaagagtcatgtaagctcagcaaggaaaatactattttccccattttcacagatagggagtctaaaggtcagagcagtgaagtgatttttccaagctcataattgacagaacttggagcagaaaccagaacttctggttgtcagtctggcggtttctccactcagctgtgatgtttactctagacagtattttctctatgccaagcctataacacatcagcttgattcaaatctttaacacgatgattataaatttgaaacccagcatcttatttttaaactgacaggtcaactataatggtcctcaaaatggtacactttgaaaatcaataaaggtgactgagggttttacacaggttagcttgtgtggtcttcccaatagttcttctaggtagatacaatcattatccattttacagatgaggaaatgtaggcagagaaaggggtaagcaatgtgttacttaaggccacacactagtaagtaacagtgtggatttgaacgcaagcagtcaaactcaagtcggggaaaactcccagtagatttaactaagaaataaaccccccagaaaaactggcaggtggattgtttagataaacaatgaaatgtctctttagctctgtaaagaaaaccagcaacccctatgtaagtttttgatcaactggtaaaaatgacctcaaaatatagaaacaagcaagtaactgtccctctatcaaactaaataatattttaattgcctaagtagtgggcatttaataaatcatcaattttctattctattaataatatttctgtggaaacaagacaactctcaatcaccaaatctggtaaaaaaaaaaaaatcacaacaaaaatcatacagaggcaacacaccgagttaaacaacagcctggagaaaatagattcattttattcaacttcaaaagtgataagaagttgactccaattattctattccacataggaggttatgatgcttatgaccaatagccaatgcataagactgataattttctagtctaaaatttctacagagcatcccaaaattctattttcaaccaagtttaatctccagaagtaagagtatgatatcttggtaagaaacactatttaatataaaaattcatagtcatgaaataatttagtaagacaccaaaagggtcacagtcttacctcaaaaaccatgtgcatactgaaaagtagccaggttgagggcaagtaagaacttagggaaaagcctgaactatcaaagaaatcatctgtctaagtccccagaagaatcaacctctacagaggtaaaaatggaaagggcgggaggagatacagctataagtaaaactccatgtggcctatattctatgataatgtatgatcaatggtacaatataggtaggtaagcatatatggatctataacaccagaaaaacaaacacatgttgagttaataattagatatctaatgatcaaagaagagctagaagtgaaaaaaaaaaccagagcacctacttaccatgggttcagtggtggtccctgttgccagcacacattccgtaatctcggaatcctgtggctagtccactctactgcctccctagatgatggaactctgatgccatggcacattgcaggagctacctagtcatatcaacagagttacagactcaggaattgagaagaacccagagctcggaggccatgcagcagggcaccctccatattgagagcaaacaccatttggggtttggggtttatttatttatttttttttaagacagggcctcacactgtcacccagactggagtacagtggcacaattatagcttactgtaaccgtgagctcccaggctcaagccatcctcctgcctcagcctcctgagtagccaggactacaggcatgcactaccacaccagttattattatctcttatttttctggtagagacaggatctcactgttgcccaggctggacgtgaagtcctggcctcaggtgatcttcccacctgggcctcccaagttgctgggattacaggcgtgagccacctcacccacccagcaaacacagttttgaaagactttctagtaaagagcccaagaattaactgcccagagaaagaggatgtgtccccatcttacagatggccagtagaggcacccagaagtgtgatattcctgaaatcactgattcagtactgaacatctaagataacacagcgatttgctgacaaagatcacagtagactctgtgagactgtaccttgaagaaagaagggaagaataggggcagagaaggcccctcaggcctgcctggggaagtgggggaatgggagtgaggagaggcagaggggacaggaagaagcccctccagcagtaatcaggggagagaatggtcaagaggagcttgaaggacactgagagctggggactggggtccggtggttctccactggtatgtgggtgaaagtggagaaggaaaagtcgaaggagctgatgagctaaagaaatggcggaaggaagtagaagagaactggggaggccttctgacagaggtcagtgctggaaaaggggaaggtgggcacaagagatgatgacaatcttggtagaaacatcatacagaaaatgcaaacatccatctagatgaccttcagtgatggtaagattctattaaccttccagagttatccgctccaaatttagaaacgttttatttgtaaaatagaaattgccttgttgctttggtccatttcttctcattttaattggaatggggttggaggacagttggttaccactattaaaatgatgtgttttcactgggctcatagctctttaaacagactgagggataaatactctcccagcccctgttctaagttggcagacagacaggaggggccactaagacaacacctaccctctgcaaatcagcaccagacaaacactttagttggacagcagaaattatatctccattttccagaggaacagaaacatctaaaagtttaaatttaatctaacaagtattttgaagttcttgctacatgcaaggccaccctaagtttatttgtgacacgacagcatcttccactatgaatgaaacacacacaagaatctcagagtttcaacaggcgcccatctatctcatcaggctcattcaagaatcagaagtatcatttaacagtccagaaaaaaagacattcaggtgcctcgtggctgcttcccgtcttcaatcccttcagcaatcatggttctgagtcagctttcataacccacaatgacacatctatctgaggcacacattctgagataataatgtccataaatggctgaagataaaagaaaaaaatcataagacagtataatgggaatcataagacagtataatgggactcataacaagatataatttccataaaaaaccattttggtggcagcttcttctaaaaaaggtgatgaaagtaaatataacatctctcacataatgtttatgttctgtaccttgtatagattctatgtctttattaaataaatgaaaagaaaaaaagtccacatagacaaataaaataccacattagggcttttttttcccccgctcaatctggaaaattttgcaaaaaaggatcttttatttatggaagccctgactttcaaatcttatttaataagcttttaggaaatgaaagataccggtggctcatttagccatgaagggaagctgcaacaggagccagggcctagacttgccaaatgaaggtggctggaggaaagggctatccgattcattccgccatgaaggacttttacttagggtcaggtgaccaagattctctatgcaggtcagaagacatcagaaagcaggccgatctggatccaattcagcatctggcatcattgactgcctcggccatgtcacttaatcctcctgagcctcaattccctcaatggtgagataagcttgtttatgggactacccacctcagtaggttgttgtgatgattaaatgaagtgccatgctaaagggcctgatacctaccagacatacaacacaaaccaccctctttcacctcttcttattttccctctggctgaaccccagtggtatggcaagctaagcgtctctaaatatcaggcgcctcaactgcaaactgacaaaggataaagtatgcgaaagctttaaatcgctatgcaaatgttaggagatattgttattagtgccaatcggtacacctcactcgcaactgcacatcagggaataagagtaaaaagcatctctcagggagtttctttctaccccacctgtatactgctaactataaagcatagttcagcccccttcagggacactaatataaaagtgtccctgaggggggatgaactatgttttatagttattttctttttcattttgtgcatttaattaatgcttttatttctgtgctcatactcttgggtaaaatttgagaaaaccagaattggaaatgctaaagacaaatattagcaacaagcaacttgatatttgcatatccttgcaaagatccaaaaggagctgaatatgtggaaaacaggtagtaagataaagaaaaacaagtgttaagaacaaaagttctgtgagtttctctggggtgaaacttgcctaacaatcttcaacacccagcaaagtgtccggcacatggaaggtatttgataaacgatatttacaccatctgtaggaacaacgtgacctcagtctaccactgaccactaataaaaagataagcagaaaaccaaacctgaaaaatgaatattactctagctgatatgtgtttctattgactaatttattgatttttagaatggccatgggtacactacaggggtatatggtcttcaactcccaactatgtaaactctgaattccaactttaaattgttcaaaataaacagaccaaaacaaggcctctataacccccattacctgtattgttgagatgatgagtttgggcagaaacaaagcctggaatgaaacctcattcccgtcctccccagacaccacatacatcacatgggtgtcagagaatcctgtgcatctaatcattttcaattgtcatttcatctaggatgccaaatgttaaataatcaagactaaattttctctctgtctctctccatctttagtgcaagcagtatattatgggttaccatactattcttaatttctaatcatttttagtgtcttttctgccaatttgtaggcttttcctacctatcccagtgtttcttctggcctatgcaacacttgctttgcatgtatattatgccagagaaagggaaatttatattcaccacaattttgtacaaacaagcaaggcaaagttaaataaaaattagaattcagaagagaagcagcaatttatacagggttctttggccctctgccaatcctaaaagaactttgataacatcaaactacagaggtcccagcacctatctgtaaaaagagaaatacacaattctcagtactcaaaagcatcttctggtttgctatgctagaaaacaaaccaccctaaaacttagtggctttaagtagtaattttattatctttcatggttctagtagcttttactttgcagctgaagctggaatgatctgaaggctttttcactcacatgtctggcaccttcctgagaaggctggctgacacctctctccatacagcctttctggatgagtatcttcagcttcctcacagcatggaggtctcagagtaatcagctccttgcatggcagctggtttctcaggatatgaatgaaggctgcagtctctttaagactttgcctgggctgggcgcattggctcacgcctgtaatcccagcactttgggaggcggaggcgggcggatcacaaggtcaggagatcgagaccatcctggctaacacggtgaaaccccgtctctactaaaaatacaaaaaattggccaggcgtggtggcaggagcctgtagtcccagctactcgggaggctgaggcaggagaatggcatgaacccgggaggtggagcttgcagtgagtcgagatcgcgccactgcactccagcctgggcgacagagcaagactccatctcaaaaaaaaaaaaaaaaaaaaaaaaagactttgcctggaaaattggtagagactcatttctgccatattttatatgtcaaatcagtcatcaaacccactcagatgcaaggggaaggaggtatagaccccacttctcaacaggagaattgaattggaagccaccattaatccactacactcagattgccttgcatggtctgcatcacaaacagggctaatggcagaatgagccccagtggatcagatttgtgcacatgtagatgtccactcctgtaaaacatcaataatctttttttttttttttttagagacagggcctcacgctgtgtcacccaggctggagtgcagtggcatgatatagctcattgcagcctcgaatgcctgaggtcaagcaatcctcccaccttagcctctcaaggagctgggactacaggcatataccatcatgcctggctaatttttcattttttaatttttttgtaaagataaggtcttgctctgttgaccaggctggctgagaaatcataatcttaatgttgggagattgaaagtggtgctggtcaactgtgctagttaattatttagtgtgttttcatttcactgctatcttccaagtttggggaatttattagaaaaaattaaaaaagagttgcctttgatcactggcaatcatcaaatatataaatttattgcatgtattttataatgtcatctgggtaaaaaaaaaagctattaatattttcatggaggtgcaacaggtttaattccaaattttggtcaccgaaagacttcatggctcacctttttatactggtcttccaagcggaaatgaatagataattatgcagtcctggacatacagatttaattcctgttgtgaatattcattcagatgagcaggaaaacttcaggttattttaaatcaggatgagaaatcaatactactagtaccaaagaatatatctgcatataaaactgctcattaaagtcaggcaaggaagacatagctcccggaaagccccacttagaaattacaccgaagctgatccccgccagcaacttgttaatgaatatctctggtgttctaggccctagaagaacacacaaaggatggggcgagaagttttccattttagacggtgaccaagccctgtaggaactggttctgtctgaatcctttctttacccattcctgatgactgcttggtggcttttttgccttgggtgcctgctcttatagcaggtcttcaagcctgctgaggggcttcttgagaaacttcaaaccatcctacttgagttgtccttgctctgcaaagtccaaaaacaaggtatggccagtctaataaccctttctcttggagaagaggcagttcgtccctgttcaagagaaggcaggaatgacaggcagacatcaagttctttcttgcttaaccaacattaggcagacagggtccaccccagagcagcagtgtgtgatcactgttgacaggtacacagagaggaagaggtgagcagcagcaacgtggaaactgggttaagaaaaccccagggaaaaaatagatagctaattagagttttcaaattaatgtgcacaaactgaaatgaattttcaaagatgttcctcctttccttgtgccaaaatttaagtctttttctgaggtccagaatgttacagccaacagaacaacttggtgatagaaagcaatcatttttaaaaatcataaaagagattaattgagcccttataatgtgccaggtgagtactgcgactatcagcattttacagatgaggaaaatgagacacaaataactttaataacctgcccaagagcacttagaaagcaagagctaacacccaagtttatactcctaaccaccacacaaagtatagaagaaggagcagggcttttctgactaaacaagactgatatctaagtctaactctgccaattactgtgctagatatgtgactttagtttctaaactttctgagcttcagtttccttgccagcaaaatagggataataccatctaattcttataattggttgctgtgaactctcagaatgtaggttttcaatcaatggtaactatttttttgttatgcagaccagagggaacacagccaagctagcaaaaatgaaacacaagaatgggaaggaaacctggaagcatcaggaacatgcacacctcattttctgccaagcaggcaaactataccttggcgagaatttcctctccagagcctcaactcctctttttaaacacggaatgggcataattctgggagattttgcatatgcagtattcataactcagggaaacaatgtgcattttccttttatttttaactagagatacacaaatacatgataatatcatatgcgcatacatatttttacttacattcaatcttttgcaactctaatgggtccttaaatctgattccaaattaagtccttcagacacggctctgattaaataactagctggtttcagagccatctgaggattttttatgctaataggataaaatccagtctctttggcctaccttcctctacctttcacagtaatttccattctaatgctatcacacacacatatcccaccccatgcctcatcaggaactcttctataaaggacaaggcctctctgcctgcttgtccctgaacataaacatcttgctcattcccacctctgcatctttgcactggccggatcctctcagcatcacccactggctcatttcctccagttcaagtcctaccagtctgttaagaccctgctaaaggacctcctcttccagcagacctcccatgaccaatttggcccccattaatccattttgtttttctactgaattcctacctgtgcagacttttcagtttcatttctacataatttactactatgtaactttccttagagaaaaatcctccctcctcaaggatactatatgcaacttgagagagcacatggttaagagtacaggttcgcagtcaggcagatctgaagtcaaatcccagccttgccatattctagctgtatgacctggaggaagctacttaacttctccaaatcgtagttccttctctgtcaaatgggattataattgtagttatctcacattgtttgaaggggggattcatgcctggtaatatataagtgctcaataatgtcagctataattattatcactacccatttctcacacgtttttaatcccccacagcaccagctatctattaataatctatctacctatccatctatccatccatccacccatttatgttagagactcgatgaatctttaccaattgcctaacttagacgtaccaatccttctcaaatttccacttctccaagaagcacaaagctgtttctactttattaagccagcatcgaaactcaagattccccagatagggtctcacacagagcatgctgatttccaggagctttaaatgggaatgaaaagtgatcattcccttagttcagatatgctggtttgaagaatagctgagtaattcatgaggttctttcaggtgcattgatcagattctgctctttaagaagcattgtaccttgaagtaactatttgtcattccccttccaaatgagagctagataatagactgcatctgtttagcaaaactataacaaaggtctaaatgataataataccttagacctgctggatgcatcatagtttataaagcacgttcatacacatccttcatcgcatgcttccagcagccccaatcagataaccagggggtttatctcagtgtgctaagtgggactgctcaggctggagaaggttcaagagctttcccacaggccagttcattgattcagatcttccaactcctacttcagtgttcattttatggcaccacaggatttaaaactattcgcatatctttacaaagagatacccagctggaaagtgtgtaacccactgctaatttgtgttttggttaaagtatctatagtatcaccttggagatataatgcaaagcaaatctgtcaaatggtatttaatgcagttctatactacctgagactaagtggaagacctcagttgaaactctgtttttaaactagccattttcagtctttcgagcctgttttcctagaagtagagtaggagtacacagcatcagcctgctgggattccttgataccagactcagcctctactgtacttggacagtcttccttggtccagttttccaccagttttctaccaggctcccccttccttactgccctccagttgcccaacccgctgcctggctctttctcagacatacagagtatgtaccatctcagtacctattcatgggtggttctcagtgcatggcctgctccctttccttattcacatttctgcacaaatatcacctcctcagagaggtcctcaaaccatctaatcttattaacaaccccagacgcactctgcaaccactttccctactgtttcatcatagcacttaaccactactagacattttacaaatgtttcatctatttataactggtcttcagcactggaatgtaagatctaggagggcagggctttgtattgctcaccactgtatcatcagcacttgaaaaggtgactgacaataggaagctcccaataagtacctattgcataaaggaatgcagcctataaatttccctgtttaaaatctctacctcttccaatttgaaaagattcttatacatgaagccaaaagaacaaaaacaaatctcacaactaagataaatgcacaaaaaaaattagtgcatggatgggacaaagaacaagtgtacagaacccctaggattggaacagccatgactccaacaactgttacaatagttacatcactggacctaatgccaatcagttgattaaaaaaaaattagctgggcacgatgactcaagcctctaatcccagcactttgggatgtagaggcgggcagatcacctgaggtcaggagtttgaaatcagcctggccaacatggtgaaaccctgtctctactaaaaatacaaaaattagccaggcgtggtggctcatgcctgtaatcccagctactcgggaagctgaggcaggagaatcacttgaacctgggaggcagaggtttagctgagatcacaccactgcactccagcctgggtgacagagcgagactgtctcaaaaaaaaaaaaaaaaaaaaaaaagaaagaaaaagaaagaaaggaagaaaaagaaaaagaaagaaagaaaaaattaatgaccaacattccccttctaccccccaggcaagaggtctctcgttgcctaaggcaatttcatcgcatgcctcagagtaagcaaaaactgacagataaatgtcctaggctatctttttgagaagaaggtccaagttatttcctggatttttgcagatatgacagtaaattggcaactgagggaataacaacctgacatcatgtgcccctaatctgatacaattagagctactcatcatcagccatgaaatgttcttgctaaaaatatgtaatctgaatgtaatcatgaggaaatcatcacatatccggaatgtagggcattctacgagacaactggacaggtctcttcaaaaatgttagtatcgggaagaacaaataagatgtagaggctctactagattaagaaaaaaagactcagttggatcctggattgcagggggaagctagaaaatcgaaaaactagagaaagctgaatatggatggcatagtttacaaaagcttcatcagctacatccatttactctacaatatttaaagccaatgtccaatttatcactattcacccctgcaagtaatcattaagcattttccatatatatcatgtccttctccaatcacatacatctcatcacagtaatatctatatcctgaattcagcagggcttagcctccacagggcatctttaatactaattggaggagacaggctttataaatccttatttacaagatgattatgaaaactatatttcctaggcctgtcctttacgcttctattattctctctctttctttctcttgccaataaagttcttattaaatgctgcttcagccactaaattgtaaattccctggcagtagaaatgatacctggttaatctttgcatttctaagaagcaaacaatggcttacatagagtacatagctcataaatgggttgttgaattttcgaaattactgtactttaatttagaccacataatgactatttatttgcttcaatttttaaatgaccctgaatgtctctgtgctacaaaatgtactgaggcactgtacatctttcagattttggaacttgcattcagttgccaataattttatatatttcatgaaatgtttaacaataaaactactctttgcatctcaaaatatgttttgaagaaattatgaaatcaagatgttctttcaatgtataaaatattcaataagtgactcaataaattagtagcatatcttatttgaaactgagatgccattaagagcatttagtaagctgttttgaatactcttatctatctctgctaacaaaggcttgtttcaccaagtaacttgggaagtcatcccagtatcatgatttatacacctctccccattcatactaaatgcatcttcactaaccctcttcaatgagaacttttatagttacttatttctttagaacttattgaattgattctcgtattgtgaaaggtattataacttatagttataaaaaaaagttaaaaatcatttaacttttgacttctcatctcatgcctagctttttaaatttccatttctatttgtgaatcttgacatctgtaagcctcctggatcatcaggctctgagacagtcacattctactttgctgaaatcagattgctcactgaacttcaataagtatgtttctttaatacttactagcacccttttgtgacaatccccaagcccaccacctcactgggacttcaccccttcctataatcaaagggctttgaaagacaagctttctctaaggctgcatggcatttcccaaagaattaccatgacctagttttgaactccagatagacttcagccagtgggaaacaatatacgaagcatctttatttcagcaactgagcctcattccgaagaactgctccctctctgagaggttaccccagtggaaaatactgcctgagagaaaaagagattacatgtgtggtctgggtccagccatgacccagctgtacaatcctgggaagtgagtcagtctctgaactttgatttcctcatctttaaaattaaacagtgagactaggtcacctctcacttgccttccagttctaagattctataattccatcgagtgttcctatgtggagcagaaaggggaaacataattatcaaatttcaaaaatacggcataaaccctttggtaattcttctgtattctgctacctctacgtattttgagtaccctggcaacttccataaggacttacaaaaccttagagactaaaacgtgggccaaaccgtatgacccagcaattctactcctgagaaatgaaaatgtatgtacacataaaaagttgtacacagatgttcatagcagcattattcataatagcccaaaggtagaaacaacccaaatgtccatcaactgatgaatagataaacaacatttacagtctccacacagtgaaatattatttggtcattaaaaggagtgaaatactcatacatgctactacaaggatgaaccttgaaaacaatctaaatgaaaaaagtcagtcacaagattatatgatttcacttgtatgaaatttccagaacagagaaatctacagggacagaaagtagattagtggttgctttagggtggcgtagggagaatgaggggatgggagatcatagccaaatgtccatcagttgatgaatagataaacaagattggtatatccatacaatggtatattattcagccataaaaaataataaactactaatacctggtaggtattagtctgctagagttaccataacaaaataccacagactgggtggcttaaactacagaactttactgtcttacagtaatctcagatcgtggtccagctagaaatcccagattgaggtccagcagggtcagtttctggtgagggttctctttctggcttgcaaatggtcacctttccactgtgtccccatatggcagagagagagcaagctctttggtgtctcttcttataagtatattaatcctaccagattagggcccaagcttttgattctatttaaccattatcacttcttcaaagggcccgtctccaaatacagtcacactgaaggttagggcttcaacatatgaatttacaggggatacaaacattcattttataacatgtaacaacgtggacaaaacctgaaaacattatggtatgtgaaagaagccagtcacaaagcaccacatattgtataaatctacttagagtaaatgtccataatgggaaaatccgtaaagacagaaagtagattagtgattgtttagggctgggatggggatagagttgaaggaaatgtggaatgatgtttcttttggaggtgacaaaaatgttctaaaattgactgtactgatggttgcacagctctgtgaatatacaaaaatccattgaattgaatacttcaaatgggtgaattgtattctccatcacaagaaaactgtttaaaaaataataaacaaatagacaaggctcaagatgattgcctaaggatgaaaaaacaaagagcttttgaaggaagtcctgggctcagatcccagtgctcccactcattagctgtgtaaccttgggccagtctctgaacctccagttcctttactctgtgacgtggggagagcatggcaattgttctcagttggtgtgaaaatgaaacgaggtaatgcacagtgcccgacaagtatcctaagcacttaataactaatggtcattgttgaatattattagcatttcatcagaagaatagcccatctgttttttgaactgaattgatttcaaagctcaggcactgaatttgaccacaagtttttagtggctactgcagaagtggaagcactcatttttcaatatccaacaacagagtcagtgccacttacctataagcttgctgttctatgaacatgtttgtgactcgagaagaggcatgtcactaaaaccaagatggctttttagcatctttagtcaagggagataccagtgtccaagtgatcaaactatttcatgcccggagctgacagtcaatatttgctgactgatcgacttagccatgcctgacttatgagggtttttatttcaaccgatgtttcattaagtgttggtaagacaggcccaactgtccctgggcctctggagccttttgggatatgcagaagaaacagagttggtccctgcctataggagtttgtattcaagcatctagtcctaaactgatttttaagtttatgtttactttaatgttaccactattccaactctccatgtgaataaacaataaaactgctcagtacatgaaggcaagcagtaaaaaggagtttttttacactcaaggtaggcccacctctccagcacttctgaggcccagttccaatccaaaaccagtggaaagaactctgggccaaatgctgaggacatgagagttctattcccagctataccacagaatagctatgagtgcaagactcctcctttatctgtagagaatatgtggatgcctgaaaccaagaatactactgaaccctatatacacaatttttttcctatactacatacctatggtaaagtttaacttataaattaagcacaatgtgagattagtagcaataactaataataaaatagaacaattataacaatctgccagcatcactactcttgcactttggggccattattaaataaaataagggttactcgaacgcaagcactgcaagactgcaacagtcaatctggtctgacaaccaagagagctactaagtagactaaagggagggcagcatctattgtgtggatacactagacaagggcctgattcacgtcctgggcagacagagtgggacagcttgagatttcatcatgctactcagaacgatggacaatttaaaacttatgaactgtttatttatggaattttccatttaatattttcagatcgtggttgactgtgagtaactgaaactgtggaaaatgaacccacagataagggggactacagtacaaatcctacccttttgtactgcttccatcactaagatatgaaagaccaggttagacagtaaactaagtctctctatcacctagaccaaaaaatgcatattagttctacataaactaagtgcctttgatagttctagttctcactgtaatttaataaactggcacaatgttctaaacaagatgtagaaactgccttccactccctgcagacacacacacacatgcacataccccagaaaatacaaagtgaggtccctgagcctgactggcagaactgacccattgtgataaattcacccatctgaaatgagtcctcttgggaaagagtctaccagcttatcctctagaattcacgcccctctttccatagccccttcatgggcctgtgtataagggagctgtgatccaacttggatacatactttccttctgaagtcatggtaccaccagcccttttgggtgtgggtgcctgtggttgtacactgtagttctcagctatttaaaaatatatattcctgaaatttgttcattctcacctccagctgtactccaaccataagataacatatgaagatgctaacctcggagccaggctggtttgctggataaaaagcagagacattgaataagaagacctagctctgctcctgattagttgtgtaatttttttttttttttttttttttttgagatgaagtctggctctgtcacccaggctggactacaatggcgcaatctcagctcactgcaacctccgcctcctaggttcaagcaattatcctgcctcagcctcccgagtagctgggactacaggtgcgtgacatcaagcctggataatttttgtatttttagtagagacggggtttcaccatgttggccaggctggtctcaaactcctggcctcgtgatctgcccgccttggcctcccaaattgctgagattacaggtgtgacctaccacgcccgaccagttgtgtaaatgagacttaacttttctgtgctttgtctgtaaataaagacaacaaataatattattgtgacactgaattaaataacatgattaatacagaaggaactagcaatgtgtccaccaattacagaacatcctgtaaagtcagtttgactaaaccattggatagatcctttctcaggaaagattaagtctcaggaaacattaattttaatgcactctctggaaatgttaagtaaaatataatatatattaataaagtagtaaaagacatacataaataaaatataaactcccttacacatacttacacacaccacatgtttatacatatgaattcaaaccaaacacactgtttacaaatggccatttatttctgggaattagtaagtccaactgtaaacataaagacaatatttatatggtcaagaaaaccaattcactagcttcagttttaactcaatttattaattttattttttaaactctactttctcaaaatgccttttttgttttgttaatgtattttttaaatattatcaaaatggaaaaaataaacttacttttggaaatcatgcattcagcaaatacctactatgtactggaaactgtgctatgcactgagatacaaagatgaataccatgggaccctaagttagccttgacccttgaagagctcatagtccaataaaactgtgttaaaaacaaatttttcaatcaaccaaacattctcttcattgatacaaaggagttctcattagtgagttctcattagtgctctaacacttcctagcccggtggctttgaacaatggatatcttcagaaccctgggatcttcatctgcacaaatgaaaaagctgaactatgcagcctgttgcatcccttctccagtgaaaatatgtgattctaattgccattttaagcccaggttgaactttccctttttttaactaccttccatggctaaaattacaggtattttagacaatgtgcaaatgagtcaatacgtgacattgtgtcaacatgtgcataggtatttattgcatagctatataaatctgggcaccaaaatctccttaagctgataagcaacttcagcaaagtctcagggtacaaaatcaatgtgcaaaatcacaagcattcttatacaccaataacggacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaaccctaagccaaaagaacaaagctggaggcatcacactacctgacttcaaactatactataaggctacagtaaccaaaacagcatggtactggtaccgaaacagagatacagaccaatggaacagaacagagccctcagaaataatgccacatatctatgactatctgatctttgacaaacctgacaaaaacaagaaatggggaaaggattccctatttaataaatggcgctgggaaaactggctaaccatatgtagaaagctgaaactggaccccttccttacaccttatacaaaaattaattcaagatggattaaagacttaaatgttagaccgaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctataatgaactcaaacaaatttacaagaaaaaacaaacaaccccatcaacaagtgggtgaaggatatgaacagaaacttctcaaaagaagacatttatgcagccaaaagacacatgaaaaaatgctcatcatcacttgccatcagagaaatgcaaatcaaaaccaaaatgagataccatctgacaccagttagaaaggcgatcattaaaaagtcaggaaacaacaggtgctggagaggatgtggagaaataggaacacttttacactgttggtgggactataaactagttcaaccatggtggaagtcggtgtggcaattcctcagggatctagaactagaaataccatttgacccagccatcccattactgggtatatacccaaaggagtataaaacatgctgttataaagacacatgcacacggatgtttattgcggcactattcacaatagcaaaggcttggaatgaacccaaatgtccaacagtgatagactggattgagaaaatgttgcacatatacaccatggaatacaatgcagccataaaaaatgatgagttcatgtcctttgtaggaacatggatgaagctggaaaccatcattctcagcaaactatcgcaaggacaaaaaaccaaacaccgcatgttatcactcataggtgggaattgaacaatgagaacacatggacacaggaaggggaacatcacacactggggactgttgtggggtggggggaggggggagggatagcattaggagatacacctaatgttaaatgacaagttaatgggtgcagcacaccaacatggcacatgtatatatatgtaacaaacctgcacgttgtgcacatgtaccctaaaacttaaagcataataaaaaaaaaaaactgggcacatgttactaaatagagggaatgactacaatcacccaaatcatttaaaaccgaactctttacattaaaattctgagttcgcataaactggtatgttgcatttatatgcactcccattcaatttatgcatgattaatttgcgtgttttggagcaaagaaatgaaattaatacttgtttttaatatacatgtccaaatatcaaaagccacaatttaagccagctgccaaatactgaaagactggtgtacaaactaacaattcttctcagctaaacattagtaatgttataaatagtaacattagttcacagcaacacaaatgccaactttttaacacccctatggctaaatatacagaaaagtatacataattagatagactatctacagatttatttaccatgctatatttattacccattcctgcagagtatttacgtttaactctgtgaagcaaatatccccacaataattttttcctccacattttaaaaatattttactatgaacaatgtggattctatttgtccaaaaaaagggaagagctgggcatggtggctcacgcctgtaatcccagcactttgggaggctgaggagggtggatcacttgaggtcaggggttcaaaaccagcctggccaacatggtgaaaccctgttcctactaaaaatacagaaaagttagccaggcatggtggcagacacctgtaattccagctattcgggagactgaggcaggagaatcccttgaacccgggaagtagaaattgcagtgaggggagatcacgccactgtactacagcctgggtgacagagtgagactctgtcaaaaaaaaaaaaaaaaaggaagaaatgacagcaccatgcatgtaaaaatgcattctttttaaacatcaaaataatcttggacagcgctggagagcatgtggagaaataggaacacttttacactgttggtgggactgtaaactagttcaaccattgtggacgtcagtgtggcgatttctcagggacctagaatgagaaataccgtttgacccagccatcccattactgggtatatacccaaaggaatataaatcatgctgctataaagacacatgcacacatatgtttactgcagcactactcacaatagcaaagacttggaaccaacccaaatgtccaacaatgatagactggattaagaaaatgtggcacatatacaccatggaatacaatgcagccataaaaaatgatgagttcatgtcctttgcagggacatggatgaagctggacaccatcattctcagcaaactatcgcaaggacaaaaaaccaaacaccgcatgttctcactcataggtgggaattgaacaatgagaacactcggacacaggaaggggaacatcacacactggggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataaatatatatatataaaatcatcttggaatgtatacaaaattattttaaacaggaatgagttttattcaggtctaccttgcttcaacctccctcctttttgaactggagccccatcctctccagagtctccagggcttctccactcctgggcacctgtcctttagccccttctcaccacactctgccactgtcaacccgtctttactttcccggtaaggccacagtctcctgaagtccagccttaggcaaaggtgacagaggaaaggagaggttaaggtcgctggagttggagaggtcaatgaagagcgagattcaggtgttgaatggctgcctacctggacaaataccactaaaaaatgatcataaacaaaccaatgagcaaatggaaaacagatgtaagatcgtccaagataagtggaagtgcccagggtcttggtagatcacagacgaaagggatacagaatgataaagcataaaatttgggagctggattaattgatcacaaagacaccatctattgctaacatccttttgttagttgatgtattattctagctgggccgtaaacacatctcaggaatcccactgttaatctatatcttcatcagactgcccagataggtctacttcatacctttcctgccctcctgaaatccccagtcagctcctctccatctcagcagaaaagctggcttccttctttactaagaaaaatcaaggtcatcagaaaaaagatttcctcgcacattctcctttccatctcagctcttatgtttcttctcttcctttcttcctatttgagaaaaatccttcctaacttctaagattaaatcctctgcctttgatccccttttcttaggcatattagattgcctctgtaatctactagcttatacgcttattaaccatgtgcccaatgctcagtttcctcagctgtaaaatggagtataatgcccaccgtgcaaggcagttataagatttaaatacaacaacatattaaagcacctgccacagagcagggtgcataacaaaagtgctattattattaccctctaagccttgtctccctcaatggctatgcctgctttctctcgcattagttaaaaattcacttagtgctacctttctaaaaggcgttttagccactggtactataacaacgaacaaaatcaagggaaagatggctcacccttgtgaagtttacagcctagtgggcagggacaggaataaaatacttaagtcaggtgataagcgccatggagttacaacttataaaagagtgtcctgggaggtctcacttaaaagatgacatgtgaacaaagacccaaaagaggagaaagaccaagcaggtatttggagaagagcactcctacgtgagaggacgctgcagtctcctggagggcttgagcttgaggaatgaggagggtgtgtgtttggtgctgggggctgggggagcaggtcaggtttggcagggccttgtaggttactgcaaggaattcaatacttactctagtgaataataaaagagagggggaccctggtggattttgtgcagtggcattatccaacttaagctttattaggatcactttagacactggatgagaacagactcaaggtcaaggaaggagaagggagatgagttcggagactttcaataattcaggagaaagttgatagttgcatagatgtgagaagtagttggattatggctatatttttcaagaagataaaataccaaaaaggttttctgatggatctaatgatcagtgcagagaaagagaggagtcaaagttactcccaaggactaggcccccagaaaccagaaaaatggagcagctctgtattgagataagcaagactgcagggtcatagctttatctctcccccaccactgcttcctgccccctgtggtcaaccgaccaaaggtcttcctcactttaagaaaagaaagcatgttagctttctgctgtcctaatctctcttaatgctcgacactaaatttcttgaacaattgctctgaatccagggtcttcactttctcaagggctccgcccccacccccaccccattccactacagataactctgcttccaaagagcactcccgcagggcaaccagcatactctagtcatccaggccagtagctgcaattctgtgctgcagcatttggcactgcccattattacctccttcctcaaattctctccatggtgggagatctaacatcctgatttacatgtgatggctgtgatcattccttccatagcctcctctttctctttcattgtctcctcctttttcttctcttctctcaaacacagcatcctctgaattctgtcccttgtccccctgaagctacactgccaagaccttacactcatagtctttatgactgtttatagggtctctagcacccagttcagtgactgagacattgttaattgaacaaatgaatgaatttatcattccatcaagtactgtattcctatatttagtttccacctgtctcccaagctccagctttagatccacaaccacgagctacacattccagttagaagtcatcctgccctacgaagttcaccaagccaaaaccaaacactccatcttaaccatccctccacaaagcaagctgcgttattttaactgccctacttattttaagggtatcatgatccccaaataagaactttcacctcttcaagcctaggatatctactagagtctccctctgccctctacaattcattctacaatgccaccagcttaattttctaaaacactattgtgcccatgtcactcatctaataaataatatttattggctccacataaccttcagaagttaagagagaagaagggagagagagcaaaagaatactagctagggcctgattttggctatttctattttccttttaaatatgttttctactaggtacattttcccctttgaaattcttagattaccccacctccagttccttgcctaggcaaagtacagtacaactcttcaaccagatattaaacatcttcaaaaatccagcccctattagcctgttcaatcttattccctaatacagcaagaatcacttcttcctttcagatggtcttgccatccctcaaacaagcattttacattcttacctccatatcactgcttacacaattccctctctggttgttctctcctccatcccctcttctctactctatgttaattgcccatcaaggtcttgctggaatcctacctcgccccagaagcctttcacatacattctaaccaagagtggtttgcagcattcctcccccgaacaccctgcaatttgctgtccttaccactcctgtgtggctcatcacagtgattctaaaaatgtgatcctgaaagcagcagcagcagcagcatcattttgttaaaatgcaaattttggggacccatcccagacctactgattcagaatctctagaggtagatagagcccacctccctgtaatttcacaagctccccaggtaaggctatgcacgctaaagtttaaaaactagtgacatgaaataccgccttacgttgtttgatcttgtcaactaaataatatgcaaaacaccaaatacggtatttagcatatagctatccctcaagaaacttgagttttgcaatactgtttcaagtagtttcatcgcaatatacatcaagtgaattttacctctacacctaattttaaaaaacaaaagtaaaaacaaaatgcctttacgctaaacaatgaaaatactttgttttttaacgtgaaccaagaaaataagccctgtcatagtggctcatccctgtaatcccaacagtttgggaggctgaggtgggaggatcctttgaggccaggagtttgagaccaacctgggcaacatagggagggtctgtctctcaaaaaataaaacaattagcccggagtggtggtgtggacttgcagtcccagctacttagaaggctgaggtgggaggattgcttgatcccaggaatttgaggttgcagtgaactaagattgtgccactgcattcagccctggcccagagtgacaccttgtctcaaaaaacagacaaaaaaaaaaaaaaagaaatgaaattaatattgttttaatcaagagcttgtttaaaatcatttaatttaatattaaatgaataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttcagaaaggttaaattaattaagcaaagaatcttcttttgtaagaactttcttacaaaagaagagcccaaaatgaaaatgttgtctcctacataaaaaggaaaataatgattaacataaaaaggtcttggaatagtataatatgctccatttatcccccatatcaacaaactttttcttcatgtctattgcaaacagaatacagtggtagctgctatgatagatcttgacgtatttttatatatttagcgtctttagagttttattgccaaaatgtccagggttccatacaagtacattctttttaatataattttctaataaacagaaatactggagagaaatatgccaaaatattatcagggattcctctgataattcctctgagtgaagattttacatgttctttttactctctatttactgttcttgtaatattcaatttttttaatgagcctacattaagttttaaaatctaaaaataattttaggaccatatttttgttttatgcatgcattagtacagtaacttacttctccacttaggaggatactgcttttgcgtcttttttttcatatatcagtttgtttaatccacacaacaaccctatgaaattggtaaaatcattattcccattttacagataggaaaactgagtcacagagaaatttagtacattctacacagaattcaaacacatgaagattaacattagagtttgctcaagtcacccaccaaaaggctgccacccaggctggcaacttacatcctgccttttggcaaatcccaagactagttaattacctctttttgagaatgcatacacagaaacacaacaataagcctgtgtgacactgggaaatgattgattttccttattttgtattgtatcttgacaactcagaagaaaacatgcaaaacgtaatatataaaaattttagtatgcatttttaatagtgtttccaaaccaaaagaactctaagagaagatggcctccttaagacaagaggcaatagccaaaagagaagaaaagattgaaatgaggacacaaatgaaaagaaagaatacaaggaagcctaagatgcaagaggaaagctggaggcaatacagaacacaatcgacttgtggaaaataatacctatgctgtgaaagacaaacatgatcacaaccagatgcaatttcaaaagacggatacaaaaataaataaggaaaaggtgatagagagggaacatacagcacagagatccaaactaagtaggaagaaattcaatagtaaggaacagaaccaaaaataaaaatagtaaagataaatattcacatgtggacaaaaacctgctcccaggagcaaaactacagtgagtactaagcaaaataactgaaaacaaaccctatatctatgcctaaaaaagtaatttccattattttcccaaactcatagcactaaccagacggaaaatcaggttaactacaaagtaatagatatcaaattagccctaagcctctctttcacaatattaaacaccattagcctatgaaccatctaagtttggtagcaaaagtttatgataaaatccttgtattccctgacaaattattgttcatttaaaaaaggcaaaagaaacattttaagcaatgtgaagcctcataaaacactgcacgtgtataacattctcataaaaatctattccaagtatacattccagctaagtgaataaaaactcaaaataaagaactcaatataatagagcaggaaatgcctaatttcatgtaatgaccaatttaatgcaaaaggctaaaagcatccttgaaaaacaatgagttgtacttaatatcttcacattttaatttaaaacaaaaaataagaagcatataatattaaattgatatcagataatataatgtatttttaatctatagcatcaaattgaattaacaaacactggaaggatgaggtcagtgtaggagaaataaaatttaacttgactcttttttatgtaatggggacattaaaggattccttttttaattaatttgcataattagagaactacaggtttaagtatatattcaaattggatttttgaaaacagtctatatagaaaaacaaagaaaacactaaagaaagtagaataaataaaatgagaagagatcaaacacatcatttatggctgtaaaaccaaatggtttaaattcctcctttaaaagaaacctcttacattgggttcaaaaagtaaatcttactatatatgctgctttcaagtgatacagcaaaaacaaatcaagacaaattatagaaagaaaaggaaaatcatacataattgagcaaacacaaagtaaaacaaacaaaacaccttatgaaaccagatgtaattcttaggaaaagtcattacctgaaacagagtgcttatattaataaaaatcaaaatctactgtgtataactgttaaaacttttatgcggcaaatattgcatcacagacacagaacacacacacagacatacacacacatgcacatacacgtgtgcaacaaaaacacaaattataacagcagattaaaaagctattcttatctgatatttccaaataaaatttaaaataattttttcagatcctaaaacaaattcctgcttgatatttttattgaaattccatattaatatgggaataatattactaaattttcctattcagaaacatgagatatttttgcattaattcaggcctttagtatgtcccttgttaggttttaattttttcttcatataagtcctgcagatttcttattacattaatttctagatattttacacttattattattaagaatatctgttttcttttctttttccttttttttttttttttttttttttttgagacagagtctcactctgacacccaggctggagtgcagaagcatgagctcagctcgctacaaccaccacctcctgggttcaagtgattcttgtacctcagcctccctagtagctgggattataggtgcccagctaattattttgtatttttagtagaggcagggttttgccatattggccagactggtctcgaactcctgacctcaggcgatctgcctgccttggcctcccaaagtgctgggattacaggtgtgagccaccatgcctggccaagggtatcttttttcaaatatattttgtaattgattgtttttcttggctcacaaaaatactattgatttgggtatatttattttgtatccagccacattgctgaattgttattgttctaatatatctttagttgattctctaagtttttgaggtatcatctgtaaatgatgacaaggttgtccctgtcatcttgtaactcttttttacttatttatttatttatttatttattttttttgagacaaagtcttgctctgttgcccaggctggaatacagtggtaccagcatagctcactgcagcctcaaactcctgggctcaagcaatcttcctacctcagcctcctgagaagctaagactacaggtgcataccactatatctggttaattttttaaaattgtttttagagacagggtctttctatgttgcccaggctggtcttgaactcctggcctcaagccatcctcccaccttggcctcccaaaacactggaattacagacatgagccactgtgcctggccctcatcctcttataattcttgtttcttttatgtcttgcctttattcaatggctaacatttccattacattatatattattattggttattatctgattcctgacaccttgatatcatccctcactttaaaaagaacatgcattaattaggatgtttgcaactgcaagtaaaaaaaaacacacaactgagagtggcttaaacaatgtggaaattgtattatctatataatatgaagactggagtcaggccagttccagggttgattaattcagatgctcaataatgtagggacctgatacgtttattctgtgattctcctggctttcccctcatggttgtcagatggctggagcaaacctaagtatcacagtctttagataatatccaagtccaggatagggaagatatctttttacatatttacttgtaaaagaaaggaaagccttcccaggaacccccagtgaggcttcctctggccttcttattggacaggttgtgttgcatgacttgcttaagccaatcatcaacaaaaagaatggaatcccaatgactggcttaatctattctacctcccccatgctggggaagtggaggtcaacttcctctgagaatgtggaaaggtaaacaccaaaacacatccagagctctgtgagaaagaaaaaggatggggatgactgccgggtagggaaccaacagtgtgcaccacagagagtctctggtgtttaaaggataggtacagggatgactattggttttagacatattatcaagttaagaaagaatgtccttaatcctagtctattaaaaatagtttttgctttgttttttaatcaaaaataactgctaagttgtaccccatacctttttgacatccattgaaatgatcccataattaatgtcctttggtctactaatatgttgtattaatagacttcctaagacagaaataagggggcttacatagcattttctgtgttttcagttccatactgttaattagcaatttttagggtttttcatacaaagcaagaaacacacattattgcttattaataaataatacttcacatataaaaagtttccagatcctaagccagaaaaattgaagagggagaaatgaatcagagggtgacaggcaagaaagacagacagaacaactcagacatgaagtgatatggcttgttctggagtgggggcagtagggcaggaaagcatggaaggaacacaaagcttacttctaagacacaacacatgcagacttaatctatatcaatattttacatcaatggcattctcatcatagcattgggaatcactgagaattgctttaagttatttcagctccatgaaactcccactcctgaccttccctccatctggtccacttccctccatcttccccactcctatacagctagccatctaccctggtgctctgacaatactctttatctatttttacatctgtttttaccactacactttgaacttcttggaggcagaacctaataccttgtaaacctacatatacccagttgcttgcactgcaccagattcagagtaggctctcaaattgtttgcaagagtgatgctgatgttgaatgtattgaacatttattgtgtatttgcaacatggcaggcactgtcataaatacttaacataaaatatgtctttttaattccagcaatagtcctatgtgtactgttattgttacctccatttcataggtgtagaaaagtgtagggattttacataacttgtcacaagctgcaaagctagtaagctatagcaccaagattcaaatccagagagtccaacccctgatgtaatcgtaagtcattttccttcctgtgactttgaaaacaaatgagataagccagaagctcacaaatgagcccaaattatttcatggtcaccttttatacacgttactctctgaggtgccaaaaacgttctggctaaatgctctgccaaggtgtcatctggggaatcctaaccagacactagaggctatcatcattcatttacatgccttgattttcaaaagactgagaacaggttgaagatttgaacattgcagcacaaatctgcatcaaacagacagtgtatctacctttcatccccatccccagcctcacacagagccagtgcatttgcccccttggatcatttggcgaggctgtcaagaaccttaacacccctcaaaaagaatgaaatcaagcacagcggcatctgtgccagttcctctctttttttattactgcccccaaagcctataaaagcttggaatctattaattctttctttatagctggaatgtctactcattattatctgagaaaggaagagtcaatttaatacatttgatttcaaagattctatccagtgaagtcatagttcattgcagtcatatcagctgattactgtaaagtgcaacagtctgcatttgtaaaggaaaaaagcacccaagcttagtaggaggtacacagtagagaacgtgggagacatcgggatagcatttgctgctgaactgcattttgcagacctgaccaccccttccactttgctctgttccaggaatgccatttaactgtcatgggccttatccccctatagctgtaggataaccacaagagccagtgagcactcactaaagctaatcaatatttagaagctaaaaatgaaacgaagaaacacacaaatgcaagcataggcaggggaggcttttaccctgtgcctccaagacctatgtctaagctaatacatgcaactgcttctgggatttatggctgcatttattcaaaccctgtagcctctgaagaacagctcatcctctccttccatattagattggaccagccagaggcaggcccttctctgccaacagtcagggaggtgagagtaaatctgccaccatgtagattccatcattctcaactcctatcaggtaactgaaatccacctataatctgtcacccatgccaaggccatgtttgaacttcatttgatgccctgtgttagaaagaatctttcttgctcacatgcttcttaaaagcagaattagatggctccagatgacttaaacaaaaatctgagggcctacaatgtgccactaatgacaggtgctgaggaaatccggggagttgataaccagctaatcagctagctagctatccacgccatgaggcggcaaaatgtcttttcccatactttcctgttagccactggggaagctgccccacagacagtgctttttagagtgcatagagcagacatgggaatataactgctgcacctgcacagtgacttgtcgccaataaaaattcacctgtgtctcatttattgagcctgtacttataaagaggtttatagtctgttgtcttaatgaaccactttaaagtctaaaggggagatagaagagcaatgagtagaggccatttcaccatctcagggccctctcagtttcttccccttgcatagcacctaggaggtttctaacaatgcaagcattaagacccacagctgcctaggacacaggtctttccatttcccaggggtcctgcactttgttaaggtttggtttcccagaatcacaatccctcctcttaaaggctaaaaacacatgaaattgtattttcacaactgcatagcaagtcgcctgtccactcagttatagtggggatgcaggatccaaacacgatgactcccagaagacacgtcctggtgaattacgtgttaggcacactgcagaatgcaaatgtaaacaagtcacttgagaaagtgtcttaagttcctgcccttaagaagcttataatttaaatacaccaatggcttgtggacaaatcattctgaagcaaaacagagatgcaggtgataaaaagtgtgaacagagcaaggcagaaaaacaaaagtaaggattaacattaaccaggggacctagatgatgaaccaaacctccctgatatgtttttcataagaaagtgtcttagtaacaggggttttgtggctcgatcaggttaacaaaaggaagagtgtgtgggtttccagccctgtccaaccaccacttgtggtgggatcagaatttggactccacgctccaggttcaaccccagcctcattccaaccctgtcaagcacatttctaatcaaagtttcagagtcctatgtccctccaaaatcagaagtacagttccccagagagcagacagtagttctaccattagaaaagcattcccactatttatttagaaaatgggaagcagcaatagcacaatgcttacatttcatgttttaaaatcggactagccaggcacagtggctcacgcctgtaatcccagcactttgggaggccgaggcaggcggatcacaaggtcaggagatcgaaaccatcctggctaacatggtgaaaccctgtctctactaaaaattcaaaaaattagctgggcatggtggtggatgcctatagtcccagctacttgggaggctgaggcaggagaatggcatgaacccgggaggcggagcttgcagtgagctgagatggtgccactgcactccagcctgggtgacagagcaagactctgtctcaaaaaaaaaaaaagaaaaagaaaaaaaattggaccaaactaggttcaaaaactggctccatcattttcaataaatcacttaacctaagcctcactttccacatctataaaattagaatagtatatatcacaagatgtggctgcattaataagactagacttttattaaaataattaacccagtgcttgacacgtggccagtggtcacaaagtatattagctataaatattggtattaaattttgttctttctcatctcccactgcttcaatcgactagcctaaatgcatgtgtattactattattattatataaattacactccagatcagtgtcaggtacatccacatgttggtgtgacctgagactctatcctagccacatttcagtatagttcttggaactgcaaagcttaggaccaaatcctggaccacaaattcctcgctgaaagtcttgccctaaccaaggccagcatgtgccactggcctgtgccacccacccacctggccctcactcaacacctagcacacacagccctcagaagctcagcatgtgctcagtttccactggtttcatgaacattctactcttgtctcccagctgctccgagggaagggccatactctccccattactcaacctcactgtggcacatggtagaagcctgcacagttttcctgtacataatatgacagtgtccatgatttttctctccctctgtttttatgatagccaagaccatgctaggctgggcgaatgaccacaatgattactggagctgagcctccacccagttctgcagactcttaagccctcttcctttctccacatttcctagagggtattctcaaggccatggtggctactgcagtttccagcaactcattcctccttgattactgcccctttccttccctcgccatcatagtaatggtgagtaacagtaacagtaaacataggaacatttttctactctattctaattttttttcaaaatctgattgcaacccattaaactcactccacaacccattacaatttgaaaaacacctggtatctgtgattccaggaagatgacatgctaaaaggagctctgatcatttgagaaaaggaattccccaactttgtgggaacaaaagagctgagctctaggggtaacagtggaggaaataaagtgtatggaggtggaatggggtggtagttactgatactgtagaaaaatagggaatggttagatcatagaaggtcttgctaagttaaggagtttagcctatgctgtaagtcacgagcaggcattcatttcattaataaatggatacaaggatacacaaaacatagcttgcctttgtggagcttatagtctcttctgcaggaagagggtgtggagggagacaaccaaataatttgttaacaaatgaacaaatggcacattatgataggggcttgggaagagtttcaggcagcaggaacagtgtgcataacagcatagaggtgagaaaagcatggaacattaagaaaacagaaagagttagtaaggaatggttttagacaggaatagctctcccagtcctggccccaaagtcctttctctacaggaggaataagttatttgagctaccttatcttgaaggaaatgattatcgttatgtttgtaaaatatgacaagcgcttcagaataaagaatgacacgaaaatacgtagaaagcagaagataggatcagagaacccatctatctctccaggtgttgaagagatggccttcctagaaatatcacagagacctgactaggaaatttgccttcacggtgtgtggagctggtcaactatgaagcagtgtctcaggcatattatactttaacacctttattgaggtacttacataccataaaattcactcaggttaccaccatccaatattgaagcattttcatcacccaaaaagatccctccggcccatttacaggcactccctgttttcctctccaccctagccaaccagtaatctactttctacctccgtagatttgcattttctagacatttcatatatacagaatcatacaatatgcaatcattgtgtctggcttctttcacttagcataacattttgaggttcatgcatgctgcagcctgattcagtacttccttcatttttattgcctaatagtattctattgtatgaaaacactacactttgtttacctatccatcagttgatagacatttgggtggtttccatttttgggccactgtgaatgatgctcctcatgaacactcctgtacaagtttctgtgtggacctatgttttcatttctcttgggtacatacgcagaagtggacttgctaggtcgtgtagtaagtttaactttttcagaaatagccaaactgtttttcaaagtggctgagttatttcatagacccaccggcaatgtatgagagttccagtttctgcatattcttaggtatatttttaaattcagatttacatgtattgtggaggaagcatcccctggataaaggtttgactttatcaagtctgtgaagtgcagagttcacatgatctcacaacttatgcacattccaagtttcacttaaatgtacttaaaaaattttgagagctgtccatttgaaaacatggttgaaataattcagtataaaaatgcgatactaaacaaccaagtaaatataatgatcatagaaattttaaccagaatatttgtcaaaggggagttattaaggaaccatgcaactcaaataaaaatgttccttgcaaactaaacaaaatctccacagggacaaaatcctgattgtgaatcctgcaaaccagcagcaacttatagaaggcagcagccacacggaggaaacaggaaagaaggacaggggattatttttttaaatctgatgcaacttgcattgtatcaagtgatgagatacaagagaccttgcttccagaaaagaaaagaaacagacctggcctcaaagggacagagaacttaatagtcacaggaatgtccctgctgctttgaatacccccaggtactctttgcaaacatacacactaattaaagggggttgggggactgaactggcaagagctttggttcagagatcacagagggacacccagccttcaaaccccttcaacagactctttcaatctagaaagcaaaccctgtatctggggctcggatctctgtatctctctaagatttattttaagtatcatacatatttcactgaatgtctacgatttcctctcttcatagagaggcttcctcctgaagaaggaccctttttgtttccagtgatgaggacctataataattatccactggcactttttctggtgcaatcagtgaaatggaggtttaggtacccagctggtcaggttccagcagatttcccatgctaattttcagtcactcaaagaaaacaaaggaaaaactaagattggtttaccatgattttaaagaaatactgttcctcttccctttccccctcccccaaaatgtgtaaacttctatatttcacacttttacatctgttcttctcccaaaataaaagctgtttatattcaagaaatgatggctacaataccagcacaagttacatctttaaaatactcccagagagaatatacatattgttcagacaacagagtgtctgtgcaatgttctttccctgaatagcatctgggtattggctctagaaagcactacagcgctttatttgtttatttgtttgcatggaaagaaaactgagtactctctaactggtgctggagctaccaatttaaagaagacagaagaagcagaggccttttaggaagagcaaatgcttagttttgactctgtcaaccattccagagtaagacaccagcaacagaaccacctggttccactgctacccagagtatccatgctctgaaagtcttggagctcaattgaaaaatcgcagcactcccaaactcaaagggccctttcaaccacgccaattgcaacatatattatctcaagcgttggaggaatcagataaacaggctgtgaaaaagccatttcaaatttgtagctttcttagacagagtctatgatttcaccaccactagaaaggaaactgctccaaacttagttccagacggaagttttcaaatgatgtcattcattgtcccatctagagcagttagtattcccgatttaaaggcttgaacagggcccagcacactggctcctacctgtaatcccagcacttttgggaggctgagcccaagagtttgagaccacgctgggcaacatagggagaccccccatctctacaaaaaaaaaaaatttcaaaaaattagctgggtgtggtagcacacacctgtagtcccagctcaagaggctgaagtgggaggatcacttgtacccagaagtttgaggctacagtgagccatgattgagccactgcactccagcctgggcaacagagcaagaccctgcctcaaaaaataaaataaaaataaaatgcttgaacaattccctgatactttaatgatattaacacctcttctgagaaaactggagctatccctctaagtgtcaatactgggaaaaacctaataatctttaaccaggtattttttatatctagtctgatgatgattgtctaaccatcggtttttccttcaaaatagttcttctatgaggggaggtcttcaaatttacatttttaaaagcattttccccagcaatgagtataaaattttcatgcacgctcactatcagttgtatataaagttgctttaacaaccatacttgccatcaacttttcctccatataaacagacatgcaatataagcaatgtgcttatctaagaactgtggattaaatagcaacatgggacacttttgtggctaggtaagagatgcttacaagttgttgttacaaagaaagtctgtgggatttcccagtaaggaaatcttcaacctgctgtctagattccaaatatacattccatttcccaggtctcaaaaaataaataactcgaagattttaggcttctaacagaagtagggctgaaagaatttgtgaatatggattctttctttcagtttccaagcaaatgtcagcacctcctggggcttcaaactcaatccctacaggcctatagggaaaaacaggaaatcgacatcagaaggatgcatcttgttgatcaagggagtggggcttttctgcaccttgaataaacttgctaaaaaaaaaaaaaaaaagaaaaagacatgtcaatgcaaagaacaatgcaaagtacagaattatcaattgaaagttgtagacttttcaatttcaagtatctttgagtcttacaaacaattcaaatgcaaatattagtaaaaaaattttaacttccatactcctaagaatgtgtactgtccacaatttctctgaggtcatatgccttatgaaaaagttgcacttaccataaataatttactatttcctattctgcaacattttcaggcatacccaaatttccatgaatatattttgcttttcttttttattttattttattttattgagatatggtctcgccatgttgcccaggctgatttcacactcctgggctcaagtgaagcttccaccttggcctcccaaagtgctgggattacaggcatgagccaccatgcccagccaaggaaactatcttttaaacatttaggccagtggttctcagactcccacatgcttctgaattactaggagggcttcttaacgcaaaagttgctggtccccatcctaagagtttctgattcaatagttgagcgagcccaggcatggtggctcacgcctgtaatcctagcactttgagaggctgaggcaggcagatcccttgagcttaggaatccgagatcacgtaggaaagcccttctctataaaaaatacaaaaatcagtcaggtatggtggcacatgcctgtagtacttgctaccccaggagctgagatgagagaatcacctgagaaccggaggtcgaagctgcagtgagctgagatcgcaccactggactccagcctgggtgacagagtgagaccctgtctccaaaaaaaaaaaaaaaaagttgagagaggcagggcctaacagaggatcctgaagctgctggtccaaggatcccactttgagaactgctgacttagggagttaaactgtcaactagcttttagaaaatcacaacatgcaggataacatttactgagaatctaccaactgcagaactctctactacctactgagtaagccgcacaggtccttgctccaaacaccatctaaattggcaacacagggtatacgtgcgaggggacaatacacagacacatatccaaaacagcaagaagtagttaatacagtcaaactaaagatgtttcatttctccagtgcatttctttatgatgtatcctacggtgcagttaaatctattactctcagatggacattactaaaccacaatgcgtagccattcttccttgcactatgccacttcatttcacttactaatggcagtttcatctgaagccagggcatgaaatgtagagagggacctcattttaaagcttatttatgttattcgtgttgtagcaactgtaaggatcagtgtgatgatcaacactcagatttcagtgataagttatcaagcagagtcatcgagtgcagatatgatctaattctgccatcaggctgaactgaaatgcacaaaaacagtccaacagaatctgaactctaactttcccatcattgtataggtttttaaagcatagctagcaccaactttcaaatgcatacttttctcatgaccctgtcctgagtttaagtgcatttgtatccagattataatcagagagggtatttaattagataatgtttgcaagtactttgaagatataaagtgctctataaatgctaaatattattattattgtttaaatacagtttgcaattactgcttacaacctgttccacccaccacactgctatcatttgattacaggcagctttaaaaaaaatacctagaggtagaaatgatgaaaccatattcatgtgaagccctggatttttaccctagacataaataatttataggcattttaaatggaggattaggttataaactgtagtaaatcaagaaaattgccctctgcaagaccaactaccataaagttgtgtcaattttaatagtttcttacttataaaccaggttgaaagtagattatagtccagaatacggagctttttactctggtggtttcctgttctatcttctattttctccattagaatcttaaaatatctacctatgtgaaaaactgaaagcacaacttaagattttgattttagcaattgtctggcagattaaggcttgagaatagtctctattctatcatggccgtagctcaccttgctatcttctatgatcatcacagagtcagctgtctccaattcttaaaaaactgaaacctttgagcctgattccacacatcctccaaacacacttgctggataattttccagaaagaatgacagtttaaatgtaaacaagccaagctcagtggctcacgccggtaatcccagcactttgggaagctgaggcgggcggatcacctgaggtcaggggtttgagaccagcctggccaacacagttaaaccttatctctactaaaaatacaaaaattagttgggcgtggtggcgagcgcctgtaatcccagctactcaggaggctgaggcgggagaatcgcctgaacccaggaggcagaggttgcagtgagcagagatcgccccactgcactccagcctgggtaacagagctagactccatctcaaacaaacaaataaataaataaataaacaaacaaacatcccctagatacactccacaagaatgtcactgttaatccccaaatagctaccatattaggtttttaaggttttaggcaagaaaaaaaaaaaaacacgttataatctgacattggtcatcttacaaaacaaagttacaaggaagaaataccttggaaatagctcttaaaacaccactatgctcatgaaagacaacttgtgccctaaaccaaaggcttctgggaagtctgtgagcctcagggtgataatacaacagataattctgatgtcatgacaaggtccataaatcaaatgatggctatgtgagtcactattggcagtggctttgggccagtcagtcgtaagctcagccacttagtagctctacgatctttggtaaactaattgatttttcagagtcttatgtgttcatttataaatgctacacacctacagcacaagaaattggaagccaatctggcaatatctagagccttagagatcattcatacactttcattctaaattcaatttctaaggagttatcctaaggaaacagagatgcacacaaagacttatatataaggatgtttattgaagcactatttatcagttggaaagttagaaataacctcaagcttcatcaacaggaactggttaaatatattatgatccatctccacaacaaaatgctaagcagtctaaaaacatgattagaaagttgagcactgactgaatattttattacacgttaaattttttaggcatgataatactattatggttatgtattttttaagtacacaaactactgaaatatttataaatgaaataatatgctactttaaaataatatgggggagaaggtgggtaggagtacagatgaaacaggattcattatgggggataattgttcagtagagagattattaacccttttatctactttttaataagagttttattgagctttaattcacattccataagacttactcttttgaagtgtacaagtgacttttagtatgtttcacagagttgtacaaacatctgcactatctaatttgggacgttagcagtcactccctgccagcaagcattagtctaccttctatctctatggatttgcttattccagacattttatataaatggaatcatacaaccatgtgtcttctcgtgtttggcttttttcacatagcataatgttcatccatgttgcagtgtgtatcagcacttccttttattgtagaataaatattccattgtaaggatatactatgctacattttgtttattcattcattggttgatggacacttgggttgtctcctatttgaggttactataaatattcatgtacacttttttttttttttttttgcatgaatacgtccttagttctcttgggcatatacttaggagtgaaattcctgggtcacatggtaactctgtatttagcattttgagaaactgtcaaactgttttccaaaatggctgtaccattttacattcctatcagtaatataggagcattccaatattctgtctacttattattattatactttgagttccgggatacatgtacagaacgtgcaggtttgttacataggtatacatgtgccatggtggtttgctgcacccatcaacccatcatatacattaggtatttctcctaatgctatccctcccctagccccccatttactgacaagccccggtgtgtgttattcccctccctgtgtacatatgttctcattgttcaactcccacttatgagtaagaacatacagtgtttggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacaccgtcttccacaatggttgaactaatttacactcccaacagtgtaaaagcgttcctatttctccatgtcctccccagcatctgttgtttcctgtaatctgtctaccttttaagtttaaattccccatgaaaaagagttttaaaagttatgccatagaaaaagattaatagcatgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttattttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtaacctttattttcaacatctgaagcattgctacttatctatattgattaacttagctgagttctcctctaccatctaattagatttggtttcttcacagtggagcacaggctatcttcagtgtgttccgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctacctacaaaagaggtaaattggatcaccaatcaccaagccctaggcagacagatagataagtagatatatagacaaagatatgcaaacacaatccccctttacttttcattttagccttaacatggttttatggctttatcctatttatgccttttatcagaaggtgccacaacttactttttggaggtatgaggtgtaataaataaataagatcccttttaaatgaatgaattaattgcattcacacaattgatatttattcaatcaacatttatcatgtgccagacacagttcaaagcaccaggaatgtggtgctgaacatgcaggcaagatccctattctcacaaaacttattaggctccagttgggacagccagatttttaaaaaattcagatagtcacgactgccttaaagataataaagcactgaattggacagtttcagggtggaagggagtgttactttacagatatattgcaaagaaagcctctctgtttagtagggagcctctaagagggccctcagtgacttctgccttctggtgttagttaatattcttgtgtagtccccttcgaaatgaatagggctgacttgggtagccaacagggtattgcagaaatgatggtgtgtgatttccaaggctaggtcataaaagacatagtggcttctgctctgctttcttgattcctctatctggtaaaagtgggcacgatgttatgaggatgctcaagcaaccaatggagccacctacgtggggaggaactgaggcctcctgccaacatccagcaccacataagtaaatcatcttggaaagagatcctccagctccagtcaagccttcagaagatagctcaccttgccaaaatcttcctgcaacctcaggagatacctcatgctaaaaccacccaggtaagccacttctgaattcctggcccacagaaactgtgagatataataaatggttattgttgtttaggccactaagcttgagggtagtctgctatgcagatacataagtaataatacaggcagcatctcaccttagacctaaataataagatggagccctccatgtgaaatttctgacacggagaactacaagaatgagcttggcatattcacaaaacagaaaaaaatcagtgtggctagagtgtagtaaaagacaagtgcaggctctcttctccatccaaccatgggtgtagaaaccatgccaatgttgtcttcagctcagccccagcaactagtagcacccaataatcaggtactgaatgaatatatacacaaacaaataaatgaatgaatgctggataccatgtgcatttcttcccctacagttaatcacatttcacagaatcacagaatactgggcctgaatttaccctgcacccaaacttgcaccttctaatacactaatcaaacaaatgtttgtaacatatgcaatgtattgttaaagtctacaaatttcctacttgatgcatactgccaaggttctaatttcactaactagagagacagcactttaaaatctagggttacttcagagtctaaatccgggtatccagcagcaacactgtaagggagtacccagcggaagtcacagtcagcccttcgtcctatcactcggtcttcaaaaactagaacaacactttaaattataaatcagaatctgacagctggaaaaaaatagctcatttaaaaattagaaagggatgttacgttcagtggcaattcccagctcattgaggtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccactcatcttacatgtgacaaaactgaagcttagagggcaaggtgtcagagccagctttatgacgctgggctctaactcccagctgtgtgcctcattaaacctcaccatctcccaaactctctctacccgctcactgccagctctgtcaagataaaaactcaacgttgtcttccagtgggccaccccagaagcacaccctttcccgcccatctattactgtttaatcaaaacagcagtcataagtattatccgattgttgaaataattgaaacacactccaaacacacacacacacacacacacacacacacacacacacacacatacgccttgcaattctaacccatggtattttaaatctctcaaaacttagaataagacaatggagagaacactttccttggcagaaaaattctagaaataggaatacctacccaggaccaggcatagtatttctcgtaattggtgcccccggaattgtactctatgtaattagcatccactggaattgtactctacataaaaagtgtccccaggagtcatgcaacctagactataatgtaattcatgatccctgaaattgtgccatggtcagcaacaggccccacctttctgaggtttctatactctctctacatagcaccacctccagcccttctaaaagggttgcacagtatatattttgttaattcaaaatttatttgttgaacgaacgcctgctgtgtaaagaaaactggtgaggatccctaagaaaatcaaacgttgcctctaaaaaggaattgtctagtagtgaatataatccaagacagaaagttctgagtgttatgaaagaggtgtgaggtcagttctgagacagtctatgagtgggagggacaacttgagagaaatcagagacttctgtggaaaaggtggtctgcgaatgttcagcgttggggcagtaggtacagaaaggagactaagacagagcgccccctacagagcatccatgggggaatgaaattgttccctgccgcaatgggggagtggtcgtcaaaactgcagagctcggtgggaggcccctctgaattgccgctggtcttaacatgctaaagagtttagttttcagtctgtagactaaggagacagagaaggccttgaataaaaacaaccagattgaaactgtgcgtttggaagactcacgtggctacagtgtacgagaaaccagtcagaagaaggctggtggtagagacacaggaggaggggaggtcctgttgcgggtgttgcccaggggacagtaactacagcacttgcagggaacagtggagacaaggggacccatatgataaacattaagggaagaattttaagttggggtgatataaaatgtgttttgagaaactgagggcacccccatgagacaaccaggacatgtaaaaaagagtggatagaatcatgtttctctaaagggaaataagcttccaaccagactggaaggaatcacaagcggaattcatccaacattttctacttaagtcctccctctctctccactagagaccttatatttatatgtgcagaataacatttcattcaaaaaatatcattaagattttcttagaattctcagcacactgctaacaaaccagtttaggccctgttctcagagagctacttcccccacagaaatgtaagaatcaatttgacattaaagcatctttcagactcaagttactccagattctatcaggaagggaatcagagactggttgtgctcagctgggcatggcggccatgattcaatcacaggagcgcctggctgggtggactttagaaccactatcactgagagaaggaatggcgtcgaaacaagaagggcacggaagattaattccagggcagagacacagaaagaagaaaggccgaacgggcaagactcgaaattataagatatcaaagagttttacagataagggggaaaaaaggaatatttcctgaaagaaatgtactgggtactctctcatcaacaaaatattacatgacctcctaagtagataattatgcaaacagcaaaccatgacttacactggcttttgtactaaagattactccagttaataatgaataatgaaaatgattatgcatatttctctgatgttctgataaataccagcacaccctactttttatgaggcaatgccattgtaaagaaaacacctgtttagtatctctgaaaaataaaaagaatatctaatgaaaaaattgccatgctgttatcattttgagatactgttatcaactcatgcaactttactaaaatctcattttagaccaaatttaattaagtgctctggagtaatgaactaataatgtttcgagatttctttgagccccatgagacctctcaccagaaagttttaaatactgggccattagtgtatcattttatgtgtccactctatctcccaagggaaaagataaaactttaggaaggcacagtcatgatcaatgtgtttgtatttgaataatcggtaatacataaagagagaaaactttttttaaaaaagaaggttttaatgaacaatgctgatagttgatactagtttagaaatatgttaatctccaaaaaacttcagggctgcacttacctcatatgtaatgaatgcttaatactgggggcgcaaagctcaattcaggccatcaaagaaacatacaaggtcacattggtacacaaaaggaaaaaggcagctaaggtctgtggaggtactgttaaaaagagtcggaaccttctgatatctttttctgaagattattttccttcttttcttagtcttcttttttttttcttaaacaagatgtcactctgtcactgaggctggagtgccgtgacacaatcacagcctcgacttctcaggctcaaactatcttcccacctcagtctcccaattagctgggaccacaggcacacaccaccacactgactttttttttttttttttagagatggagtctccctacattgcccatgatgatctgaaactcctggtttcaagcagtcctcccacttcggcctcccgaagtgctgggattacaggtgtgagccactgtgcccaggaaagataattttctattagataaaatcattgcaatcaaatgttgatggtatcaattttcccactaaattctacttaaccatgggatagcatatttgtacagtgctgtatggtttttaaagcattgccttaaatactttattgattttgaaaccagtatgtgagaaaggcaaacagttgtgatgattcttattaactatggttaaatgtcctacccaaagtcacagagtgaataagaggtggacatagaactggggagacagggttcattccactccattcattcaagcattcattcacgtactcattcatccaactaatggagactatggctccaaagatgaacaagatctagcctctgccctcaagaagtccacggtttagtaaagaagcagaaaggaaatcacacaccaagtaaaacatgagcatgaaaagtgtagcaaagggatgtatgcaaggctttcagatgaggtcaattcttaaatctgggtttcaatggagaaaggaatggctagggaatgagggctaaggggaaagacaagtgtagatcatctaattttgttcaaatacaaaagtgtatgtgagtcctggcagaagctgagagtatgaggtcagcagcagccaactcctggccttgaatgccttaccctgtgggccaagttaaggacagccaaggtgcttaggtccagaaatatgctaatctccaaaaagctttctgggctgagctcgcctcatatgtaataaagcacactggtggcaactttcatctcttttaatactgagatgtcttgaagcaagaatgactcaagccccaggtttgaatgagtaaattgtttgctgtagcctatgtatgtatacacacattttcatacacccacgtggatacggtttatatccataatactacacataatatatgtatccacatagataatacaaaacatacacacaactctataaacctcacatgcagagccatctgaataacatgtatgtttatactgaccccttgagacatgctctgatggacacaggttactcagagaggttacctgtgcaggacaaccatgtgtcctaggtgatttcagacagtcgtttgcctgcagagtaggcattgaaccagggctggacaagatgaattccaaaggtggcctagagctccatggtttcatgtatcacaagcttacttgcatgaagtagtttcgccattctcaataaataaaattccctgaccctggtgaaattattcctttctgctattcttttgtactcaggcagaaaatgtattattgatttctgattccaccacagaaagtgtgacttagagaaaagagcactgaatgaggagtcaggaaatctagattatttcctcaaaccacgctcctcgctgtcccctccccttgttactgtgtgaccttgaacaacttacttcacgcctctgggcttcagtttcccaagtgttcaatgaaaggagtggctgagtgttctacaattctctttccagctctgaatctataaaacaattccagcccatccctcaagatttagtttatctctgagctctaaaaatcagggctaaaactggattcaaagtacctattttctaaccaaagaagatcctgcttcactcacttttaaaccatgcaaatcttgcataatttaaatgatcagtgctgtcattggttgctctggtttaaattatgcattgttgctatttggggaaaatttagactgggtccggtctggaatcactggctgagaacaataagcccccaaagtgagaaggataaaggcctctctagacaggatctgcttttaatgctttgagcccagggtttacaaaaagagcattgactgtgtacattaaagagccaccgaaacagcgagggactggtaagtctgcagcaaattctcccagaagccactgaccttggctgcatttcaggggtcaggcattccccaggaggggctcagcaggcagactttaccaagggcttaggaacaaatgagacatctcatctagatgaggccacctctccaaatgtggcaaggtggagatgatctgccctctgatttgtggagattacctatgtggcctttggacccactccagcagacacacctcacccacaagactggtcaaagaccctggccctccaggatataactgtctccacatctgcatctaagtcttctagccagcagttcctggtccccaagctagctgttgccctctctgtttccacacctcccagcaggcagaaaaacagaagcagagccctaagctgatagcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatgaatgagctttggctgcccaactatcagaacagcccatttcaaacggcatctctgtttcttctcaactccttacttgccttgctgaaacctcatctcttagcccaacagattaagacgaagagagaaagacttattcaaagagatgtggaggaaaaggtttaattaaggagaccaaagagaaagtaccactttgatcacaaaggtagcactttaatatatcagtgcagatagcggcaatgtcagaagtactaggaatccaggtaaatggccccaagattcagcatcaatctaacaatgtattcctcaggagggcgtgtgaacttccatgcttcatccatcctggtgtctccctgtagagagccaccatgaattccttctcatccaccctccatacatcaagtatatgcactcgctttctttttaattttatttttggttcgggagaggaagaagcagtccttaaattggtgtccaatccttctcagacacccgctgctgccaccatccccacccctcacccccttccaggcaggcagcatctaattaaaatggcaagaaagctctgcccccttccccaaaggagtgtgttgggatcgggagttgggggtggggaagcgtcgaagcagcacttggattcctggtattctgatctcaaaacaacagcaaaatggattctatatcagtgatgtcttagtcaatacaatgaaacggcgtctgaggtaattcacgtgaaggtaaacgcaaaccagtggggctggggggagggaggtgctctacaaaggactggccacagacacggggaaaacacacacagacacacacacacacacactcgcacacactccagggagttccggtctgattgaggaaaagcagaaaacacatccctttcacctgcttaagttcagccataaaactgaaacgttacagccacaaagtcagaaagaacaggcagggctgagttaaagccataaataaaggtgagtggcagactggcatttaagggagcgctgagagggcgcccgggcgcgggaggtagaaaagggggagggggaggcagttgccatctacaagaccagcatagcaataactgcccccttggagcggcaggttcggcttcgcggggacagccagcctcacaatgtcatcttgcaggtagctggaaaacgtgaggggccagtgcctttattcacgctggcattctttttgcagaagggacagtcgggtctcgcgccttggcaccagacaactgcccggggcgtgtacacacacacacacacacacacacacacgcacacacgcctttcattttaatgctcttacaccggtataagatgaaactggcataagctctacgagccctcgggagagcctaagccacggccagaggaagacacgtaccgcacagcccctgccgtaggggctcagccaggagcacctcagcaaccccgaatcaaaacgggaatccaggttccctccccgacgcattctcccgctgctgtccccctgccccagccccagcccccagtccacgcaccgagcccattcaccctaacccaaaccactggaaagaaaccagaaaacgtcctgctcaccctcagagccgagagatctatttcatccaggcttcgagccggggagtcgctcgccatgtctacttcttcgctggagaaatggaccaaaaccaccccgaagcttttcccttggaaattccaccttggtctatttcactcgcgtcctcatgcgggtgtcgcgccagaggccccgggcccagcctcccccgcccaccccagccccacagcgccggatcccgatcctccgcgcgtcggtccgccgggtccgggagcccagcctgcgcggatctccaagccccgagcagcggtgcgtgtgggctgagcgccccgatcggctaagggcgctggggctgcgtgggtgtatttaaatgggacatgcttctttgcttgtgcgtggatggcggctgcattggctgttataat

SEQ ID NO: 960 - DNA, 397906 bp, Homo sapiens; identical to SEQ ID NO: 959

SEQ ID NO: 961 - DNA, 397906 bp, Homo sapiens; identical to SEQ ID NO: 959

SEQ ID NO: 962 - DNA, 397906 bp, Homo sapiens; identical to SEQ ID NO: 959

SEQ ID NO: 963 - DNA, 397906 bp, Homo sapiens; identical to SEQ ID NO: 959

SEQ ID NO: 964 - DNA, 397906 bp, Homo sapiens; identical to SEQ ID NO: 959

SEQ ID NO: 965 - DNA, 397906 bp, Homo sapiens; identical to SEQ ID NO: 959

SEQ ID NO: 966 - DNA, 397906 bp, Homo sapiens; identical to SEQ ID NO: 959

SEQ ID NO: 967 - DNA, 113475 bp, Homo sapiens
tgatcaaataagcattttaatatgactttactggctgcacagtaggaatgtaggggctgcaaggataacatcaagggacagtcctgcaggcgttcatatgagagatgtgcaatgcctgtgctaggacagtggtggcagagacagaaaacagaagagagaaatcaggaaccatttaggaaataggatcagctgggcttggtgatgaaattcaggagatgatgtcatgggtgactcctagttggttcttggagttgtgataatgcccttcactcactggttcatttgctgaaaaaaaaaaaaaaagaaaagaaaaatgacaaaaccctagctcaggcaccaaacacatagagcacactctcttctctttgacagccaagctagttctaagtagcatctagatgcctggtatacaagtcctaagtgcctgcagagctggccctcagctgagaagtgcctatcacacacacacacacacacacacacacacaagtaaagagaagccaacaggctacattagattcaggataaatgagctagcccaaatgacttcttctatttcaactccactatcattgcatttaactggtcacacctacaaagcaatcagcaaactgggtgactcattaggattttcttttcaagagagcaaagaacctaaataaagatccttgaatttagcgtacaatacccaggagtcatcggagcagcagcaatttgggggaacttcaagtgtggtatttcggtttgagtggggaagttagaaatcagaactgatctcacaaacaaaaagcttttataatagcctgtcctagataagagagtaatgagaggacaaaaggggaaagccatccccctcttaataccaaggaaacctagggaagtgacttcttaaaaaggaggtaaaagcagcagttttagtcactcatcaagagtgactgttcttcctctttgctagaaatagctaagagagtgtaaatcactcactaggctctaagaaaagaagacttacaaatgagcttgaaaccaaatagtgctgtgtagattcttctaccatcttctaaagaatctgcatggacttacttattcactgttaaggttgtctgtgcatggtagccacagtgctaggatgatatctatagtttgtttttgacaacaagtaaatccattataaacccaatttcttctcttgagcacaagtttaaaaggaaaaaaagaaaagcttttctactttaacatgcctcatgcctgtgcttccaaaccagagcacaagtactccctggggcactcagctctatgccaagtattacagcagcaggaaaccatagattttgtttaagtcaacctttctatagtaatttcattaacataattttaaactgacgcaacaatgattatcatgtggcataaagagaatccatctaaattttaaggatataacagaagattccaaatacatttcatttttgtggtttccacaccaccaccgagtgaagcctttagatctcttgaagaggatggggtggttacaggccaacgaacgtatccattagatgcagacagcacaggacctagagcctacagtactttttgcagtcaacaaaaaattattcttattttaaaattagaagataaaaactaattcttaggccaaagaaaatgttttaacatataatatttgtcttacaccaatgaggttataaagcctaatttttaactttttgttgttttatttttcttggagaaaggggcccacggaggcaaaaatggggagggcctacaacagtcatactacagcaccgggtagtgctttcatttgtgtttgagtccctctcctctgctatgctggtaagcctcaaacacaaatgaaagtgttatttcttaaagtatagtggtccaaataccaacatgatttagtgagacaagggcaaatattttaatttaaaaagtatgtactatatttttaaatatagctgaaaatattgagtttctcatttacggtagcaacgaattttctttttgaaaaatttaagtaaataaaatactttaatgaaaaatattaagcaaaaagactgcaagttctaggatgaacttggaaaaaaaaaaagaggttggtattgctgaatggctgaaaactagtgatatcctagaatcctagaaatactaggattcagactctcagctataacacccaaaaaagtttccatatagatcatcaactaccttcatctctcaagaaaaacagtaaaacatgaccagaacttccaccaccaatctactgggaaaattagaaattttggatagtggtctgagtgcttatttatattttaaatcacatatcatatttttcagaattagtggttcacactggcaagagagcaagaaatatttgttggttggtacaaagcacctccttttactagcccatgaaacaatcctacaataactcttgtattgtacaaagagaggcagatgattgataaagattcccacaagaataagacattcacagaaaaatgagatcagccactgcagtcctaccagctgggataattttacaagggtcagacagctccagggcataaactaatcacttcagggtgaggaagaagctgactcctgattcccaagaggcagtgtcacacaattagattgtttattctagctcaacacaaatttgacacatttccccaaaactgcctgtctagggtcctgtcaaaacaggatgatggaaagtcagaataatgttttagcccagtatttccaacattcctgtaatccattccatttcagtcatgttttgatgtaaaggatattttccccactaatatttgaaagctatccattcttgcgtattctagttacaccgagcatacattcattgtggaataagcagcagccaatggtatccaggatcttctaaaagtagtattcgagggctttttttgtatgtcttaaaattgttaaatctgagtgaatgaacttatctactcccaaagcaagatcttaagttgtttttagtggccaatgaaatctttcccagggagctagaagatgggctacccaaaggaaaatattctatatatttttcaatgaacatatagaagaattacagaacaaacaagacataaaatacaacattatagcaaatgtttttgaggagggtgaatgagattcttaattagttcttttgcctctgccaatattgtctataccattgtccttacacaatatttacacaaaatattgcagctaataagcagaatcaaaatttgaactcagatctgcttagatccaaacctatggtcttaacctctgtatttgttccagaacagttcctggaacaaagctggtagccaagaacaaacctggtagccaatccgtatttgttgaatctgaatctagattaggaaccaggctgtttgatccaggattctgaggtgtttctagagctctttacaactaatctcaacacccagaatgaaaaagctctctatgacatttgaagatattagatgactacatctgataatgccacattcaaatattttctgttaattcttctccctgttgaaatccaattagcatgaggaaaattaactactgcaattaagaggaagaggaagtgaaagatttccatataacaagtttaaagctctgttgctaaaaaaaaaaaaaaaaaaaaaaatgcccaaagaaactcaatcctgtaactgaatttcagataacagagtatactgcatacataaaaactaacttttttgagtactcactgtatacctaaaattcttctaaatgccatttcatgtattatctcatttaatccttatgagctaggtactattattcctaaatttcagaagagaaaaccaaagcacaaagaggttaagcaatgaagcctaggtctaccaataagtggtagagccaagattctggtcccaagggatacaaccccaaactttatgcttttaacctgctgcttcccataataataacacttgctggacactttaatctgtctcatatattcttttttcttaacctccacttcctgggttcaagctattcgcgtgcctcagcctcccaagtagctgggactacaggcacgtgcctctacacctggctaatttttgtatttttagtagagatgacgtttcactatgttgctcaggctggtctcgaactcctgagctcaggcaattcacccacctcggcctcccaaagcgctaggattacaggcctgagccaccatggctgggctgccctatgtattcttcatgcaaactatgttatttactttccccaacaaccatagagaaaatatatatatatatgtatatatgtgtgtgtgtgtgtgtatgaatgcatgcagatataggaggtgtgtatatgtgtgtctgagtgactattctctatcctatcactgtaaaaacacttgacagatctctcaaccattgaaagaaggtcatcttagatcttctatataattaatcaaaagaactattcatacaaaaattgcattatgtgtcatcttcatttttcattaggtattttgattggatgttgtttttgagaggaaaagaattcatttattctcatgttcttgttctttttctcattttaatatgaaataacagcaccagagaaagttccaaaatatcttgaaggacagagtttcagggctatcattgcatttgtaagagttgggaggaaaatttccaattcatagtagtagccaaatgttgcaaatcttcatgtaccctccacctaagtattacagactctgcatcatgtaacctggttactgccagaattgagatctcccttctcctcttcacttatccaaatgtgtgattcatctctgtgggatatgacaaaccaaccacactgggcaaaaaggccctgcctgagccctctcagttcccaggagaaccattcaacacaaaagttaaatggtgcatttcaggcaccctgcccatcctgaaccctggatttatgccaaggaaaggcattccactaatcaagctatctctagtcctcaggaccaaggagatggcctaatctcatgcttcccaaagttaaatgggcatataaatcacctgggagtctcgttaaaaagcagattctgcttcagtgggtttggaaaggcctgagattctgcatttccaacaatctcccaggaggtgctgatcatgctgctggacagcaggccacacctggagtatcaagggtctagttcatacacaaatgcaaaattgggcttcaaagagaagtgtttgattttttgaaaggttcatcctgggttctcatccagggtgatccataaaattttccatatcttcatgtggcattaaaaactccagacaatcctcagaaaaatctattcaccttttaagcctttggattccacaaggctaccacaccccaagtatggagggagaccattattccatacataactttaaaggcatcccctttgtgacttagccacatgttcttttgtgttatttatccaaagaataagcaactgataatttcagattttccaaaatggcgaatgtttgacataaatgtgtttaatactctgcaaagcctctccaactcagtgtatttgggatgcaagggttggtatcactatgtaaataaggaactactttacagtacagtttaatgaaccaagtacatgcaggaaccctatttaagtgaaagtattaattccttggaggaaatgctttaatactgaagaatgacttgtgattagcatatcaacaagaataaacagtcttaagatacccaagggtacttaaggacagaagctttcaacaaacttcttaaactcctgtttatactcttaaattgcttggtaaacgcctccttctaaggtactttaaaaggtcaagttttgcccaagtctcctctctgaaaactaatgaggctttaatgtattcagaaatgcaaaagtaacatcaaagttatttgattgacccaagccaaagaaccttctagaatagcaacatattttggctgggtttctaccttaaagtcacctctcctcctaaataggataatttaaaaaacatttatttcaacatattggcagaattactaggtcatttgtgagcagaataattcttttctacctttttagaatggtcagatatgagaaacaaagcatgtaaacaacactaaaggtggctgctctactttacaaggatcctaagaactagaaatagtagtcttcagttaaaccagaaaattttaaattaaaggttagatgactgaactcttgcactgagcagtcgaccccaccatgctttcattatgccaatgaattatatctgtttcaatcactggtgtcaaaaggttgtgggttcaactccaggttgtgccacttactgtcagtgtgacctagggtaagttaaattttgcaaggtttagacttttcatctgtaaagcagggatactaagcagtaagtgcttactttatgatgttgcggaagcctgctaccgagcctttcctataatgggcatagttactctatacatatactatacatacgggattacatactattgctacttttactgtgcacagaacaaggtcggtccttgagcttttaaagagacacattaacaagtaaagacaagaactgccaaccaaagcacatactaaatctatgaaacacctgactacaagagatgactcaggattaaaaaaaataaagagatggctcttaaactatcaagagttctgaactcatcttaacctctgaggttcaagtctaggaagacagcaatattcttctgcaatgtgaccttccacatgggtgttttgcctacaaatcaaagtttttattttggatgcccagccttcatccaagctgagttaaaaagttaacttattttttcttctcttagtaatagtaggcagtaatgattgtggtcctggtacttcttcagagttaatatctatgatttcttaaaatgtttattctggagaattttttgtagatatcctctaccctccaaatgcccccaaaaggtgtatgttagtataaagtgccattattctagcaaaatcagcccttaagaccacattcatgtcttagggtgacactgcgctaccaagaaaaaaaaattttcttgaactgataacaatttagaaactcactcccagtaaagcatagaactcagcacaaacaccaaattcattatatatatgtaatatatatgtagatttacacacctttgtatagctatccttgttttaaaaaactaattttcagcattaggcactttcactgcttctgctctaacccaaattgctgattgtaaaaaggggattttctcccctgtatttactttggaaacagacaccagccacggagaagtagttgagtgcaactgcccacagactcacactgaaattagagcacctgagctggtccactacctgagccgtgttcctcaaggaaatttcaaaagaaaacctccaggacctcggagggccaaaagggcagcttgtagcaggactcggctgacacaagactaaagcctaggagttctctgtgtccttacccttgggcttcctgagaaacaagatcctgagtcagacactgaaatcttatgattatgagcaaatgggcctcataatcccaattaatctccagagttgattgttagaaatgcaaagatactccctagagactgttgcacagactaaggagtttcttcaacactgagaatgtagattaagactgctgagggagaaataatttaagtagtgattgggctgtgaaagaaaacattgtcaatacctatcttacttttagctattcacaaatatatagatttcagagagaggtaacaccatgatgcatagtacttaggccaaatttcaaagagcacatctgaccatagtattactcatcaacttaatcaggtagccataaatctcctatgcttctagactagaaaacaatactcaaagagcgttctgttttcaatgttgctattctgttttgggttctgttagcagacttttttttgtttttgtcttttctgtcttgtattttcccccatcccctgtgaacactggattcttggtcacatcttaatttatgactatttactcagctgattaaccgtaggcattcgtcttattcaagcaaatcttgttctgagcaacagataaactggaaccccaaggacagagcagccatggctccgtattaatcatctgctcatcccatttccccatcctacagcagaccatgaaagctggggttgcctcagagggcttggcttcaggcacctcctccctgaagcactctcagaggggcatattcatatggagcaggagggaggctttggtgattggcttctgtgataggtttcttgagggaatggaaaggttttgaagttctgaagtatttgaagtgtctcttcataagttcacaagtgggtacaaaatggtagaacaaaatgtactaaacatttaggccacaaaacattcattttctccagctgaaatcaccagaagtgttagctggggagaaatcagaatctgcctaatttgcaactcttttgaagagaatataaaatcagctttgcctccacccaaagaagaggacacactgtcctgttttcactaactttcactattttgacaaagagaaagaatgagataactctggctaaaacttgtcatgaaagtatctgatagaggcatctctagcattcctgggttactgatgttatataactaaaacctgtaaggaaaaaagtgaataatgtgatccttaatggaaacggaaatagagagtcacaggtattcctaacttgcagtcatgcaaattatccaagagattacatctcggtattgtagccaggtcatcctcctctacaatacccagaaattctttctttccatcctctatttcattgtctctccccaccctcaaccccaaacacacaaacctaggcatccctgtaaaggaggaaatataaaagcaaagagtaagcaacttgctacaatgccacaccaggtaacaggtaactggccttccccctgcttggaatagaggaaaagtacaaattatacacctggcaaatatttgcgtggtctccagagcagtaagattcatccatttgctcacaaaatcacacaactgaagctgagcgaataaatcaattcaattcatttcaacaaacatttatcaagctccagtctgaatatagagtttttctggggggaaaaaaaaatcataatgcacctggctattggagctgattttttaagaagtctagaaatttcttcctcctttctgagaaacgaggcaaccaactcccttaaataatcaacacagatgtattttatattgtaaaatgtaagtagcccaaggtatgccgcttccttttttgtaggtggaaaagaatccacttcttatctttctgggaaaacacaattgtgtttgttgtacaaaaacacagtgtccccatttactaagaaatcaatgagtaatcaccaagccatgaatcaccttttagtatttttgctataaagatgagaagcactatatattgaaacaggctatggcatcgctgctctatagtataaattcagacttatcaagaatctacttaaaatattctaaacatgcaatggaagggcagggcaaaaccaatctttgccaaacatttaaggagatgttatacacaaatttcctcctgggaaacttctgagtggaggtaagataatttaggcgactcgatcaggagtcatgctctactacttacctgggggcttcaagggaagacatttataaactctcagacctaaatttctctcctttaagacaaggttaatcatacctcttctatctaacttatggggttactgtgaaggtcaaatgaaataatgaatatgaaggtttcaaaaccattgttttatgttttatgattgatatcagtgatgtcaacgtttaactctacagtcccaaagacatggtagaagatggaaaacaacctccaaaaacccatctctgatatcaaaagtgtgcaatgggctatttaaaagttcagatgagctgtggttctttgtgcttagccacaaaaacagccttagaatcataaagccagttttaaaaagaagggaaaacaatttttttctttgtcctattctcttctgtcatattagatggtaggcggacactgtttttacttatcaggtatcaaactgctgttggctactaaatattatattttgtgtcagtctccttaatttatatactcaaacagttgagatgaagcaaacctaaacatatctcactgagttagggcattccaaactcagcagaatttttttttttttttgagatggagtctccctttgtggcccaggctggagtgtgcagtggcatgatctcagctcattgcaacctccatctcccaggttcaagtgattcttctgcctcagcctcccgagtagctgggattacaggcccagaccaccacactcagctagtttttgtatttttagcagagacggggttttgccattttggccaggctggtctcaaactcctgacctcaggtgatccatctgcctcagcctctgtacttttttttttttttttttggtacatatttataactacctactctgtattggtactagagaaacagtaaggtaatgtccctgactcagtttggaataggagacagccagacagaggattacaaacaggtcagagtacggagagaagaggcagggaaaaccatcaaaccccattgggcaggtgctgcctgaaccaagtgttaaggatatagtatggttgctagccaacagggggtgaggaagggcacagcacggataaacagacaccgtgtgcagtgtgcacgaatgccccgcaatgtgctaccatagatggacacagtgggaatcaggatgggccgtagatgaggctggagggggaggcagaggtcatgtcataggaacctgtgactggggatgtagaactgtgctccctggagctccaagtgtggggctactctgtggagggaggtagaggtgcatcggggagtgttgtgtcggcaaagggacggctccatgaggtagatcctaactatcctcccagaacatcctgctattgtgtcaaatactggagtttcctgtgggggaaaaatgttttgctgctttaaaaaatagttgatacatttaaggtaaagagaaatctcatttgtaaaattgtaataaaaataaccacagcccagacattttaatatagaaaatgtattagtctgtttttgcactgctaataaagacatacctgagactgagtaatttataaaggaaagaggtttaattgactcacagttccacatggccggggaagcctcacagtcatggccggaagtgaatgaggagcgaagtcacatcttacatggtgcagacaagaatgcttgtgtagggcaactcccctttataaaaccatcaggtctcttgagagttattcactacacgagaacagtatgagggaaactgcccccaggattcaatcatctacacctggccccacccttgaccggggattattacaattcaaggtgagatttgggtagggagacagccaaaccatatcagaaaacatacacaatattcttttaggattcatacaaaatgcttgcgtattttttgtggacttctacctgagaaggatcgttttatttagatataaacagggtagaaaaatcaagggcttcagctggtttcagcttcctagaacaagatgcagccctgcagttgtggggcggtcagtcacctgcagataataaagtgggctgttggtgaggtaccttggaggaacgccaacgtaaggacagacagacatgcagacccatttcaagcttgttgcagatccagtgttgcaggacatgacccaggaaaccaccacctctataattaagttttaagtttactaacagtatttttttaaacagagatcagggcatggggtggagtgagggatagtagggtatggggagttaatatttaactggttcagggtttcagttgaggatgatgaaaaagttctggagatgggtagtggtgaaggttgcacaacaatgtgaatgtacttaatgctgctgaattgtatgctcacttaaaatggctaagggggtaattactgtatgtacgttctacgataagagaaagaggtaccactaaaaagatttccagtaagataaattcagctaggagcctcataccacctccctgaatgtgatgcacagatcaaaactgaatttctcaagccatactcgaagtatcaactcgaagatgttaaacagtaacgggcaagttttctaaaacaagaagtcaccttctccttaaaggagactgagttcttcacatatggagttcctaactcttccctgctgtccacaaagatgatatggttattattatcatgattgttgtaacagacattttgtaatttatctagaaaaattgtgtaaccagctgctacacttgtctgcctttgttgtagagaggaacaaaatggacacagtagttctgtgcttctccttgcaaagtgagcaacaggaccaagatccgaagcaatatcagaggccactgcacccagcagcagaggttgtaatgaccccattctagaccctcaccaccaacaacgctcctatgtagtagtaagcatatatttgcttgccgaacagcagatatttctttttgcatatgcaaaatatccaagcagatttaatgaaattatacttaaggttaaactacagagataagaaatacaatctcaataccacagttaattggttattctttttattaaagagtctcaaatgtttcccatgtacaaaatagttaaaaaccgtgaagagccctaaattctgtgcctgtaatcctggcggggtttcattttacaggttacaaataacccagaatagtaactattgatggtttaattacttgaaagtgccttataatcacgaagtcattaagggtgttatgagatctaaaaactacaagtcatgagggggttgtgcatcaagttatttggcaactcattgatacaatatgaggtggaatgaaagtattttggactaaagcattctaaatacttcaaatcaaaattgagcacacgagtgccaatccatgtccatccctaacagaaaatctcatcctcttttcatcactattagaaattttgtatcatcattcactgaggcagtgagaacctgctaaaaccttgcggctctgaattaatgagagaatggtataaaatgtgcatgtgtctacatccttcaacacatcaactacaccaagcaatgccaccaggccacatgggtaccttaataatgttaggcattccgtataaatcattttgctaatggtttagagtattgctgtaacagttttgcagttggaaaagcacaggctgtaagtggattcatggaagcaacttgtggaggttatccagactagtgctctacttagaattaaaggatgtcatatctagaaggaactctggagaccctctagccagacctcttcgttatacatgaaaccaaggcccagaaaagctaaatgacttgcttaagctcacacagctaatgagtctcaaggccaagactcaaggccagaagagccatctgtccatgtctgtcttaaaggcttcccagccctacttcacctcaggttattgaccctggcccaggccatcaaaagcagtcaagcctttggtaacactacctctccctagagtacctacttaattccccttccacatacatctattcatcttttaagactccactcaagagtcacctttatatgaaggctttcctggtcttcccacagcccccacagatttggctctgctctgtatactcttgctgtggtgcatggaatacaacattgaagtgatctattttcatgtctctccacccagagacttcaaacccttggagggcaaggaccatgccacatgtttatctataaaccatgccctgatggcaatgccaggcagttgttagatacttatgaaggctgacactgaataaataaacaaaggtaaacaaaaccccaagatagagctaaaaggggtagactcatctccaaagacaaagatacccaaaagagcacttacactacagacagcctcagcccagcagctctctatcctggctgtgcattgcaagcatctgggaaggtctggaataaaaccttccccagcccaacatcagacaaaccaaaatcaaatttttaaagaaaggcccaattatctatagttttgcaaaattatccagatgatttctataaaaagtgaaggctgcgaaccactagtagcaataagaaatcccacacagtccctgtatcaagttttggtagcaactctacaggttcaactacctagtagagcaatcgacccacccatatggcatctagcacacaggcacccacgaaggtcttccctccatgttcacatgacaaccatctaattcattatactcaacagatcatagcacaaggtggcatggtcttcagacaaattagatgcaaacaacttggggatctatgaggatgaaaaattcatcaagccaacatatttcaaaggtgaatgattctcctacttattggagaatggaagtaaaattgttacctttaattctagcaaaactacactttaagaacagataataaagcctgaggatgaagaagagaaataacaacataggaataaacttccccagaccccaagataacaggaatctgccacctcctattgtaataaatgacaatagcagtaatcaaaccttacatgtacataggaatttatatttaacaaaatactttcatagtcattaattgatttcaacctcacgatagcttcatgggttatatcatgaaaactgtttctttatattctaattttacagatgagaacaactgaagttccaaatagatctatggcaagctcaaagctaaggcaagttaagggtagaaccaaaaccatacaacgggtcctcaatatctaaatgaggttcttgctgctccacaccccttcactaatctcacaataaagactctctcctgagaccttatgctacctgaagaagaaatactgttgcttctcctccaaaacttgtgaaatataaaattattcagaaaccattttcaccccaccaaagttccacagtgctgcaactgattcctgtttcctctattaacctatcttctctttacacattattgagacattggcttttttaagcactaaagaccaaatataatatccaagtggcaattatatcaccaaatacaatgtaagaattgtattaggttggcacaaaagttactgctgtttttgccattaaaagtaatactggtattaggttggtgcaaaagtattgtcgtttttgccattacttttaatggcaaaaaccacaattatttttgcaccatcctaatatttaatacaaataatgccattctaagcatacataaaaaccaataaatcaaatgtagaatgtggagcacaaagacatgtgtttctaacttcattcctctatgaatgtttcttttaggtcataaaatgttctatgaaagcaagaccatgggaagaactggcacatgtgtttgggaagaggaaaaggttattgagtgcctactatgtgtcaggcactgagctgaatgcttccacatattaatgttttatacttgagttttcattaacagctctaatctgtactattaataaaagataaagaaatccaggctcacagggtaagttgattatcttcacatgactggaacagagcaaaaccagactaggaatccagctcaggcagtcctgctccaaagtccttttcattatactctttccacttataaaaatgctcaattacactcccagatacagtggaaatgccaaagcctctaagctttttccaaacccacatcttgtgcccattcaggtccccactctgcctggacagcattaattcctaaatagtctacactctcaccatccccacttgcacctcaatgttaagagttttgccattctgtgtgatttttagagcagtggttttacccccacagaagacacaggaaaaactggagacattttcagctgtcacaacttaggggtgctgctgctttgtagttggatgaggccagggaggctgctatatatcttgcaatgcacagtacagcccccacaacaaagaattatccagccccatatctcaggagtgctgaggctgagaaaccctgccttacagtgataatgtgatttaataaatgttcttcctccccagtaaaatgagaccataaccaccatgaggaataactgagacaatatacataaaaacctctggtgcacagtgaacactcagtcctaattagataatctgattacgcacttcttaagagtaggaacctcctcagttagctctgcattattcccatacaaagcacagggcttttttcatgggcactcaacaaatgtgaaagaatgtattctttatgttagaaattcttgattaaaaaacaaacgccactattatctataaaacacaccattctcccatactcactccttgccaaacaataagtgaatagtataatacatgattcattgcagcaggctatgaaaagctacagtgcatccaggataatgttatagaatcacctccataaataaactattaataaacttgctattgaaatgttttatcttattttaacagaaggttaatgaagagatcgtgatatacagatttgagaaaatctccacccaacaggccaagattttgctatataaggtcagttttgacaatattgattctcaggtcttgagttaaattattcagctttaaactgtaatcataagcatatcaaataaaaacactgaaagtcaaatctttgaataagccaaaacaggcgggtatcacatctcagggcaagatctttgatttttgcttttctcagtttatgtaagtttgagtcagcatggaaatcctaaaataaatgattacaaaaagtataggattagcattcactcaagtgacctataacaggataacatacaatcatttttgcagtttctggaggtgcggtcccaggaccttgaacaacagaatgagcatttatacttattaaatgttcaaagaggataccccagacccactgaatcaaaatttcagaagttggagccgggaaatctacattttaaatcctttcccaaatattcattttacatactaaagtttgaggacctctgccaggagaccagaccccagaaaattgctttgcctcattttgtaaatttctagcatagtcttgcttctgcagactactggtaattcattaaacataagatccacatccccatcccattataaaaaaaaaaaaataggtagaggattttgtttattgcttttgtgcaaatatatttttctaaagtacaaagattaacattttatgaaaatgctaaaaaaaatttaaaactgggaacaaatatagaaagaattatcaaggaaaacatagctcaattctgggccccagaagtgtcaacatttactgtgtgccagactagggatagtgatggcctagacagactaggtctctgacttaattttcccttgacttatgtatttaaattgctaaatacagacataaacaaggaagtaagataattcagagagtggcaataccataaaaacaataaagcaggttaatgtaataaagaaagtctatggcagagggaagcagaggcagtggctagctgtaatagacacagggatgaaaagtggcttccttgagaaggtaacatttgagctgagacctgaaggagaaggagccagccatgagagggctgggggaaagtgttctaagtagagggaactatgactttaaagaccctgaagtgagaacaaggtgctcattctaatatagaaattaaataatatattcaaaaggttttatggaatataaaactatttacaagcataaaacacgacttttagtgacagaatagttcgtggggataatgaagggcctcagctctatgccataagaatgaatcaagcaactgaggctacattgcctggacaacaggagatgtaagtatatgtttggaggaagaacggagaaattttcttcaaatatcaaaaggactacacaaaaggactacattcttttttttttttttttttttttttttttttttttttttgagacagagtttcgctctacttgcccaagctggagtgcaatggtgcgatctcagctcaccagaacctctgcctccctcgttcaagtgattttcctgcgtcagccttctgagtagctgggattacaggcatgtgccaccacgcccagctaattttgtatttttagtagagacagggtttctccacgttggtcaggctggtcttgaacccctgacctcaggtgatctgcccacctcagcctcccaaagtgctgggattacaggcgtgagccaccgcgcccggcccaaaagttctacattcttgtgaaagaatatttaattttaaattttaaatagctctagaggtatgaaatggggttgaaatggtaaacattttaagaaggcaggatctcagcacaatgtgataacattcaaaggaactgcaggaaaatggactgacagaaaagtaatgagttccacatgactggaggtcatgaaggatgggctgaacagccagctggcagagaactcagaatgaggactatgaagactcttatagcatgctggaaatatacacactcacagcatctgtctctcttaagcacaatagccaccacgacggcctccctactttgcactttacaaccttaagaagtattgaaaagaaatatgagaaatactgaggaatccttcatattcctaattcacattatcaccctgggataaaatatgtcttcatttccgtaataaccaatctatattcaaaagggcaaattaggagacaggaaaaaccaacatttatttaaaacctgtggctaatttgtagtggtatcttaccagtaaacattaaacaattatttcaatttattaaaagaattactctattttaacaaaaatgtgtccagattccattaggttcccaatagatggcatgccaataaacagccaagacctttagtaaatgggtatgtggccttttgttggtttattttttaatgcagccatgaacagaaggagatggtttcctcattaaaagtcctgagagtgaatcactattctttattatttacctatgctcctcggtaaataaagcaaaaaacagacattgaatcactacttgattagatgggactaaaatgctaaagataaacaaatctaaccttgcccaaaacaggaataagctaaaattgggagtaagactagaagcaactttgaaaaactaaacattattaaatggcttttatataaaatatttatatttctatatctagatgtacctgactcacatgcagatatatttcaaggtgttctctgaatacctacatatactttttatttattatattaagtatgtttctttaaaactacctgtaaacaaaattatattatgactctcttagggcagcttataaaaaagaaacttataataaatttttccataaaataagggctatgtccatatacttattcataaaattatacctgactttatgaaaaccaggaatgccaaaagagagactttaaaaattaaaatcaaaggcttagcatttgatatggtttggctgtgtccccaaccaaatttcgtcttgaattgtagttcccgtaatccccatgtgtcatgggagagaccaggtggagataattgaatcatggaggcggtttcacccatcctgttctcatgatagtgagttagttctcatgagatctgatggttttataagaggcttccccctttactgggcactgattctctctcctgccaccctgtgaagaggtggcttctgccatgatcgtaaatttcctgaggcctcctcagccaggcagaactgtgagtcagttaaacctctttcctttataaattgcccagtctcaagtatttcttcatagcagcgggagaacagactaatacagtatttaacagaaagaaaatacttatcatatgattttatgtataaggacctcctcctagagctataacatttctatttatacctacagtattttagaaacatacatattccataaaagttgcataatctatagtgcaatcactttttaatgtaatttacttaggctcacatatcttttagctcgtattttgctattttattaaactttaatcttttagaactcagaatgacagcaggactggattagtggcctcaggaaacacagggtctgctcatgagcagtgccacctaacatcgtctggttgcctagaaaccaaacccttaaataggtaggtagggagttataattctttaagtaaatcaacacaaggccccatagcatttttttggggggggggggaggggacagagtcccactctctcgcccagactggagtgcagtggcaagatatcggctcaccacaacctctgcctcccaggcttaagagattctcctgcctcagcctctcgagtagctgagattacaggtgcatgccactaccacctggctaatttttgtatttttagtagagacagggttgcatcatgttggcctggttggtcttgaaatctgagctcaaatgatccatctgccttggcctcccaaagtgctgggattacaggcgtgagccaccgcacctggccaggccccaaagcatctctaactacattctcatttgactaatacacagaaaagctgtggtggctacaaaacaatggggctggtaaaagagagcaaatctcctgtcccaaagttcactgcattcaccatgaccattctttgcagaatctcccttaaacttggaaggtgccatagtactgtatcaaccaccaagagaatggaatcctttagaataataatgttgacaacctagctgctaaatatcttccctctctaaaaagatctgagacctcttgccatttgtttccttgcctttttcaaataacaagaaattatggataattctggattttccaaatattctcatccttaattgaatctcttggtatctcctcttataagactgcagagtttcacctcttgaattagtgtaccaagctgtgaaatgtctcccaaatgtatattctatgggtgggaaacataatgaaacggaaaggctctaagaaatggcaccataaaaccaacagcatgctacagagttgctccttcatattgacagcaaatcagaagtaattttgtacctaagtcagagcttaattcattagttacttcacaagttcaatccagtttctcaaaatgcagtaacacaatcttccaacctaattatcttcattgaaagtatttaaaagcctttgctgagacacatttctttctgtgtcagacaggatcaacgtcaagtgagcaggttgggtagactacattctgtctaatggtaaaaggtgtacaatttaggaaataatcgtttcttgcaagggagaattttcccctggacaccaaaggaaacctctcgtaaataaacatataaatgtgtatccacttagaatctcgagaataccctataaataatacttttgacattctgcagaattgaaaatattacaacctgaatgatttctataataaatttaattaactgagagaagtttagggctcaggaggaatttttaaaaatagaacacgagataatttgtaatggaaatgccatcccatatcgctgccactagggaaaatgatggatatttccctagaaattatcatgaggaaacagttggtttgttttgatggcatttcaatagctcattcaatgaaaccccaaaagtttcagtccaaaaacagttcactttcattttttttgtttttttttttgacaatcagaaaaggaatcaactcacattttcaaccagccatttttcgtagattatacttggggaaaataccttttaaaaacactttttgagtgaatttgtaagcagaaattagtacacaggcaagcaagacttcttattccacagctcagtctcaactcaagtttaacttttaattatttcctaaaattcgtcgctgctattaagcttttgctttgtgaggtaacccagttttcttccaacactgttcactccactcatttaattcatgtcctaggccaataacacatctacttttccagctgtaatagtttaatagcttaaatttctgaagtagatggcattcttttctctttcaaaaaccagttctggcagtgattaagtaaaggaaactgaacgcttgaagagcttcaaatatgtgccatcagaattcatgtgtcacatacaaacacagtaatatataatgaagggaaatacccaaatcacagaatccagtttaagcaacataaccacagatatattttaaaagatggagagtcaatcaacaagtatattaattcattttaaatttgttaggagccatttatgagccagtatagacagcactgcaatttgtcattcatgaactgaaaccgtacataagccactctcagactcaatgtacttaccttataaacttgcccgtatgttccatttccaacaagttccaccaattcaaagatccctgcggggtcctgaaagaaaataaacaaacaataaaaattcaaaacaatattccaggcattgccttaatcaaaagcaaatacttatttaaattaagcaaataaataacaactttagcttcaggggctctcatgtgttaacatttaatactatcaaaattttaaaatttaagtcagctgcagctatgaaattagccaagttctattttctttccattttacatttctatgaaatgtgtttaaatcaggcaaaaggagatgctttttcaagtgaaataataaaaaagaagtaacacatttctcactgttaaatggaaaaacacacttgcaggagctacagcaagataaagtgaaagactcatcatcctgagaaggttctaatgttccagggtatttctctttgaaatatccgagctgttcattgtgttgagtgagccctggtagctaagaagggtgttcgtgcattgtggggcaatcttacctatggtagtcaacagtttccaagggaaaatagagtcaacttaactacctctctcagaaagtttttctttggattcatctcttctgtaatactgcctctacaaaatatacttttgaggatagcctccagttcctgcagtacctgctgagtaactgcaggatttagaatgcaaactaaattggagaattattcaagttcttaccaccaatcagttgtccactaaccccaggagtcagctaaatgttacagcgttcaataaatatccaaaattactgctattataactgaattactatcccaaaaagttgaaaagaaaaatcaaagccaataaaattctattcagaggcagaaattgactttcaccccttactgattcctaactggacagaaattgcttctttaaaggcataaatctaggagtcacaaacttaaatgtctacagaggccaggccagtaacataaacaagtaaagtggtccagttggggcctgtggcaaactgggcaacccgagcctccttgagggaggtagggtatggtatggtagggtggggtggggtggagtttacttagctggagccacttgttgtcttgtcaacatatgagcacaatattgccaggtctaaagatttttcaagagaaactgaacattgtatttaatgtgagatctcctattttttaagttttaggcacttaatttaaaaaacattcttaggaacaaataaaaatagactgcgcctttggcctgtctctactggacacttacataagagcaatgccatatattattacaatgggtggctaagaggcagggagggaacagcctgaacttcagattcagagagacctgggttaaataccagctgtgccttgaccagctgtgtgatcctaggagaccccgagaaagcaacatattgtctgggtctgcagggatgacatctacctagccatgctcttgtgaagaataagtgtgggctttgcacaatgcctttcaagtagtcggaaatctattaacacctaatagtaatcacttttaagctgagaaattccacaccaccagcaggatttaaatgggggaaggggaaaatgagtttatctgctattctggggaaagggaaaaatgagtttgatctgacaagtcaggatgctttaaagtccaatctgtggtaaatcaaactcaagaaaagcccctgcgtaggtgccttcaaagattccacacagagaacaaataaaaacaaaaacaaaaagcaaacaaagcacccaacagattaagcacttagtcactgagaaagattggagttagcactacattacctgctcttacaaagccagaagggcaagaaaccacactccatgctcatgtcctgaaaaatccagaagtccagaagttccagttatgccccacctggtctgggaggtgtggttccagacagaaccacaaaaccggaaaacactcttaagggacttagagctctgagtcgaccaacaccccatagttagaagacaccatcaaggccacctgggaggcctcaggatcgggaagaaaaattttgttggttaaactactaggccattagagcagcaggttttattacaaatggaattagaaagaaatgaggaaaagaaaaaaaaagcccataaatggtggcagctgctgtttgtttctaagctgtgcttcccagtagtttgtttgcttggtggtgtttctgcaacatatttggagagaagtcctacatttgcttgaaatagctcaattgtgttttcaacattcatttttcttaactaaaaaaaaaataacagaaagagaagagatacaggacagtgatgagtggctgcctcaaggaacctgggaatcaaacagggatgtgagatgagggcaggagcacaaacaggtgcagagcaggaatcagcttctacatccaaaggtcactcgcctcagggtcccctctcagagctggggttagtaggtaggtctcaggaagatctggacagctgacttgtgaggctcttttctctccttgaataatctattcttgggtatatgtcccaaccaatcaaaaccaaggaggcttaatgctgagcctttagttcaaactgctaggagaaggtttttgctggacacatccaagggcctcagaagtaaagttcagaggaactaaagagttctactggcaactggccttgcataggcaaccaaactggaaagaatcatcatatcagatgggttccccaggaataaaacctgagactccctgagatttatactgtgtgagtttattggggtatgcctcagaatcaacacctgccggggagtaaaggaagaactggactgagccaaaggaagagctgaactgaaatgtagtggtaacaaaaacttcatctgatccatggaagtgctggagctaggacagccctggagaattatcctacctggaagcatcaggactttgcatcccatctccattgactagtcactgcatgtgggatgccccccaatacccgtcccagaggtaacaatcttaggtgaactgacactgttcagctgaggacatttttcagatgaacgtcatccctagctacctacactcccagaaggtggacaactgagtgcctcagcagtggagaactgagctctgtgtgacataccacaacatacactacaagcaccatggctagaaataagaaccagtctggaatcaaaagagaagtctataagcatctacagtctacagtatcctgagagtaacaaagcaaaatagcatgagtcatggtatttgcaaggagggggctctttgaaaccctagatatggaagtcagaggtattattcagtgacacctcagtactgaccctaggctctcttctctctttcccccaatccaagcgcctggagagctgaatgtttgtgaatagtctttcacacaaatgcatttcatcattagttacatccttgtagaattgtgatacagcttgaacagtataagcatttagctgttttctccattctagagtacctctaaagtaatttccccaaaaggtcaccatgaacctcaatttcttacacatagtggttgcttctcagtcctgtcctagttgtcccttttgaggcatttatactcctgagcatcactactcctgttgaaaatatatccctccaccatcttctatcatacctcttagtctctctcacagattctataatatttcttctgctcacaccttctaggtaccttcccctaagtttccacccttgtccaccactcccctaattttgttcactaagtgtcaatgatcttatctccaaatgtccaccatatccatctactccactccattcacacaacaggcttcatcatctttttctgggaccatttgcttttagttaattctttcttccttctaagctattctccatactgatctttctaaaacagacatttctaatcatgacactccatgatttaaaataatacaagatacggttcaaactgaaagtcaaggtcatgtcattcttaggcctggcctcgattcccagccttgtgttccatcattctgtactataaccaacacatgtccctcatgtccctaacataccacactcagctcttggttcatactgcccatctgccaagattattccttctgctttctttatgaggcaagcccatccttgaaagcccagcttgctgcctcctttctgaagcccttcttaaatcagcgtcactgcctctctctctctgcagccgcaatatgttgtgcacagctctatgataaccattttcacatagtgctagcctctcttacatttctctcccttgatgaattacaaatgcctcaagagcaagcactgtaacatatttatcttggtatttccagcacttagcatgctgtccaatacataactgctagatataactatttactgaataaggttgatgtcccactcccaattcttcaagacatgtatagtgcaaatcacaaaaaatgggatcagaatgtagagccaaaggtctagcaaacttacatcatttcttttaaatctagacaagttgttttaccactgtgccctctatcctccttaccccaatcccaaatggacaaaactgtcacatgtaaaagcccctgtagtattcccagcttaaaaaaataaaatccatagagcctgttgtagtaaactgtgcctcacgtgcattgagaagacaggctgtcagaatgtggccaacagaatgtgcagcaaggagaggaagctgtacctaataatcatgttacaaagacaggaaagctaagagataagaaatccacttaattctccctcttgtgtttgcttagctgctcttaaagccaggatgagcagcatggaagaaagttacatacaccaaggagaaaagagcaaatcattgacatttaccaaagtcaagaatccctgttggccacacatgcctttattcagatcttaacctttgctgggagggtgagaagagaatttaattctaaggtagagtagtttacattatttcataatgaaatataactacatatcaaaaggtagactattccttgaaagaaaatgtaatttttcagccagtactgataaaagcaaacttggttagtcatgacaataaaaattacagtaatagtgaacatttcatgaggacttatgtgtcagaaacgattctaagcatttttcatgaatagctcatttatcacagctttatcaagtggatgctatcattatctttgttttacagattaggaaatggaggcacggagggattaaatgcttagtcagggtcacactactaatgagcggcagagccaggatgttgactcagatggtcagactccaaaccttgagttcctaatcactatatcatagcttcatggaaccataatccccagcccttggtttaccacctggtagctctctaaccttgagccagtttcagaactgcattgaacctcagtttcctcatctttaaaatgtggacaggattacctcccttgggagatacaatgagaactgtgagtgtctagactagcttggggcctgatatgtaataggactttaataaatattcattttcttcctcccttttctttttcatctttgaaaatgagttcatgtaataaacaaagaatatgccacagtaaaattcagtccgcattttatagattttcaactaaaaaagccaataaaactaatctggccagtaaacgaaaacctattgcttttcaaccaataatattacccaccacatgcttagcaaacagagtcaggtatttatggacaaaatgtatgtctctttaaaaattagttagacaattgagaaggcgcattaagttttgggggttccttggatgttgaaataaatactctttctttcagctgatgaaatttagatggcattggcaggctcaagcccagcttcacagcagagaggagagatttaagatctagggtttgatattccctgccactaggttatgctttaattcctccaggtcctctgaatgatactggatttataagaacactaaataacaccactgggctaaatcccaaagattgaaaaaggcaaacttaagtctgtaactaggatgactatttccttcacatcataaaagatgatacatattctttccaatgcctccccacttctttgaaaatgaaattgacacggatcatgagcaaatggcctacacagactctagacacccctcctccaaaacgcctcttaaagacacagccgttctgtgacagaatcttttacttgaggccaccagtcctctggcagggtaaaatacacccaacagaatacggatggctgatagtgctcccagaatgactgctacccccggattccctattgacatctgccaaacgactgtgcttactctaaacttacgggccttaagaagaccaaaatgttatttcttttagaaccatatttagcagctgttttgtttggtttcagccctaactgacaagcatatgcttacaaaagcaaaacagaacaaagaaaacaggaacagtaggagaactctccacatttatcttgaggcttcaggcttttcaacatcatcttcgaaagtacagcattaggaaactgtgctgactcaacaacccccagattctagtttatgctgcactcacagccaggcaagttccctcaaaggtaattttttactttaacttcccctcttctaaagcagtagaggtttgcagagtcaaaggtcttgctttacacagtaagatttatttaatccctgactgctacctggcaccctccctcgccacctactgtgtgttatacactgtccaaggtagaggcagtggggtacatggcccctgcttcatggtgcttccaatctaaggaaggaagcagacatgagcaacttactacacgtacatagtgattagatcatcataacgacaagcagcatatgagaaaaggtgctccaagagtattgatccaggagatctggaatatagcccagaagcatatcttcattaacctgctggcccaaagaagtcatctcaactggaatagataattcaagtaaaaaacataaatatatacagatagatagatagatgatagatagatagatagatagatagatagatagatagatagatagatgagagagatatggctataggtaggtaaaatactgattgttgatttttcttacttgatcatcagtgtaggacaaattaaactatgcaaacctatcacaggactggtccaaaacaattagggttcaagtctggattccactccttactagagttctttcacccctcatattccagttttcttcatctgtaatttgggaaagtgccctttggcctgcatttttacaatgtcgcatcctgcgtatgaatgttctaggtaactccccagctccctgtgtcaagcatcgtcttttgggaagggctgtcctgagtgtaggctgattccaggacacaaactgctccgatagagctgttcctggctagtgttggtatcctcttactaataccagctcctcaatgatcagctggctactggcagaacacagccaaacctccaggaactaaccctcgatactggtagcttccagtttggctttcatctctcagaacagggagactggagcctcctcacctcctgtttggtttgcagtctgcttagtttcacctgctaatgtgcagcagccagcagtgacactgctttagatcaccctccccgctcagctgcttcactcaagaccctgcagctccagcctgtcctcacaaagtcggcctttagaactggatttgaaacatcactcctcggattaatcactgcaaaaccttaagctatacaataagctataataggcattatcgttgtcattgggataggccatagcctaaatgcttttcatacattttcatatttcttccttatgcaacctgagaaataggtattactaaccccaattttcagatgataaaactaaggcgtcaaggaattaagtaacttgcccaagattaaacagtaagtggtagagacagcagccaagaccagactgtaaagtaaaggtaaaaatacctgtcatggaagatggttctgagaatccaaaacaacatatataaagcatttagcacaatgcatggcagtgcttaataaataatggctacagacatactgctcttgctggtggtattaagagaagtttcccaaggtgatgacaacattggttcatagtagagccaggattcaaatccaggtattttgaatccaagtccattattactcatttctctacaaatggccaatgctgaaattaacctggggttacggggatgctgaaggccttgtgggttaacaatagagccagagaatgggcagtgacctcaggacaggaaaccacaatgagccaaatggctgggagcatagaagttttctataccatggttgcttggtgtccctgcctcttatcagagccagaagccccagagagggagagcaaacaggctctcagatttctatctaaagctagtttctttttttcctactttgccattagctaggatgaatgctaattactttaagctaaccaattaattgacagtgagaggcggtatagcataatagtgaaaaccacagactctacagccaaaagcctgaatcgaatcccagcttcaccattttctagccatatgactttgggcatgttatttaatctttctatgcctgtttcttcaactataaaatactgataatggtagtacccactttgctggattacttgatataataattaatatatataaaatgtgtaaagcaacatctagcatattgtaagtgcttaaaaagtgttcgctaaaaattctttactcaagaaagaataatttctttactccaagaatgaataactcttattggttttgtccactgcagtatctccaatacctcgatcatgactgggacatcagagatattcaataaatattatctggatggagcaagtcctcacatcaccacttcttccaccgacagccacaatgcggtaaggtctgtgacatttgcagcgaggatttctgagatcatatcaataaaatatctctacccattttacagaagagcaaagagaggcccagacaggctctatatacttatgcagttatagatttctccagcaagatagtttaggtgatttatctgaggtcttatcctagttagtggcagagttaaatgaagacctatgtcttttgacttctagtttttccttctgtttgatttcaccctttagtaaaccgatggaatcacccattgcctttcaaaaagtggacctggaaaggaaggaaacagggacagtaggtaggatgggcaggccctgctgttcttttgcaaaatctaggtagttgggttaagaaatcgatttcattcatttccagaaatgatgtaagaagatttagtgcacatggccagtttgacagtccatttagtaggtcacatgcatatatatcagcataaaagataaataatattttcaaaatatatttttctcggttcacagacttagcatattcatactcacagttagctcagttcaaaattatttccttacagatgaaaacaaataattctacataaattgattattgtctactagcttacattgcataaataagtatatacaactaagaatataaaactaaaaagagaacaatccaaggacttcttgtaacactgacttgaatattttttctgattttggtgcatagcacagctattttaatcctttgtcagctgctgggattcactggccagcccttctcatgcttcttgacctgaaattcccaagtcacgactacaaacctgcttgtgcacacaaggaatgcacaagccccaactgtgtgttcagagactgttttctaacacattcagagtcagagaaaggcacaccaactccataaggcaagttaagaaaactcttcagggtactaagccacaagacagatattggagaaggatagctctctccatcacctcctgtaatttttctcagctcttctaaaaaagtcttttaagaagcatacatgcaggccggacacagtggctcacgcctgtaatcccagcactttgggaggctgaggcgggcagatcacgaggtcaggagttcgagaccagcctgaccaacatggtgaaaccccatttctactaaaaatacaaaaattagctgggcgtggtggtacacgcctataatcccagctactcaggaggctgaggcaggagcatcgcttgaaccagggaggtggaggttgcagtgagctgagatcacgccactgcactccagcctgagcgacaaaagcgaaacttggtcaaaacacacacacacacacgcgcacacacacacacacacacacacacacacgcaagttgctttaaaggtcaatatgcacatgaccacccccaaccccagcccctgctcaacctggtcccttccctcccatcatcaggttgttgcagagattatacagctgtttgggaaaatgtatcatacagtttacaaagatttgcaaacatgggatccttccagacctgtcaggacagggtaactttccagtatttccagcaaaacgaggtggaaatgatgggaaccagactagcaaatattttggccttttgcctttttgaagatacttagatgaagaaaaagatagcaactgcaggagatggatttaaagacaagagctggttacctaaataattaagaaagaaagattaggaaacaattcaaggttctgttttggaagaagagccttaacgggaccattcccccagagatactcatttaccacctgcttacaacagaccaatgacacgttatttgcttgaaagaattttcaactgttcttcctacacctataagcaaccatgaagttgattacaggcagaggtgaaacttttaggtaaaagggacctaactctattctaagtctaataggagtatgaggccccctttaccagctgcctacctgtccccacccctcttcacaatacagtgagcttccttctttgccctttgcagagggaacctctgatgagggcaagagttgtgcacactgaaaggggcagggttaatgcctttcggccaagggcccaggacttttctatgagtagggaaatattggctggttgattagatcatctgttactctcccatttccagagaagggtgagatggcccagagccatgtaggaacagccaggagcccaataatagctacctggagcagggacctgtcatctggcagaggtacaaaccaatcttagtccatcacttggtgtcaccagtaatggtacagatggctgaccaataccaactcttataaatctcatacagatgttaataacagggcttcatttgcatctatttttttttcaagcttttatatctatggctaggccaccgtgaaggacatacaaatttatttgcttgcttattagttttgcaaggcagataacattttggaacgggggatttataccatctgttcaaggatctaaaagctttttggcagactcaagaagctaaagccagtccttttgtccctccagatttccatgggtgttgaatttccactgtcaaataagtttgggaacactaggttaaaaagattagcaggttaggggtttctttactgcaaggcctctcaaagcttttaatgtgttaatgtaccctgtgaatctccaagacagggcaaagcttttcatattttcctaacttgtctggccacagaacactccttaaggaagctttgtatctcctctaagcactgatattctgcagagcatagaatggaaaatgacagtgtatagagcaatcttttctgtgtcattcctacttaactaaagcttgcatcttaagttactgtaacagagatggatcaatgccacccaatattcattctccccttgctccttaacaaaaattccaattttatttgggaggaaatgcacccagctcaaaatctacatgcccttgtcccactgaagctaggaatgaatacatgactaaattctggccaatggtatgtaagcagaattactgtgtggggcattcagaagggctgcccaaatggagctgacttagctgggagaagggttcttctgtcttcctccctcctccttcctgctgcctggaatgcagatgtaatggctagaacactacagccatttctgatcctgaggtgaatttaagaatggaagccttatgctaagattgttatagcggaacaataaaatgatcctatggttctgacgatcatggagctaccatgctaccgctaagctgcctatgtctgaacttctttatcttgaaagagaaacaaacttctatcttccttaacccactaatattttgagttttctgtttgaagcagctgaaatctaattgatttactttgaagtttactgttcagatatttttattcatttatgtttaactaacattccttctttaaaggactcttctccattagccttttgctctttggtagaggtggcagtctctaaggttgttgaatacatcttttttttttttttttttttttgagacagtctcgctctgtcagccaggctggagggcagtggcatgatctcagctcactgcaacctccgtctcccgggctcaagcaattcttctgcctcagcctctgaagtagttaagattacaggcgtatgccaccatgctcagctaatttttgtatttttaggagagacagggtttcaccatgttggccaggctggtctcaaactcctgacctcaggtaatcccctcgcctcagcctcccaaagtgctgggattataggcatgagccaccgtgcccggcctgaataaatgttctatttctcctcctgctggcatgttataggatggcacttccctacccctcttgaagctggctggggccacatgatttactttggctaataaagtgtgcatggaagtgatgttccacttccagatggaatatgtgactgacagttcaaatcattgtgatgactgtggaagcatatgtggacatgatgcctccattagtctggtacttggatagctgatgaatggagtcctctactgacccactctaggcatgtggcatggtcgagaaataaactttagttatataaagcctctaagagtgttcattaccatatcctatcctactctactctgactgaaagaatagaaaagaccagaaactgatgataataataatcatattgtataatgctttgtaacttttgaaacaatatttgagaagaactgcttcacactgaatgtctccccatgccccagacattatgcagggtattttgcaaaggttattttatttcatctctgcatcaatcctgtgaagtagattgctcacaagagaaaaaaagcgaggctacaagagcctccaatgccaaaacatacattctcctcactgtctcccatgtgcaatatctgaaggcagctcccagaaacagtaaaatcccttccaaagctggctgatgatacagggggcaaggaaagaccagaatttttacaaggtgcctacgttcacaaggctgactacacctacatggcctaaaccagagcatgctggagcttgtggtctctgcaccccactgagggcaacagaattgcaagtcctcgactgctcttttttgagtgtctttgaactcaaaacctgctttttgagccactgtcaaggtaacctagcagctgagaataactaattgggcaacgttctctgactgctggcatgaacagttataatctcagcatcactgtggcaacctgactggaatgctggttattcacacaaagaaaaactggtctccattcagaccagaattgcattttgtctttgttccacttttcccattacaagttgctactgaaggaacaatgcttcttttaagaagaatgtgtattattggtctgtgcaaaagcagcattttcttagccaaaaaaaaatttggaaagggaggaaaaagtaatatgtcctatattgccaaaggcaaagagactattaagaaagctctatataaacaacagtaaaggtcatcttggggtaattctgtggcgtttcagccaggccacagaattctgtggagatctcaatggtgcaacatgggcaacagatgactaaaaactagattacattcaatcaaccagtgcacatttcctgagcacctacaatgtgctatcacagacactgtcctccaaatctcccagtggttccccggtctactctgctctcccatccaacctcagcctccctttaaagctacagcacacctctccccaggcatcagctacagcctccagctcaccattcccagaagatgttctgtacactcccgcattctgtgtccttgttccctttttgttcttgctatccaaaaagtccttttgtcccatctttgtcagtcaaagccttaccagtcttttgagatcagattcaaatcatagttcctacctaaggtcctcccattacactccattagagtaaattccacattaaagtacattccaaagatcgctttgaatgtatctgtcttactgcacttggaaggcaactctccagggagcaagatcagcatttgaataaggctttaccacttccagttgtgttatctttgaaaaatcacttaatctcttagagccaaagtctcttcacctataaacagcatgctactcagactgcacccatgaccatccaactcatctgggaaccttgttacaaatgcagaaatctgggccctgcccagacctactgcatcaggattaacattttaataagattcccaagttatcccaatgcatattaatggtaccaaagtattgataaaatctacccagcagagatatgatgagaatgaggggaaacatagaaaacatccaacggggagtctaatacataaagactctcactaaatgaggaaatgactacactttatatccaataaatgtttggttaagttgaactgtttggtgttttaaaggattcagatatttatggcatgagctggccctcaagtgacatgtcagattagtaaaaatagattaaaatacatgaaatataaatgaagagaagcaaaagaactgtgttttagaagagcacatgactgaaaatgacttcatcgtttataatttttctgacattgaacaaggccactaatattttttagcctttggtgtcttttcctatcaagtagaaataagaataaaggcagcctgcttgcctctcagagttgaactaaagttattctaaagttaaaatgagctaaagagaatgaaggaattttgccaaatacaaagaaatgattaagtcggtgtttatcaagtaacactaaaatacaacatacccatcacaaactgagctcacactcaaaggtggccaaacatgaagggcacacggaggtcaaaacggtacattaaggccactggtttgaggatggagttttagtggaaagaatgaagagtgagccaaaggggacaagtagctctgccttctcagtgggctgatgactgaggtatctactgctttgaaaatactgggataggagtgggaggggacaccagctgggccctagaagaaaaggaattcacagcaaacctggggccctctcagcctaggggttaagagagaaatcagaagggagtctcacgactgtcagggcagaggcctgagactagacggaggtgtgtggcagccactctgacgaggaacacagaggaaacatttgctggaggaacctccatcatccatttctcaagaaccctgctcaagaaaggagaaaggatggagtttgggatctctgctctaacaagtcagacaagcagaacataacataaatgcaaagagagttcagacaggcaggaaatcgatacaaactgacacagtcaagcggagctgaatggaaaaggtgggcaccaagctagactttaaaatacctgcaggatttgggtacacagacagagatatcagtagaggggataaacttgctttgttaatagtattattttaaaagaacacatgttaattgcatgtatcatttctgtcagaaatgataaaacaatcctatcacttataggacagcatatgcattcagcaaactttaaattatttctagaaatcaggattccgtaagcatttcataaggcaaatggatttcaagtattgaacacacatggctatgacaaaatggcagacatgcatgcgataaagaatataagccagtcatttttttgaacaaaatgctgtttgaggcctcacttctcccaggcaaatgaacaaatacataaatgactctgatgtaataacttgtttacatccgtattccccactcagctatgctcctgctccttccaaagctgaagctgggctccattcatgttaatatctttagctacatgcactgtacctaggctacagggggaccttcataaatgctggttaagtaaataattttaccaagatcaacaacaagaaaatatttataagttgttgtttactttttcttgtgaaataaataaataactcggagagagatgaatacatgtatcttcacatcattaaatataccttcctctgagagtaccagctgggtcccagagaatctgtgaagctgcattcaaccacggcatatctttttggaaagcctattttccataaaaactttggtgttcgtggtgttttttaatatgttaaattaaacatgaataagtttgtatcaagtttaaaaataaaacacaaagatgctaacaaatttctggtttgcagtggaggtttctcagtcagtccaccagaatctctagggtttccagtttcctcttctttacccacagggatgttttgataaagacattcagaagtgtattgctcacctataccatttatagccctaattttcaaacacaataaatgcttcttatttcacctctactcattcagaatttgcaattactgaaattagagctgaacagaagtttaattgtctattgtccatatagaatagatttcaagaaaagtaataacataaaaaaggaaatctcatttttaaaaatcttcagtcaagtatcattcacatccagtcacttgctaattacaattagacatctctatcaaagccagtgttctctgctaaaggtggtgttccaggacctctgttgaaaaactttgccactccagggtttctcagttattgtctaaacctaaaagggaataagattcttcaaaaattattattgtcttacctttcagcaatataaaatgtccctgctcctcccaggtctctggattagggaggtttttctgtgaggcaaataatagagcaattctattccttaaatagagagatggtcacactggtgctaattaaataagctgagcatgtttgctttgtgcacttttcagtacatattttacaatttaaaagtttgaaaaaataatttaatcattaagagggcagcttcaatttagaagaatgaggaaacagacataagcaacccaacaattaaactatcagttccctgttctaggagtggttcaaagttcagaaatgaaggcctacttgagaggcagtagaggtaagtgtcttttattagtgcagaaattctcactcttaattactgaattccactcagtcattaaccatactatagtgcaatgctaactacataatgctagtagatagagtgtctcctacattgagataccagtgtttgccagtgtgtgtaactaaagcaagcctacagccacatctccaaaacctgacatcggctcttacatcttccacattttgtttcaaatctttctagggatagttctttcaaaatccctctcatgtgcccttctcagtcactatactcaaatgcttttatgagataagaaacttaaggagtatgtgtctggggatatttttaggaagagatggattttgtgcagctgattattaagtcaaataatgaattaagaataatgacaacaattgaagtgaaaaatctgcgtcattacagtaatctttctctcttgaacagaactatttggcttaaatcaaagccacctgtaggattatgaatttcaaaccactaggagtgaggcatatgaagtttctaattagcactggccaggaaacattagttctcccctttgcggtatcttacaggtggggatagagtgattgtatgttctcaggagaaatttgcagttaaaatggcctagtggttcagaacttggactccaacagaactgaaataatgactgtactatcagaaaaatataggtgagcaaggagtgtggggggaggggacgggggggagcagatctttccaaagaaagattgctgccagtgaactaattgactatttaatgtgtttattttacttgaccatctccaggagtgatacaaaataattaaacagcctgtatgtattttggtgatttccatatatcctaaagtactcaatacaaagactggcctgggccagagctggcatgactgccctcagcttccagttctagtgccatcttatccctcctaatcaatttcctctgggcagagatgtccaacaaccaccacagaaaggcctggcttagaatcttatttttataaaacataacaacttcccattgacacacattattgaatagagatactcttctgaaaaggttaggggtctctaagaagtaatacaaagaacactttaaaatgtagtaacttacatatttttaaaattaggtataaaaagatgcaaagagcactggtcattgtagaaatcatttcagtttaaaattcaggtcctgccacgcattagctatgtgactgagcaatctatgttactttgttgagtttcctagtgtcttggggatgaactgtgtctcccacaaagggtgacttcttccctactgcttcagcactcacataggcatccttacacacacacactacctttgtgttctacttcaactgctttcagttagtctgttcacaaacaacttccttaaaaactgatttccatcttcaaatcagagtaagcatcgtgtacacaaagcccttcctaaatcccatttcctcctccccagcagagcttagttgcttctcctttgtgttctaacagtatttgactatagcacttgccatgtattgtaactatgtgtttaagtgcctaactccacctctagactgcaagctacttgaagtacatacagtttttgaatgttattggtatctctagttttttaacagtatcaaaactgacagtaagttctcagtgttacacaaaggagttgattaatagcagtgttcatttcttgtatacttactatgtgctaagcacttacatgcattttctgtaatcctgacatgaactctctaaggtggacattagtattttaattttatagaagagaaacctgaggccccaaaacaacaaataagtgattaaagtcaggatttgcccaatctccaatctgttcacaagggatctagcacaaccacctggtacttattaggtcctcaaaaatgccatcttttttcctactgcccagaaaacaatgggaatgtgacttctgcaatggaagtaccagaaactgtgtccgttggtgctggctaacactattacttagaaaattttgatacaaaaagctcatttcaccaagtctgtgtcagcaaccataaacagatttttcaattgcacattaataattcccaaaaatattttccgagtgcctgctctgtgccagttctgtactgtacactaaagatctatgaataaaaagtcaagaccccagtctcaagaagcagacaccacgaggtaccaacatttgtagagcacttgctatggaaactttagagcacctgggaggacataatcttaatggacagatgttacatgcccattaaacccatcattaggggatctatgaatcatttaacggaacatagagtagcctgttctgtgccatgtatgtggccacaggagattcttttaggaagataatgtcctccatttgccaatgtttgtgttaaaattgaagtgcagccagcccacaggggtactcctaccagcatgtacttaggggattgatcagggtttccaatgaaatggcaatatggcagccacatagtgaagcagagagcatcaagacataaaagccgttcattattgaaactttacaacaaattccctgacaacctttccctggagaagccccttgtttctgccaacccattacatctattttgaggctggcaacctgatgtgcctctgcacacaaccccaagaggcacccttcatatacaatacaacatgatgcaaatacatcttgattggttcctctggagctgtgtgacaaggtggtcctgactaccaaagtaattaaggttctcatgcaccttcagttgccaagccattatcaacacatttgattttcagggaacatgtgaggagacctctgagcctttgtggcacgaatttaccaaaggggagcaaagcctagtgagtgaggtgcctctttctgcccaaaagtgcaagtgcatgatcagccatatggaagagatcccgggtaattactctcggtactttcgtttagctattaaaatgccacccaactgtcaaaccttcactcagtgttaattactgccacaccgtgtttgaatgcagcacaagtaggactgaaagtagaaaataaataataactatgcaaggttacagcctctttttgtacctctggttgcagtaaccaccttcgatctctttttaaggcctttcgttctcaccgtcattccctcatggactgagcagttgtttacaaattgcaaatgcctatgaaaagcccctatttcacagggtctcgcacacagccactcaattaatggaactaaatgccttggttaggttcacagaagctgctgaataactgccatgctgcacttggcatttgcctccagaggaagaacatgatgctgggtgatgttggtgatctcacctcttggtacattagctttcagctgaaagttcaaggccatcaagctgcttctctgactggcagagagggtgcatattaacctcacacctatccttcatgagataactgtgctggcttattctgctcttggactggagctatattttatccagcagttcttaacctgtgcccatggatgttgtgaacctgctaaaactagatactatgctttgtgcatgtgtgatttataggaaagggagcccaaacactgatcatctgaaaggactctaatatctagaatcttaggtgacctttcaacggtccttcaacacaagctgggcaagtgtatattcacctccatttcataacagaataaacaaatgctgagctgtgacttgcctgagtgatctgagaataagttgaggcacttttccagtactaattaacatcttcccagaggatgcatctaccatttgtaatatgtgagatgcatttatctcacataaatcaccttcgctgggatgatttgtctttcatctagactgtaagcccaaaagacaaaaactatttttgtctgtcttatcatctccatgtgtgtgtgtaatagaggaacagtgtttgtaccgaaggggatcaatgtttgtcagtctaaaacatgccatgatggcataagaattattttgagctaaaggcaactgacaaacatcagatgtatataaagctgtctactccccttgtatctgcctaaagtcagggcataaattttcctcagtgaagatgttctctctttcctctcccataccaggaagaggaggcaactcttattgctgaagatggcactgacttcaatctgcataaacaaaattgactgtaataaatcttatctttcattagttttccccatatacttatcttcacataaataagtacccctagaagtccaaaacccctttcttttctcttgtcatattgccacaatttattgttctttgttaagatggtatatataagcccccaattctaaccacttccttaagttatatttctttgtgaacttccatgcatatgtatgtaattaaatctgttcttttctcttgttaatctgtcttttttcagttaacttgtaggcccccagtactgaatctaaaatagtggatgaaaaagtcttaccctttcctatagtatataacaataactgtgatcagtgaacagatgcaaaccaaccttcagtttccaaaaatatttatttctgttttctgtcacaagacacctgtaggacaattttttttgatgaccataagatgtaaaggacaatgcttagaaaaacctagacaccaagaaaaacctgctaatgtctgcaagaaaagaacttcataatccagaagttcccaaaactctataattgctgaagaataactagaattttaacaaattgctcaaaatctcctttcaagtcctcacaaaatcagctaattcattaaaaagaaattacattatatgccccattacatttcataggacactggagatggacacaggcactcaggaaatactgggaaatagggacagtgatacaaatgacaataagataaaacaataaggatccagagaatggcatttgaaacttgaaaactgtatattgaaaagggtgattccagaaatttaatctggtcacaatgtctaaactggtggctatgagaaaggggaggagagggatggagtcagcaagaccagataaaggcagaatgacataattaatgtgtagcactttcagcatatgaaaacagcacttccttcatcttcccaaagaccatcagcgttgatcatattttattattaagaaaatacaggctgggcacagtggctcggcctgaagtcccagcactttgggaggccaaagtgggtggatcacttgaggtcaggagttcgtgaccagcctggccaacatggcaaaaccctgactcaactaaaaatacaataatcagcagggtgtggtgggggatgcctgtaatcccagctactcaggaggctgagcaggagaatcacttgaacccagaaggtggaggctgcagtgagccgagatcgtgccattgcactccagcctgggtgacagaacgagattctgtctcaaaaaaaaaaaaaaaaagaaaagaaagaaagaaaatacagttatcatactgtattcagtgtattcaatgcatactttgtctcatcagtgaggaaattttcaactattttctgggcaaaaagagtaataatccttggtagtaataaccatttatctgaaagaaagcacttccacaagctttctgtcacattttaaaataaaaaaaaaatgagccttctccctttacaatgcaggcatttctaggaaccactgtaaaagggcccactttttcagtatgtctaagagcagacagcactttccaccacctgccttgcccactctctcctagctcagtgcactttctcaggttgcacaagtacgaacacatggagaatgcaaagaatctatctaagtttggcagtgcttgctgcattctgcctgtagaagtgcccccaaatggtgcaagctgaagcaaaacagccgcagaagcaaaatacaatctcgcggtcagtgcagacccagctgcccttgtctcttagacattcctggctggaatcccactgagcaaatatagggggaaaacagacaagaaaggccctagattcaggaaatacccagctgctgcaggagagagcagcttacaaacagcaatttccctttaaaagtgcccccaagggcagatctctaaattatccctcgatatttcttttcaatcatgccatgaccctaccactggtttttaaactcctcctcttgaaccatatgatggacctacaagcagccagtaggttctcaaacacagctttcactattaggcctgaaatccaaagggaataacgttaccctctcatagcatagtttcctcattcagccatttctcaaaccttttttctccaaaattcttgctatcaagagtgactgttaataccaacagaaggacaagccttcaaggaacacagtaactgatctctttcgtaattttcatttgtcaaactaagggaagctatacaacttagaaatcaaatgtcatgttcatttatcaggtatttattctattccaaatctacacaggacacggacagaaaagattcatgcattcttttgaccgatatttattaagtacttactgcaattcatcaagtctaaaatacatattttttcacattttgacatttctggaattgggatgcatctgaaaattaagattctggttttcttcttttagtatataaaataatatagcatcttacaatcaattgcacatgccatggacgaaatgcttaaaacttctcaaatgagtacagccatcttttcccttgaacttgtcctcctctttcaaatgcatcctcagaggctggtaccagagtaatttttatctggggcaaatcttgtcctgtgacccttccccctgtttgaaccagccaatgaattccctttacctatgggtaagcatggagtcagaggtccttcatgacatgtcccagaccaacactggcagctcatctccccttgtctcctgccaaattataaattttcctcaatataccaatttctctgaactcaatataacttttagaattctgctcaagtattgactacctgaaaactttctctgacacttctatccccaaggttgaagtaaatgtcaatcttttgaggtcccacagcctcctatgctttattatattattaccacactctaatttggggctcttgatctatgtcccccaaaagaccaagatctccacaaagggaaaggttgtgccttgcacatttctgatgaaaaaccccagggacactgcctggcatggagttgaagatcaaaacataattgaaaggatggatgaacaaaccttatgacatctcatcctcagttcataagacacctagcttttagagatcatcagcaaccaaacaggatttcaattcttgttactcttgggttttgtctaaaaaacaaatgggaattcaagaaaaattgtttcttagtttctttccattctataattttgttatttgtgctccactgaaaattacctgctattctatccatctggcattgatcaaatactgcctttgcctatgaagcacctttttaaaaatggattctcagattggcaaaacagtctcgcacctaagattcttgagctgtgtgtgtgttgcagggggaggagagaacatgtctaaaactccggggaaatacgtcatttgagagcacatatttggtttaattttatacctagaaaacaaatgctctctgcattataaactaaacaatatacggcttgataaggtgatcttggctgatggagaaagaaaaaacgattgagattctcaactggggaaaagacatgatatttttatgaagtttatcaaagggagatatgagttttagaagttcaggaaaaactggcacagtaaaagctaatatggcataatcgttaacagcagattctggcagtagacagacacggggtgaaattccggatctatccctcgctaactggctctttgattctgaacaatttacttaatctctccaagccttccttttgtcatcagtaaaacagggattatcaggcacacctcatagggtcattataggactcaaatcaaagattgcatataaagctcctctaaccgtgcttggcacttaacaggcccctcaaaaatggtcgcaattattacaactattaataacatctcttctccagttaaatacagagcctacattatatgtcccattacattgcataggacactggaaatggacacaggcactcaagaagtactaggaaataggcatggtgatgacaaatgacaataagataaaacagtaagtatccatagaaagacatttgatatttgaaaactgtatattgaaaagatatcttttctacgattaaccaggttttttagattacagttatttttaacttatgaaatacagataccatgagcatttgtgacatatgcgtgcagttcaaataataataaattgaacggagtgaacatccgtgtacccaccaccctgcttaggaaacttaggaaacagaacgttaccacttggaaatcatctgactgtctttccctgatgtaccctcctctcatagcccagggtaatgtcttgaattttatgtttctcgtgtttttcactccttgctttttaaaaaacaggtttattaagatataattcataaaccatacaatcatccaatcaaagtttacaagtcaatggtttttagtgtattctcagatatgtgcaaccatcaccaccataaattttaggacatttcatcgcctcaaaaagaaaccccataccctgtagctaccactcctcagacccctcatcctcccacccactgcccccccaaccctaagcaatcagtcatctactttctctacggagttctctgtcctggacattccataagaatgaaatcatacaatatgtgaccttttgtgactggcctctttcacttagcataatgttttgtaagttcattcacatagtagcatatatcattacttcattcctttttatggccaagcaacatgccattgtttggagacaccaaactttattcctccattcatcagttgatggacattgtattgtttctgtctttaggctattacaaataacgctgctatgaacatttgtgcacaactttttgtatagacatattttcatttcagttgggtacacaatacgtaggagtagaattgcctggttatatggcaattgtttaaccttttgagaagctgaactcaccagcttttatactgatctccaggtggcagaaagctaaaagtatgtcagtgacttatggtgctaaaccaacctattcagccaacagcaggccctcaatgccagtgaaaactcttcataagtagttacacatcaattattcataggtgtgcaaatcctatcttctaagaattgaaattttctagcagttaaagaaagccagtagcaagaagagaagacttagtagaaacaaggctcttccacttcctagccattctcagttgattcttttgactctcagactaccatttttaaggtatttttcatgttgattcagtctactgtgtctgtgttgacaacttcaatgatgaaaccactaaagatggaatataaaaatggactcatattgaagacctacagaaatatcaatgcattaggtacagacaattttttcagaccaatgacttccagcaagtatgtttataaaaattaaatctacttctcaccaagagtctgaattgccagaaatacactggcatgaagagaaagcaggcaaggggtagaaggaaagagattaaggagcagaagcttcatctgaaagcctctgaaatgtggcatctggaaaatctattcacaccctcacaaatcacttttggtctgatgtgccagtctctaaagcctttgatacaagagtgcgaagggcatctgtctctgattttcctactcaacacttgtcttgttttctacagtctgctacactccccttttgttagccacagacagattgatggacagagtgaggtgacggaccaaggagtacattattcacctttacattagctatgttggggggttaaaaagttggccaacacagtaacgcctctgaattttaacacagtatttctgaatgtctttgactcaagtaaactattgctcagagagatgtagactaggaggacctaggaagcagaaattctcagtatcctatcgtgactggaatgaaaacatgctgactgcccagctacccatgtgaactccacattcccctcatcttgaagtgaaattagttaagaacagagagaaaataaaacacctctttgtattgacaatcgaacttacaaaatgacaacttaccaaaaaaatttacatttgaaatatagagatatcactgtaatatgtttatatcttaaagaaaatgcatacacatatacagaggcttgtatattataatttcctaaaacccaaacacattcaggcaatccaaatacattagatattagtatgtagagtttatcaatgaaactatttctataatacaacatacacgctttttttcttttatgcttatttctgtggtctagatttacaacacttaccaaaataaacaaactaaaaccaaataataaaagaaactgctgtctaatatcccttggggaatctcaacatttttatcttattcttaaccacactgctggagaattcttagaccttagatatgaagtgatatttaatgaataagaaatgctggagaaagaaaatacaacaggctggtgatatgcatacttttaatttatgttggccaaaacacaattttcccatttactgattcttttcacaccagtcacagtaaatagcacagacttttgtagataccaaaataactgatgttttactattagcacttttcaaatcattcctccttagactgtcacctttttccagctcaaaacagacttcacaactgcaagtttccactgtgtagttccaacattgcaatattttccccaaagaggtgtgaaacaggtcagtatacagagctaatagcatcacatttttatttagggggaaaaatacatgttacgaaattgttgggatagcgtaaaagaacaccagcttctgtgtttttaagcaacttgggaatccatatcttctatttagtacctgcacagtagtgtttcacagagagattggctatctctaaacagctgacaaaggaatccaaactcctcttggtatggcccacacagcccttcacaatttgtacccagtccaactttccagctcagctcccattgtccttctactatgtaccaaatcagtgttacctaaactttttcataaggcacactgaggtaaatgaacaactgggctcaagccccaggaatgaaaggataactgtctatgcagccccatcacctggtatgtcactgaggtaggggcattctacctacattctacctatgggagtgtattcatggttcctttgacgtgtcatgtaaccatcgcaagtctgcagttttgcacacactattccctttccctggaacatttttcccctccgtacgaaagaaataattcttatttttcaagactcagctcagacttcacctctgcagcacaggtgttcttgccctctgctgcctccttagccccaagaatcagaggctctcctctctgtgctcccaggggacttctcacccacagtaggtcacttctctgtcttctacactgcaagtgagccccttgagagcttacttacttttctaacttcagaggtaagcacaatgtctgacaaattgtaggtgctccattgctgttctttgaaataattcagaatttctccaaagcatgcagagaatagagaaaattcaaaaccagtctctatcaaatagggaattattctgaagcatatgtgctcaatttcacctgtggcaggacttgccatttatggattcctggagaaatgctttgatgcctccttctgaaattcaacatgcagtctaaaagagctcaagtagatgcaaacaggagcaggcaaattcccttggaccctgagcctccctccctcccagaggcaggtttagctggaggccaaacaatcacaagagtgctggtcccacccagaaatccaacaatattcagcatctaaaaacatgtcctaaagaaatcaccagcaatgcacaagcaattctgctcaaggttattaaatgtagcattatttataagagtacaaataggaaacagcctaaatgttaaacaacagagacctagttaaataaattatgactatctcaatgctagagaatagtaggcaaccgataaaaaaattatgttgataagaattttttatggcaataaatattattaccaaaaaacaaaaaaggaataaacaacactatatacagtttgatccaaattttacttataaaaacatatatatgtgtgcttgcaaaagtaagaagactggaagaaaatatacgtgtttagtggcatgtatatctgagtgacattatagtgataaaaaatttattttattctccattctctttcagtattttccaagttttctgtagcaagtatgctttacttttgtatggaaaaatcaggaggtggggaagtaataaaaatcaaagcagaaaggagtaaaaagttattattgccgagctgttctactctgggctgcatacagctgtccaccaatgttctgggaagctggcccattgtcaggatcacaggacacagcaggagtaaggctctcacaggaatatacaccctgggtgccccagatctgccctagactcagagtggacccgggacctgatgggttttcttaaattggtagaaaccatactctgggcccacagttcccttgccatctaggacaaaaatctaagacctaaatctagttttctgaatttgatttgcaagagtttcaagaaatcatgccaaatttcccctggtgttctcattttcctcatagaaaatgctagattcaggccaggcacggtaggtcacacctgtaatcccaacactttgggaggccaaggcgagaggattgcttaagcccaggagtttgagaccagccgaggcagcatagtgagacctcatctctacaaaaaattttacaaaaaattggctgagcatggtagtgcattcctgtagtcccagatacttgggaggctaagattgaaggatcatttgggcccaggaggtcaaggctgcagtgagccatattgcaccactgcactccagcctgggcaacagagtgagaccctcctatctcacaataaataaataaataaataaataaagtgctagatccagaccccagccagaaagacatttcctccccaagaatattcttccacatcctcctttttgtaaatacagttccatattattcttaatgttgctgaaaaatattttttggaaacacttaacacatgaaagaaattaagcaggacaactaggagtggatggtgtcacaaagacaaggaaagagtctcctaagcaccatatgcccccaaagataccaagatgagacagatcccaaaagcgtccttcggatttggcttctactggtgctgatgatctctaccagattcagggaggactgaagtcagaataacaaagtggtgtgtatacctgagtgatgttataatctttctttaaggggtttgcctgggaatagcaggagaatcaggccagtgctcacagggttgagacaaacacatatctagttggaagctagtgaagaatacagggaaaagggggtcaatgaaaactgaggagagacaggaataatgagagcagatctagtcctgaagaaaacaaaaaaagaagaagctgggaaccagagctccatatttccttctctcctgaattttcatttaggagaggtgagggatcacccttgaatgaaagaggtactttgtcttctggaacctgacccagtgattcttaaccagggagcccatcagaatctcctgtggcaattttacagccaacacaggcttgggctcctcctcctcctcacctcaccagcagacctactgaacggtcctcttcaggacgaggactaggctgagttatttctaaaagctcccaggtaattaagatgcacaatgctgtctaacgatcactggttagaaaggaggaaagggtgatgatggtaggaaatagcttcataggtgtaagagcaggaaactgaggaaggagagggttcagggttctctcaactaggaggtaaggtcaagaagtagagggcttagggagcagtgaagtcttaaaatagtctctgtgcactgctcagaacaaggcatgtgggggcaggaggaggggcaacactttatcaaatgtctaggagcatcaaggtacatcgtggagtgatttttcccaggagggttcagaaatgtagaaagcaagtgagaagcagatggtcagattaatctatatgtgggagtttcagggggatttggcatgaaagagcaaggaagtaatttaatatcaacctcatagggctgttggaagaattaaataatgcatttaaacacagtccagtgcctgacacaaaatgagagctcaataaatgttagctgttattgtcattgctacaaccactgttgttatttatttctggaaccaagcaaagtgatcacgtctgtttcttaggaatctatcaaatagaagtcagcagttgcttctcaattaacagaggaaaaattcgaaagctatgtggggtgttaaacccctcaaacaagaaatgctaataatcatatatttctgtaggcttccattaacttagttttgaatagctagttgttgagcattcttgcaataatgactaacgataactggtaccacttttactataaatacagcagcacaaaagacttaagaaattgaatggaaaataatgctctctttagaaagcccatgtgaggctgtttaaggtaagacattctgaacctttattccattactgctgcctccatccattcaaaaaggatttgtggaagttggcaaagatgcatacaaaacaaaattaagaaaagaaagtaaggcaaccagtctaaagagaagtaaagggtaaggaaaaatgtattcggtgtccaatgcacaggcaaagaggtccctttcacaatgctagttgtgggtctcgaatttggctgtgaaccacctggcagtggactaaagagggaaacaggaacagtactcacagtttccaaaaccaagggaaatactgctattattgttaataaagtgtgaaaattttttccttcatagattgaccgtgatatagtgaacaatgtctataatatccttacatcaaggtttaatcacctgactaaaagatacccttcctccagcttcaaaaaaacatccttaacttctggtagaagagacatggtaccagaatcaaaggttagctctccaaaatttaggaattttttctatgttatttattagtccttatgttccatcaaagacagaatcattttgaagcatatccagctcaaataaattaatgttcccattttttggaggaaataagtttacatacttaaatatgacctgcataatcactcatctaacagtaaagtatatttttcaacccagaattattttgcccagccaaagtatttttaaaaattgtaggaacaccataaagacatgctcagatatgcactgtctaaaagttttccttcctttctctgaaagctactgaaaaatgtgctccatgaaaataagggagtaaacaaagaaagaggatccaggaaatgggagctagcacaaaaagggaaaaggatgacggtgaaaggaaatcccagtatggcaggcctagggcacagatagtccagcctggggctggtcagaggctccagaagaaatggccccaacaagatgaaacagatgaatagctgctgtggctaaatacgttaaagagaacagcccacacctggggaagagtgtagaactacactagtgatgagtacgctgaaaaccaagcaaacaagagcttttgtcttagaaaagggggtgaatggccgggcacggtggctcacgcctgtaatcccagcactttgggagacgaaggcaggcagattacctgagatcagaagttcgagatcagcctggctaacatggtgaaaccccgtctctactaaatatacaaaattagttgggcgtggtggcacacgcctgtaatcccagctactccagaggctgaggcaggagaatctcttaaacccgggaagcagaggttgcagtgagccgggatcgtgccactgcactccaacctgggcgacagtgagactccgtatcaaaaaaaaaaaaaaaaaaaaaagaaaagaaaagggggtgaatagaaatagatccatttgcttgcacaaggaaacaatggaagcataagaaactaataaagacagcaacttacaggagatggagaataatggagacagtagaactagaatagagtgaggttttttaaagtacactttctatgttgttttaatttctaaaccatgtgaaagtactacctgttcaaaatcaaataaaaataaagttctaagattgttttctgctaacagtgtccagaggctttacttgttcttttgacagcatcaactgctgacccacacttggctttctgtattgcacacatctatagagaattagaggcaaagaggtcacaggatatggctacagccttgaaaataaaatcagtgaagataagagaagtgggagaagcatcttcaatttatcaaagcatgaagtacagccacttgttttctagaaaaaatagtactggctatgtacctacagtataacccatataagtgtatagaaatcagatgtattaacaagttgtttttaatgggggctctatgagaattttgaccatgcagttcttcctcaaattcccctgtgcgttttgaggagtaaggatccctagccactgtccaccaaatgtcagtgtgactcctcagtcactgaggcaataaaaaatgttccctcctccacatttccagaagctcatactcccaactgagaaccactgtgaggaataagtaaaaaaattaaaaattaacatttgtcaatttttttccctatcactgccactaatttttatcagttcattaatttaatgaatctttataacacattcattaagaaatcatgaacaatctgatcttccaaatgcttgggtgttactaaagatagtttgtgccttgagtttgtttttttttttaaccgagctagagaaaatctgaggaatctagaatccctgccagccttcagtcaaagtcctgcttcacaactgcagagtatgcagtttaattttttttaagttcttatatattctctcattgacaaaggctaattacttctcttaagagtcatgtaagctcagcaaggaaaatactattttccccattttcacagatagggagtctaaaggtcagagcagtgaagtgatttttccaagctcataattgacagaacttggagcagaaaccagaacttctggttgtcagtctggcggtttctccactcagctgtgatgtttactctagacagtattttctctatgccaagcctataacacatcagcttgattcaaatctttaacacgatgattataaatttgaaacccagcatcttatttttaaactgacaggtcaactataatggtcctcaaaatggtacactttgaaaatcaataaaggtgactgagggttttacacaggttagcttgtgtggtcttcccaatagttcttctaggtagatacaatcattatccattttacagatgaggaaatgtaggcagagaaaggggtaagcaatgtgttacttaaggccacacactagtaagtaacagtgtggatttgaacgcaagcagtcaaactcaagtcggggaaaactcccagtagatttaactaagaaataaaccccccagaaaaactggcaggtggattgtttagataaacaatgaaatgtctctttagctctgtaaagaaaaccagcaacccctatgtaagtttttgatcaactggtaaaaatgacctcaaaatatagaaacaagcaagtaactgtccctctatcaaactaaataatattttaattgcctaagtagtgggcatttaataaatcatcaattttctattctattaataatatttctgtggaaacaagacaactctcaatcaccaaatctggtaaaaaaaaaaaaatcacaacaaaaatcatacagaggcaacacaccgagttaaacaacagcctggagaaaatagattcattttattcaacttcaaaagtgataagaagttgactccaattattctattccacataggaggttatgatgcttatgaccaatagccaatgcataagactgataattttctagtctaaaatttctacagagcatcccaaaattctattttcaaccaagtttaatctccagaagtaagagtatgatatcttggtaagaaacactatttaatataaaaattcatagtcatgaaataatttagtaagacaccaaaagggtcacagtcttacctcaaaaaccatgtgcatactgaaaagtagccaggttgagggcaagtaagaacttagggaaaagcctgaactatcaaagaaatcatctgtctaagtccccagaagaatcaacctctacagaggtaaaaatggaaagggcgggaggagatacagctataagtaaaactccatgtggcctatattctatgataatgtatgatcaatggtacaatataggtaggtaagcatatatggatctataacaccagaaaaacaaacacatgttgagttaataattagatatctaatgatcaaagaagagctagaagtgaaaaaaaaaaccagagcacctacttaccatgggttcagtggtggtccctgttgccagcacacattccgtaatctcggaatcctgtggctagtccactctactgcctccctagatgatggaactctgatgccatggcacattgcaggagctacctagtcatatcaacagagttacagactcaggaattgagaagaacccagagctcggaggccatgcagcagggcaccctccatattgagagcaaacaccatttggggtttggggtttatttatttatttttttttaagacagggcctcacactgtcacccagactggagtacagtggcacaattatagcttactgtaaccgtgagctcccaggctcaagccatcctcctgcctcagcctcctgagtagccaggactacaggcatgcactaccacaccagttattattatctcttatttttctggtagagacaggatctcactgttgcccaggctggacgtgaagtcctggcctcaggtgatcttcccacctgggcctcccaagttgctgggattacaggcgtgagccacctcacccacccagcaaacacagttttgaaagactttctagtaaagagcccaagaattaactgcccagagaaagaggatgtgtccccatcttacagatggccagtagaggcacccagaagtgtgatattcctgaaatcactgattcagtactgaacatctaagataacacagcgatttgctgacaaagatcacagtagactctgtgagactgtaccttgaagaaagaagggaagaataggggcagagaaggcccctcaggcctgcctggggaagtgggggaatgggagtgaggagaggcagaggggacaggaagaagcccctccagcagtaatcaggggagagaatggtcaagaggagcttgaaggacactgagagctggggactggggtccggtggttctccactggtatgtgggtgaaagtggagaaggaaaagtcgaaggagctgatgagctaaagaaatggcggaaggaagtagaagagaactggggaggccttctgacagaggtcagtgctggaaaaggggaaggtgggcacaagagatgatgacaatcttggtagaaacatcatacagaaaatgcaaacatccatctagatgaccttcagtgatggtaagattctattaaccttccagagttatccgctccaaatttagaaacgttttatttgtaaaatagaaattgccttgttgctttggtccatttcttctcattttaattggaatggggttggaggacagttggttaccactattaaaatgatgtgttttcactgggctcatagctctttaaacagactgagggataaatactctcccagcccctgttctaagttggcagacagacaggaggggccactaagacaacacctaccctctgcaaatcagcaccagacaaacactttagttggacagcagaaattatatctccattttccagaggaacagaaacatctaaaagtttaaatttaatctaacaagtattttgaagttcttgctacatgcaaggccaccctaagtttatttgtgacacgacagcatcttccactatgaatgaaacacacacaagaatctcagagtttcaacaggcgcccatctatctcatcaggctcattcaagaatcagaagtatcatttaacagtccagaaaaaaagacattcaggtgcctcgtggctgcttcccgtcttcaatcccttcagcaatcatggttctgagtcagctttcataacccacaatgacacatctatctgaggcacacattctgagataataatgtccataaatggctgaagataaaagaaaaaaatcataagacagtataatgggaatcataagacagtataatgggactcataacaagatataatttccataaaaaaccattttggtggcagcttcttctaaaaaaggtgatgaaagtaaatataacatctctcacataatgtttatgttctgtaccttgtatagattctatgtctttattaaataaatgaaaagaaaaaaagtccacatagacaaataaaataccacattagggcttttttttcccccgctcaatctggaaaattttgcaaaaaaggatcttttatttatggaagccctgactttcaaatcttatttaataagcttttaggaaatgaaagataccggtggctcatttagccatgaagggaagctgcaacaggagccagggcctagacttgccaaatgaaggtggctggaggaaagggctatccgattcattccgccatgaaggacttttacttagggtcaggtgaccaagattctctatgcaggtcagaagacatcagaaagcaggccgatctggatccaattcagcatctggcatcattgactgcctcggccatgtcacttaatcctcctgagcctcaattccctcaatggtgagataagcttgtttatgggactacccacctcagtaggttgttgtgatgattaaatgaagtgccatgctaaagggcctgatacctaccagacatacaacacaaaccaccctctttcacctcttcttattttccctctggctgaaccccagtggtatggcaagctaagcgtctctaaatatcaggcgcctcaactgcaaactgacaaaggataaagtatgcgaaagctttaaatcgctatgcaaatgttaggagatattgttattagtgccaatcggtacacctcactcgcaactgcacatcagggaataagagtaaaaagcatctctcagggagtttctttctaccccacctgtatactgctaactataaagcatagttcagcccccttcagggacactaatataaaagtgtccctgaggggggatgaactatgttttatagttattttctttttcattttgtgcatttaattaatgcttttatttctgtgctcatactcttgggtaaaatttgagaaaaccagaattggaaatgctaaagacaaatattagcaacaagcaacttgatatttgcatatccttgcaaagatccaaaaggagctgaatatgtggaaaacaggtagtaagataaagaaaaacaagtgttaagaacaaaagttctgtgagtttctctggggtgaaacttgcctaacaatcttcaacacccagcaaagtgtccggcacatggaaggtatttgataaacgatatttacaccatctgtaggaacaacgtgacctcagtctaccactgaccactaataaaaagataagcagaaaaccaaacctgaaaaatgaatattactctagctgatatgtgtttctattgactaatttattgatttttagaatggccatgggtacactacaggggtatatggtcttcaactcccaactatgtaaactctgaattccaactttaaattgttcaaaataaacagaccaaaacaaggcctctataacccccattacctgtattgttgagatgatgagtttgggcagaaacaaagcctggaatgaaacctcattcccgtcctccccagacaccacatacatcacatgggtgtcagagaatcctgtgcatctaatcattttcaattgtcatttcatctaggatgccaaatgttaaataatcaagactaaattttctctctgtctctctccatctttagtgcaagcagtatattatgggttaccatactattcttaatttctaatcatttttagtgtcttttctgccaatttgtaggcttttcctacctatcccagtgtttcttctggcctatgcaacacttgctttgcatgtatattatgccagagaaagggaaatttatattcaccacaattttgtacaaacaagcaaggcaaagttaaataaaaattagaattcagaagagaagcagcaatttatacagggttctttggccctctgccaatcctaaaagaactttgataacatcaaactacagaggtcccagcacctatctgtaaaaagagaaatacacaattctcagtactcaaaagcatcttctggtttgctatgctagaaaacaaaccaccctaaaacttagtggctttaagtagtaattttattatctttcatggttctagtagcttttactttgcagctgaagctggaatgatctgaaggctttttcactcacatgtctggcaccttcctgagaaggctggctgacacctctctccatacagcctttctggatgagtatcttcagcttcctcacagcatggaggtctcagagtaatcagctccttgcatggcagctggtttctcaggatatgaatgaaggctgcagtctctttaagactttgcctgggctgggcgcattggctcacgcctgtaatcccagcactttgggaggcggaggcgggcggatcacaaggtcaggagatcgagaccatcctggctaacacggtgaaaccccgtctctactaaaaatacaaaaaattggccaggcgtggtggcaggagcctgtagtcccagctactcgggaggctgaggcaggagaatggcatgaacccgggaggtggagcttgcagtgagtcgagatcgcgccactgcactccagcctgggcgacagagcaagactccatctcaaaaaaaaaaaaaaaaaaaaaaaaagactttgcctggaaaattggtagagactcatttctgccatattttatatgtcaaatcagtcatcaaacccactcagatgcaaggggaaggaggtatagaccccacttctcaacaggagaattgaattggaagccaccattaatccactacactcagattgccttgcatggtctgcatcacaaacagggctaatggcagaatgagccccagtggatcagatttgtgcacatgtagatgtccactcctgtaaaacatcaataatctttttttttttttttttagagacagggcctcacgctgtgtcacccaggctggagtgcagtggcatgatatagctcattgcagcctcgaatgcctgaggtcaagcaatcctcccaccttagcctctcaaggagctgggactacaggcatataccatcatgcctggctaatttttcattttttaatttttttgtaaagataaggtcttgctctgttgaccaggctggctgagaaatcataatcttaatgttgggagattgaaagtggtgctggtcaactgtgctagttaattatttagtgtgttttcatttcactgctatcttccaagtttggggaatttattagaaaaaattaaaaaagagttgcctttgatcactggcaatcatcaaatatataaatttattgcatgtattttataatgtcatctgggtaaaaaaaaaagctattaatattttcatggaggtgcaacaggtttaattccaaattttggtcaccgaaagacttcatggctcacctttttatactggtcttccaagcggaaatgaatagataattatgcagtcctggacatacagatttaattcctgttgtgaatattcattcagatgagcaggaaaacttcaggttattttaaatcaggatgagaaatcaatactactagtaccaaagaatatatctgcatataaaactgctcattaaagtcaggcaaggaagacatagctcccggaaagccccacttagaaattacaccgaagctgatccccgccagcaacttgttaatgaatatctctggtgttctaggccctagaagaacacacaaaggatggggcgagaagttttccattttagacggtgaccaagccctgtaggaactggttctgtctgaatcctttctttacccattcctgatgactgcttggtggcttttttgccttgggtgcctgctcttatagcaggtcttcaagcctgctgaggggcttcttgagaaacttcaaaccatcctacttgagttgtccttgctctgcaaagtccaaaaacaaggtatggccagtctaataaccctttctcttggagaagaggcagttcgtccctgttcaagagaaggcaggaatgacaggcagacatcaagttctttcttgcttaaccaacattaggcagacagggtccaccccagagcagcagtgtgtgatcactgttgacaggtacacagagaggaagaggtgagcagcagcaacgtggaaactgggttaagaaaaccccagggaaaaaatagatagctaattagagttttcaaattaatgtgcacaaactgaaatgaattttcaaagatgttcctcctttccttgtgccaaaatttaagtctttttctgaggtccagaatgttacagccaacagaacaacttggtgatagaaagcaatcatttttaaaaatcataaaagagattaattgagcccttataatgtgccaggtgagtactgcgactatcagcattttacagatgaggaaaatgagacacaaataactttaataacctgcccaagagcacttagaaagcaagagctaacacccaagtttatactcctaaccaccacacaaagtatagaagaaggagcagggcttttctgactaaacaagactgatatctaagtctaactctgccaattactgtgctagatatgtgactttagtttctaaactttctgagcttcagtttccttgccagcaaaatagggataataccatctaattcttataattggttgctgtgaactctcagaatgtaggttttcaatcaatggtaactatttttttgttatgcagaccagagggaacacagccaagctagcaaaaatgaaacacaagaatgggaaggaaacctggaagcatcaggaacatgcacacctcattttctgccaagcaggcaaactataccttggcgagaatttcctctccagagcctcaactcctctttttaaacacggaatgggcataattctgggagattttgcatatgcagtattcataactcagggaaacaatgtgcattttccttttatttttaactagagatacacaaatacatgataatatcatatgcgcatacatatttttacttacattcaatcttttgcaactctaatgggtccttaaatctgattccaaattaagtccttcagacacggctctgattaaataactagctggtttcagagccatctgaggattttttatgctaataggataaaatccagtctctttggcctaccttcctctacctttcacagtaatttccattctaatgctatcacacacacatatcccaccccatgcctcatcaggaactcttctataaaggacaaggcctctctgcctgcttgtccctgaacataaacatcttgctcattcccacctctgcatctttgcactggccggatcctctcagcatcacccactggctcatttcctccagttcaagtcctaccagtctgttaagaccctgctaaaggacctcctcttccagcagacctcccatgaccaatttggcccccattaatccattttgtttttctactgaattcctacctgtgcagacttttcagtttcatttctacataatttactactatgtaactttccttagagaaaaatcctccctcctcaaggatactatatgcaacttgagagagcacatggttaagagtacaggttcgcagtcaggcagatctgaagtcaaatcccagccttgccatattctagctgtatgacctggaggaagctacttaacttctccaaatcgtagttccttctctgtcaaatgggattataattgtagttatctcacattgtttgaaggggggattcatgcctggtaatatataagtgctcaataatgtcagctataattattatcactacccatttctcacacgtttttaatcccccacagcaccagctatctattaataatctatctacctatccatctatccatccatccacccatttatgttagagactcgatgaatctttaccaattgcctaacttagacgtaccaatccttctcaaatttccacttctccaagaagcacaaagctgtttctactttattaagccagcatcgaaactcaagattccccagatagggtctcacacagagcatgctgatttccaggagctttaaatgggaatgaaaagtgatcattcccttagttcagatatgctggtttgaagaatagctgagtaattcatgaggttctttcaggtgcattgatcagattctgctctttaagaagcattgtaccttgaagtaactatttgtcattccccttccaaatgagagctagataatagactgcatctgtttagcaaaactataacaaaggtctaaatgataataataccttagacctgctggatgcatcatagtttataaagcacgttcatacacatccttcatcgcatgcttccagcagccccaatcagataaccagggggtttatctcagtgtgctaagtgggactgctcaggctggagaaggttcaagagctttcccacaggccagttcattgattcagatcttccaactcctacttcagtgttcattttatggcaccacaggatttaaaactattcgcatatctttacaaagagatacccagctggaaagtgtgtaacccactgctaatttgtgttttggttaaagtatctatagtatcaccttggagatataatgcaaagcaaatctgtcaaatggtatttaatgcagttctatactacctgagactaagtggaagacctcagttgaaactctgtttttaaactagccattttcagtctttcgagcctgttttcctagaagtagagtaggagtacacagcatcagcctgctgggattccttgataccagactcagcctctactgtacttggacagtcttccttggtccagttttccaccagttttctaccaggctcccccttccttactgccctccagttgcccaacccgctgcctggctctttctcagacatacagagtatgtaccatctcagtacctattcatgggtggttctcagtgcatggcctgctccctttccttattcacatttctgcacaaatatcacctcctcagagaggtcctcaaaccatctaatcttattaacaaccccagacgcactctgcaaccactttccctactgtttcatcatagcacttaaccactactagacattttacaaatgtttcatctatttataactggtcttcagcactggaatgtaagatctaggagggcagggctttgtattgctcaccactgtatcatcagcacttgaaaaggtgactgacaataggaagctcccaataagtacctattgcataaaggaatgcagcctataaatttccctgtttaaaatctctacctcttccaatttgaaaagattcttatacatgaagccaaaagaacaaaaacaaatctcacaactaagataaatgcacaaaaaaaattagtgcatggatgggacaaagaacaagtgtacagaacccctaggattggaacagccatgactccaacaactgttacaatagttacatcactggacctaatgccaatcagttgattaaaaaaaaattagctgggcacgatgactcaagcctctaatcccagcactttgggatgtagaggcgggcagatcacctgaggtcaggagtttgaaatcagcctggccaacatggtgaaaccctgtctctactaaaaatacaaaaattagccaggcgtggtggctcatgcctgtaatcccagctactcgggaagctgaggcaggagaatcacttgaacctgggaggcagaggtttagctgagatcacaccactgcactccagcctgggtgacagagcgagactgtctcaaaaaaaaaaaaaaaaaaaaaaaagaaagaaaaagaaagaaaggaagaaaaagaaaaagaaagaaagaaaaaattaatgaccaacattccccttctaccccccaggcaagaggtctctcgttgcctaaggcaatttcatcgcatgcctcagagtaagcaaaaactgacagataaatgtcctaggctatctttttgagaagaaggtccaagttatttcctggatttttgcagatatgacagtaaattggcaactgagggaataacaacctgacatcatgtgcccctaatctgatacaattagagctactcatcatcagccatgaaatgttcttgctaaaaatatgtaatctgaatgtaatcatgaggaaatcatcacatatccggaatgtagggcattctacgagacaactggacaggtctcttcaaaaatgttagtatcgggaagaacaaataagatgtagaggctctactagattaagaaaaaaagactcagttggatcctggattgcagggggaagctagaaaatcgaaaaactagagaaagctgaatatggatggcatagtttacaaaagcttcatcagctacatccatttactctacaatatttaaagccaatgtccaatttatcactattcacccctgcaagtaatcattaagcattttccatatatatcatgtccttctccaatcacatacatctcatcacagtaatatctatatcctgaattcagcagggcttagcctccacagggcatctttaatactaattggaggagacaggctttataaatccttatttacaagatgattatgaaaactatatttcctaggcctgtcctttacgcttctattattctctctctttctttctcttgccaataaagttcttattaaatgctgcttcagccactaaattgtaaattccctggcagtagaaatgatacctggttaatctttgcatttctaagaagcaaacaatggcttacatagagtacatagctcataaatgggttgttgaattttcgaaattactgtactttaatttagaccacataatgactatttatttgcttcaatttttaaatgaccctgaatgtctctgtgctacaaaatgtactgaggcactgtacatctttcagattttggaacttgcattcagttgccaataattttatatatttcatgaaatgtttaacaataaaactactctttgcatctcaaaatatgttttgaagaaattatgaaatcaagatgttctttcaatgtataaaatattcaataagtgactcaataaattagtagcatatcttatttgaaactgagatgccattaagagcatttagtaagctgttttgaatactcttatctatctctgctaacaaaggcttgtttcaccaagtaacttgggaagtcatcccagtatcatgatttatacacctctccccattcatactaaatgcatcttcactaaccctcttcaatgagaacttttatagttacttatttctttagaacttattgaattgattctcgtattgtgaaaggtattataacttatagttataaaaaaaagttaaaaatcatttaacttttgacttctcatctcatgcctagctttttaaatttccatttctatttgtgaatcttgacatctgtaagcctcctggatcatcaggctctgagacagtcacattctactttgctgaaatcagattgctcactgaacttcaataagtatgtttctttaatacttactagcacccttttgtgacaatccccaagcccaccacctcactgggacttcaccccttcctataatcaaagggctttgaaagacaagctttctctaaggctgcatggcatttcccaaagaattaccatgacctagttttgaactccagatagacttcagccagtgggaaacaatatacgaagcatctttatttcagcaactgagcctcattccgaagaactgctccctctctgagaggttaccccagtggaaaatactgcctgagagaaaaagagattacatgtgtggtctgggtccagccatgacccagctgtacaatcctgggaagtgagtcagtctctgaactttgatttcctcatctttaaaattaaacagtgagactaggtcacctctcacttgccttccagttctaagattctataattccatcgagtgttcctatgtggagcagaaaggggaaacataattatcaaatttcaaaaatacggcataaaccctttggtaattcttctgtattctgctacctctacgtattttgagtaccctggcaacttccataaggacttacaaaaccttagagactaaaacgtgggccaaaccgtatgacccagcaattctactcctgagaaatgaaaatgtatgtacacataaaaagttgtacacagatgttcatagcagcattattcataatagcccaaaggtagaaacaacccaaatgtccatcaactgatgaatagataaacaacatttacagtctccacacagtgaaatattatttggtcattaaaaggagtgaaatactcatacatgctactacaaggatgaaccttgaaaacaatctaaatgaaaaaagtcagtcacaagattatatgatttcacttgtatgaaatttccagaacagagaaatctacagggacagaaagtagattagtggttgctttagggtggcgtagggagaatgaggggatgggagatcatagccaaatgtccatcagttgatgaatagataaacaagattggtatatccatacaatggtatattattcagccataaaaaataataaactactaatacctggtaggtattagtctgctagagttaccataacaaaataccacagactgggtggcttaaactacagaactttactgtcttacagtaatctcagatcgtggtccagctagaaatcccagattgaggtccagcagggtcagtttctggtgagggttctctttctggcttgcaaatggtcacctttccactgtgtccccatatggcagagagagagcaagctctttggtgtctcttcttataagtatattaatcctaccagattagggcccaagcttttgattctatttaaccattatcacttcttcaaagggcccgtctccaaatacagtcacactgaaggttagggcttcaacatatgaatttacaggggatacaaacattcattttataacatgtaacaacgtggacaaaacctgaaaacattatggtatgtgaaagaagccagtcacaaagcaccacatattgtataaatctacttagagtaaatgtccataatgggaaaatccgtaaagacagaaagtagattagtgattgtttagggctgggatggggatagagttgaaggaaatgtggaatgatgtttcttttggaggtgacaaaaatgttctaaaattgactgtactgatggttgcacagctctgtgaatatacaaaaatccattgaattgaatacttcaaatgggtgaattgtattctccatcacaagaaaactgtttaaaaaataataaacaaatagacaaggctcaagatgattgcctaaggatgaaaaaacaaagagcttttgaaggaagtcctgggctcagatcccagtgctcccactcattagctgtgtaaccttgggccagtctctgaacctccagttcctttactctgtgacgtggggagagcatggcaattgttctcagttggtgtgaaaatgaaacgaggtaatgcacagtgcccgacaagtatcctaagcacttaataactaatggtcattgttgaatattattagcatttcatcagaagaatagcccatctgttttttgaactgaattgatttcaaagctcaggcactgaatttgaccacaagtttttagtggctactgcagaagtggaagcactcatttttcaatatccaacaacagagtcagtgccacttacctataagcttgctgttctatgaacatgtttgtgactcgagaagaggcatgtcactaaaaccaagatggctttttagcatctttagtcaagggagataccagtgtccaagtgatcaaactatttcatgcccggagctgacagtcaatatttgctgactgatcgacttagccatgcctgacttatgagggtttttatttcaaccgatgtttcattaagtgttggtaagacaggcccaactgtccctgggcctctggagccttttgggatatgcagaagaaacagagttggtccctgcctataggagtttgtattcaagcatctagtcctaaactgatttttaagtttatgtttactttaatgttaccactattccaactctccatgtgaataaacaataaaactgctcagtacatgaaggcaagcagtaaaaaggagtttttttacactcaaggtaggcccacctctccagcacttctgaggcccagttccaatccaaaaccagtggaaagaactctgggccaaatgctgaggacatgagagttctattcccagctataccacagaatagctatgagtgcaagactcctcctttatctgtagagaatatgtggatgcctgaaaccaagaatactactgaaccctatatacacaatttttttcctatactacatacctatggtaaagtttaacttataaattaagcacaatgtgagattagtagcaataactaataataaaatagaacaattataacaatctgccagcatcactactcttgcactttggggccattattaaataaaataagggttactcgaacgcaagcactgcaagactgcaacagtcaatctggtctgacaaccaagagagctactaagtagactaaagggagggcagcatctattgtgtggatacactagacaagggcctgattcacgtcctgggcagacagagtgggacagcttgagatttcatcatgctactcagaacgatggacaatttaaaacttatgaactgtttatttatggaattttccatttaatattttcagatcgtggttgactgtgagtaactgaaactgtggaaaatgaacccacagataagggggactacagtacaaatcctacccttttgtactgcttccatcactaagatatgaaagaccaggttagacagtaaactaagtctctctatcacctagaccaaaaaatgcatattagttctacataaactaagtgcctttgatagttctagttctcactgtaatttaataaactggcacaatgttctaaacaagatgtagaaactgccttccactccctgcagacacacacacacatgcacataccccagaaaatacaaagtgaggtccctgagcctgactggcagaactgacccattgtgataaattcacccatctgaaatgagtcctcttgggaaagagtctaccagcttatcctctagaattcacgcccctctttccatagccccttcatgggcctgtgtataagggagctgtgatccaacttggatacatactttccttctgaagtcatggtaccaccagcccttttgggtgtgggtgcctgtggttgtacactgtagttctcagctatttaaaaatatatattcctgaaatttgttcattctcacctccagctgtactccaaccataagataacatatgaagatgctaacctcggagccaggctggtttgctggataaaaagcagagacattgaataagaagacctagctctgctcctgattagttgtgtaatttttttttttttttttttttttttgagatgaagtctggctctgtcacccaggctggactacaatggcgcaatctcagctcactgcaacctccgcctcctaggttcaagcaattatcctgcctcagcctcccgagtagctgggactacaggtgcgtgacatcaagcctggataatttttgtatttttagtagagacggggtttcaccatgttggccaggctggtctcaaactcctggcctcgtgatctgcccgccttggcctcccaaattgctgagattacaggtgtgacctaccacgcccgaccagttgtgtaaatgagacttaacttttctgtgctttgtctgtaaataaagacaacaaataatattattgtgacactgaattaaataacatgattaatacagaaggaactagcaatgtgtccaccaattacagaacatcctgtaaagtcagtttgactaaaccattggatagatcctttctcaggaaagattaagtctcaggaaacattaattttaatgcactctctggaaatgttaagtaaaatataatatatattaataaagtagtaaaagacatacataaataaaatataaactcccttacacatacttacacacaccacatgtttatacatatgaattcaaaccaaacacactgtttacaaatggccatttatttctgggaattagtaagtccaactgtaaacataaagacaatatttatatggtcaagaaaaccaattcactagcttcagttttaactcaatttattaattttattttttaaactctactttctcaaaatgccttttttgttttgttaatgtattttttaaatattatcaaaatggaaaaaataaacttacttttggaaatcatgcattcagcaaatacctactatgtactggaaactgtgctatgcactgagatacaaagatgaataccatgggaccctaagttagccttgacccttgaagagctcatagtccaataaaactgtgttaaaaacaaatttttcaatcaaccaaacattctcttcattgatacaaaggagttctcattagtgagttctcattagtgctctaacacttcctagcccggtggctttgaacaatggatatcttcagaaccctgggatcttcatctgcacaaatgaaaaagctgaactatgcagcctgttgcatcccttctccagtgaaaatatgtgattctaattgccattttaagcccaggttgaactttccctttttttaactaccttccatggctaaaattacaggtattttagacaatgtgcaaatgagtcaatacgtgacattgtgtcaacatgtgcataggtatttattgcatagctatataaatctgggcaccaaaatctccttaagctgataagcaacttcagcaaagtctcagggtacaaaatcaatgtgcaaaatcacaagcattcttatacaccaataacggacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacatttcatgctcatgggtaggaagaatcaatatcgtgaaaatggccatactgcccaaggtaatttatagattcaatgccatccccatcaagctaccaatgactttcttcacagaattggaaaaaactactttaaagttcacatggaaccaaaaaagagcccgcattgccaagtcaaccctaagccaaaagaacaaagctggaggcatcacactacctgacttcaaactatactataaggctacagtaaccaaaacagcatggtactggtaccgaaacagagatacagaccaatggaacagaacagagccctcagaaataatgccacatatctatgactatctgatctttgacaaacctgacaaaaacaagaaatggggaaaggattccctatttaataaatggcgctgggaaaactggctaaccatatgtagaaagctgaaactggaccccttccttacaccttatacaaaaattaattcaagatggattaaagacttaaatgttagaccgaaaaccataaaaaccctagaataaaacctaggcaataccattcaggacataggcatggacaaggacttcatgtctaaaacacccaaagcaatggcaacaaaagccaaaattgacaaatgggatctaattaaactaaagagcttctgcacagcaaaagaaactaccatcagagtgaacaggcaacctatagaatgggagaaaatttttgcaatctactcatctgacaaagggctaatatccagaatctataatgaactcaaacaaatttacaagaaaaaacaaacaaccccatcaacaagtgggtgaaggatatgaacagaaacttctcaaaagaagacatttatgcagccaaaagacacatgaaaaaatgctcatcatcacttgccatcagagaaatgcaaatcaaaaccaaaatgagataccatctgacaccagttagaaaggcgatcattaaaaagtcaggaaacaacaggtgctggagaggatgtggagaaataggaacacttttacactgttggtgggactataaactagttcaaccatggtggaagtcggtgtggcaattcctcagggatctagaactagaaataccatttgacccagccatcccattactgggtatatacccaaaggagtataaaacatgctgttataaagacacatgcacacggatgtttattgcggcactattcacaatagcaaaggcttggaatgaacccaaatgtccaacagtgatagactggattgagaaaatgttgcacatatacaccatggaatacaatgcagccataaaaaatgatgagttcatgtcctttgtaggaacatggatgaagctggaaaccatcattctcagcaaactatcgcaaggacaaaaaaccaaacaccgcatgttatcactcataggtgggaattgaacaatgagaacacatggacacaggaaggggaacatcacacactggggactgttgtggggtggggggaggggggagggatagcattaggagatacacctaatgttaaatgacaagttaatgggtgcagcacaccaacatggcacatgtatatatatgtaacaaacctgcacgttgtgcacatgtaccctaaaacttaaagcataataaaaaaaaaaaactgggcacatgttactaaatagagggaatgactacaatcacccaaatcatttaaaaccgaactctttacattaaaattctgagttcgcataaactggtatgttgcatttatatgcactcccattcaatttatgcatgattaatttgcgtgttttggagcaaagaaatgaaattaatacttgtttttaatatacatgtccaaatatcaaaagccacaatttaagccagctgccaaatactgaaagactggtgtacaaactaacaattcttctcagctaaacattagtaatgttataaatagtaacattagttcacagcaacacaaatgccaactttttaacacccctatggctaaatatacagaaaagtatacataattagatagactatctacagatttatttaccatgctatatttattacccattcctgcagagtatttacgtttaactctgtgaagcaaatatccccacaataattttttcctccacattttaaaaatattttactatgaacaatgtggattctatttgtccaaaaaaagggaagagctgggcatggtggctcacgcctgtaatcccagcactttgggaggctgaggagggtggatcacttgaggtcaggggttcaaaaccagcctggccaacatggtgaaaccctgttcctactaaaaatacagaaaagttagccaggcatggtggcagacacctgtaattccagctattcgggagactgaggcaggagaatcccttgaacccgggaagtagaaattgcagtgaggggagatcacgccactgtactacagcctgggtgacagagtgagactctgtcaaaaaaaaaaaaaaaaaggaagaaatgacagcaccatgcatgtaaaaatgcattctttttaaacatcaaaataatcttggacagcgctggagagcatgtggagaaataggaacacttttacactgttggtgggactgtaaactagttcaaccattgtggacgtcagtgtggcgatttctcagggacctagaatgagaaataccgtttgacccagccatcccattactgggtatatacccaaaggaatataaatcatgctgctataaagacacatgcacacatatgtttactgcagcactactcacaatagcaaagacttggaaccaacccaaatgtccaacaatgatagactggattaagaaaatgtggcacatatacaccatggaatacaatgcagccataaaaaatgatgagttcatgtcctttgcagggacatggatgaagctggacaccatcattctcagcaaactatcgcaaggacaaaaaaccaaacaccgcatgttctcactcataggtgggaattgaacaatgagaacactcggacacaggaaggggaacatcacacactggggcctgttgtggggtggggggaggggggagggatagcattaggagatatacctaatgtaaatgacgagttaatgggtgcagcacaccaacatggcacatgtatacatatgtaacaaacctgcacgttgtgcacatgtaccctagaacttaaagtataataaatatatatatataaaatcatcttggaatgtatacaaaattattttaaacaggaatgagttttattcaggtctaccttgcttcaacctccctcctttttgaactggagccccatcctctccagagtctccagggcttctccactcctgggcacctgtcctttagccccttctcaccacactctgccactgtcaacccgtctttactttcccggtaaggccacagtctcctgaagtccagccttaggcaaaggtgacagaggaaaggagaggttaaggtcgctggagttggagaggtcaatgaagagcgagattcaggtgttgaatggctgcctacctggacaaataccactaaaaaatgatcataaacaaaccaatgagcaaatggaaaacagatgtaagatcgtccaagataagtggaagtgcccagggtcttggtagatcacagacgaaagggatacagaatgataaagcataaaatttgggagctggattaattgatcacaaagacaccatctattgctaacatccttttgttagttgatgtattattctagctgggccgtaaacacatctcaggaatcccactgttaatctatatcttcatcagactgcccagataggtctacttcatacctttcctgccctcctgaaatccccagtcagctcctctccatctcagcagaaaagctggcttccttctttactaagaaaaatcaaggtcatcagaaaaaagatttcctcgcacattctcctttccatctcagctcttatgtttcttctcttcctttcttcctatttgagaaaaatccttcctaacttctaagattaaatcctctgcctttgatccccttttcttaggcatattagattgcctctgtaatctactagcttatacgcttattaaccatgtgcccaatgctcagtttcctcagctgtaaaatggagtataatgcccaccgtgcaaggcagttataagatttaaatacaacaacatattaaagcacctgccacagagcagggtgcataacaaaagtgctattattattaccctctaagccttgtctccctcaatggctatgcctgctttctctcgcattagttaaaaattcacttagtgctacctttctaaaaggcgttttagccactggtactataacaacgaacaaaatcaagggaaagatggctcacccttgtgaagtttacagcctagtgggcagggacaggaataaaatacttaagtcaggtgataagcgccatggagttacaacttataaaagagtgtcctgggaggtctcacttaaaagatgacatgtgaacaaagacccaaaagaggagaaagaccaagcaggtatttggagaagagcactcctacgtgagaggacgctgcagtctcctggagggcttgagcttgaggaatgaggagggtgtgtgtttggtgctgggggctgggggagcaggtcaggtttggcagggccttgtaggttactgcaaggaattcaatacttactctagtgaataataaaagagagggggaccctggtggattttgtgcagtggcattatccaacttaagctttattaggatcactttagacactggatgagaacagactcaaggtcaaggaaggagaagggagatgagttcggagactttcaataattcaggagaaagttgatagttgcatagatgtgagaagtagttggattatggctatatttttcaagaagataaaataccaaaaaggttttctgatggatctaatgatcagtgcagagaaagagaggagtcaaagttactcccaaggactaggcccccagaaaccagaaaaatggagcagctctgtattgagataagcaagactgcagggtcatagctttatctctcccccaccactgcttcctgccccctgtggtcaaccgaccaaaggtcttcctcactttaagaaaagaaagcatgttagctttctgctgtcctaatctctcttaatgctcgacactaaatttcttgaacaattgctctgaatccagggtcttcactttctcaagggctccgcccccacccccaccccattccactacagataactctgcttccaaagagcactcccgcagggcaaccagcatactctagtcatccaggccagtagctgcaattctgtgctgcagcatttggcactgcccattattacctccttcctcaaattctctccatggtgggagatctaacatcctgatttacatgtgatggctgtgatcattccttccatagcctcctctttctctttcattgtctcctcctttttcttctcttctctcaaacacagcatcctctgaattctgtcccttgtccccctgaagctacactgccaagaccttacactcatagtctttatgactgtttatagggtctctagcacccagttcagtgactgagacattgttaattgaacaaatgaatgaatttatcattccatcaagtactgtattcctatatttagtttccacctgtctcccaagctccagctttagatccacaaccacgagctacacattccagttagaagtcatcctgccctacgaagttcaccaagccaaaaccaaacactccatcttaaccatccctccacaaagcaagctgcgttattttaactgccctacttattttaagggtatcatgatccccaaataagaactttcacctcttcaagcctaggatatctactagagtctccctctgccctctacaattcattctacaatgccaccagcttaattttctaaaacactattgtgcccatgtcactcatctaataaataatatttattggctccacataaccttcagaagttaagagagaagaagggagagagagcaaaagaatactagctagggcctgattttggctatttctattttccttttaaatatgttttctactaggtacattttcccctttgaaattcttagattaccccacctccagttccttgcctaggcaaagtacagtacaactcttcaaccagatattaaacatcttcaaaaatccagcccctattagcctgttcaatcttattccctaatacagcaagaatcacttcttcctttcagatggtcttgccatccctcaaacaagcattttacattcttacctccatatcactgcttacacaattccctctctggttgttctctcctccatcccctcttctctactctatgttaattgcccatcaaggtcttgctggaatcctacctcgccccagaagcctttcacatacattctaaccaagagtggtttgcagcattcctcccccgaacaccctgcaatttgctgtccttaccactcctgtgtggctcatcacagtgattctaaaaatgtgatcctgaaagcagcagcagcagcagcatcattttgttaaaatgcaaattttggggacccatcccagacctactgattcagaatctctagaggtagatagagcccacctccctgtaatttcacaagctccccaggtaaggctatgcacgctaaagtttaaaaactagtgacatgaaataccgccttacgttgtttgatcttgtcaactaaataatatgcaaaacaccaaatacggtatttagcatatagctatccctcaagaaacttgagttttgcaatactgtttcaagtagtttcatcgcaatatacatcaagtgaattttacctctacacctaattttaaaaaacaaaagtaaaaacaaaatgcctttacgctaaacaatgaaaatactttgttttttaacgtgaaccaagaaaataagccctgtcatagtggctcatccctgtaatcccaacagtttgggaggctgaggtgggaggatcctttgaggccaggagtttgagaccaacctgggcaacatagggagggtctgtctctcaaaaaataaaacaattagcccggagtggtggtgtggacttgcagtcccagctacttagaaggctgaggtgggaggattgcttgatcccaggaatttgaggttgcagtgaactaagattgtgccactgcattcagccctggcccagagtgacaccttgtctcaaaaaacagacaaaaaaaaaaaaaaagaaatgaaattaatattgttttaatcaagagcttgtttaaaatcatttaatttaatattaaatgaataacaaaaataaatgtttttatttagtaataaatcatttaatattaaatagcttaatcttattaattggatgagaatcttcttttacatttcctttacatttcaactttggaaatatagttgagttttcagattacaccttcatggtgaatacaggagaagatagctaaataaaaattcctgccaagagaagagtagaccttaattttaatcaatttgcatgttgcagaagataaaaagtagagccacaccaagctgaaccagatttaacattatgctttgaagaaacccagtaataatgaattacgcacttatttcataggtccgtcctgcttgttttggctctttagaaacctatatttcagaaaggttaaattaattaagcaaagaatcttcttttgtaagaactttcttacaaaagaagagcccaaaatgaaaatgttgtctcctacataaaaaggaaaataatgattaacataaaaaggtcttggaatagtataatatgctccatttatcccccatatcaacaaactttttcttcatgtctattgcaaacagaatacagtggtagctgctatgatagatcttgacgtatttttatatatttagcgtctttagagttttattgccaaaatgtccagggttccatacaagtacattctttttaatataattttctaataaacagaaatactggagagaaatatgccaaaatattatcagggattcctctgataattcctctgagtgaagattttacatgttctttttactctctatttactgttcttgtaatattcaatttttttaatgagcctacattaagttttaaaatctaaaaataattttaggaccatatttttgttttatgcatgcattagtacagtaacttacttctccacttaggaggatactgcttttgcgtcttttttttcatatatcagtttgtttaatccacacaacaaccctatgaaattggtaaaatcattattcccattttacagataggaaaactgagtcacagagaaatttagtacattctacacagaattcaaacacatgaagattaacattagagtttgctcaagtcacccaccaaaaggctgccacccaggctggcaacttacatcctgccttttggcaaatcccaagactagttaattacctctttttgagaatgcatacacagaaacacaacaataagcctgtgtgacactgggaaatgattgattttccttattttgtattgtatcttgacaactcagaagaaaacatgcaaaacgtaatatataaaaattttagtatgcatttttaatagtgtttccaaaccaaaagaactctaagagaagatggcctccttaagacaagaggcaatagccaaaagagaagaaaagattgaaatgaggacacaaatgaaaagaaagaatacaaggaagcctaagatgcaagaggaaagctggaggcaatacagaacacaatcgacttgtggaaaataatacctatgctgtgaaagacaaacatgatcacaaccagatgcaatttcaaaagacggatacaaaaataaataaggaaaaggtgatagagagggaacatacagcacagagatccaaactaagtaggaagaaattcaatagtaaggaacagaaccaaaaataaaaatagtaaagataaatattcacatgtggacaaaaacctgctcccaggagcaaaactacagtgagtactaagcaaaataactgaaaacaaaccctatatctatgcctaaaaaagtaatttccattattttcccaaactcatagcactaaccagacggaaaatcaggttaactacaaagtaatagatatcaaattagccctaagcctctctttcacaatattaaacaccattagcctatgaaccatctaagtttggtagcaaaagtttatgataaaatccttgtattccctgacaaattattgttcatttaaaaaaggcaaaagaaacattttaagcaatgtgaagcctcataaaacactgcacgtgtataacattctcataaaaatctattccaagtatacattccagctaagtgaataaaaactcaaaataaagaactcaatataatagagcaggaaatgcctaatttcatgtaatgaccaatttaatgcaaaaggctaaaagcatccttgaaaaacaatgagttgtacttaatatcttcacattttaatttaaaacaaaaaataagaagcatataatattaaattgatatcagataatataatgtatttttaatctatagcatcaaattgaattaacaaacactggaaggatgaggtcagtgtaggagaaataaaatttaacttgactcttttttatgtaatggggacattaaaggattccttttttaattaatttgcataattagagaactacaggtttaagtatatattcaaattggatttttgaaaacagtctatatagaaaaacaaagaaaacactaaagaaagtagaataaataaaatgagaagagatcaaacacatcatttatggctgtaaaaccaaatggtttaaattcctcctttaaaagaaacctcttacattgggttcaaaaagtaaatcttactatatatgctgctttcaagtgatacagcaaaaacaaatcaagacaaattatagaaagaaaaggaaaatcatacataattgagcaaacacaaagtaaaacaaacaaaacaccttatgaaaccagatgtaattcttaggaaaagtcattacctgaaacagagtgcttatattaataaaaatcaaaatctactgtgtataactgttaaaacttttatgcggcaaatattgcatcacagacacagaacacacacacagacatacacacacatgcacatacacgtgtgcaacaaaaacacaaattataacagcagattaaaaagctattcttatctgatatttccaaataaaatttaaaataattttttcagatcctaaaacaaattcctgcttgatatttttattgaaattccatattaatatgggaataatattactaaattttcctattcagaaacatgagatatttttgcattaattcaggcctttagtatgtcccttgttaggttttaattttttcttcatataagtcctgcagatttcttattacattaatttctagatattttacacttattattattaagaatatctgttttcttttctttttccttttttttttttttttttttttttttgagacagagtctcactctgacacccaggctggagtgcagaagcatgagctcagctcgctacaaccaccacctcctgggttcaagtgattcttgtacctcagcctccctagtagctgggattataggtgcccagctaattattttgtatttttagtagaggcagggttttgccatattggccagactggtctcgaactcctgacctcaggcgatctgcctgccttggcctcccaaagtgctgggattacaggtgtgagccaccatgcctggccaagggtatcttttttcaaatatattttgtaattgattgtttttcttggctcacaaaaatactattgatttgggtatatttattttgtatccagccacattgctgaattgttattgttctaatatatctttagttgattctctaagtttttgaggtatcatctgtaaatgatgacaaggttgtccctgtcatcttgtaactcttttttacttatttatttatttatttatttattttttttgagacaaagtcttgctctgttgcccaggctggaatacagtggtaccagcatagctcactgcagcctcaaactcctgggctcaagcaatcttcctacctcagcctcctgagaagctaagactacaggtgcataccactatatctggttaattttttaaaattgtttttagagacagggtctttctatgttgcccaggctggtcttgaactcctggcctcaagccatcctcccaccttggcctcccaaaacactggaattacagacatgagccactgtgcctggccctcatcctcttataattcttgtttcttttatgtcttgcctttattcaatggctaacatttccattacattatatattattattggttattatctgattcctgacaccttgatatcatccctcactttaaaaagaacatgcattaattaggatgtttgcaactgcaagtaaaaaaaaacacacaactgagagtggcttaaacaatgtggaaattgtattatctatataatatgaagactggagtcaggccagttccagggttgattaattcagatgctcaataatgtagggacctgatacgtttattctgtgattctcctggctttcccctcatggttgtcagatggctggagcaaacctaagtatcacagtctttagataatatccaagtccaggatagggaagatatctttttacatatttacttgtaaaagaaaggaaagccttcccaggaacccccagtgaggcttcctctggccttcttattggacaggttgtgttgcatgacttgcttaagccaatcatcaacaaaaagaatggaatcccaatgactggcttaatctattctacctcccccatgctggggaagtggaggtcaacttcctctgagaatgtggaaaggtaaacaccaaaacacatccagagctctgtgagaaagaaaaaggatggggatgactgccgggtagggaaccaacagtgtgcaccacagagagtctctggtgtttaaaggataggtacagggatgactattggttttagacatattatcaagttaagaaagaatgtccttaatcctagtctattaaaaatagtttttgctttgttttttaatcaaaaataactgctaagttgtaccccatacctttttgacatccattgaaatgatcccataattaatgtcctttggtctactaatatgttgtattaatagacttcctaagacagaaataagggggcttacatagcattttctgtgttttcagttccatactgttaattagcaatttttagggtttttcatacaaagcaagaaacacacattattgcttattaataaataatacttcacatataaaaagtttccagatcctaagccagaaaaattgaagagggagaaatgaatcagagggtgacaggcaagaaagacagacagaacaactcagacatgaagtgatatggcttgttctggagtgggggcagtagggcaggaaagcatggaaggaacacaaagcttacttctaagacacaacacatgcagacttaatctatatcaatattttacatcaatggcattctcatcatagcattgggaatcactgagaattgctttaagttatttcagctccatgaaactcccactcctgaccttccctccatctggtccacttccctccatcttccccactcctatacagctagccatctaccctggtgctctgacaatactctttatctatttttacatctgtttttaccactacactttgaacttcttggaggcagaacctaataccttgtaaacctacatatacccagttgcttgcactgcaccagattcagagtaggctctcaaattgtttgcaagagtgatgctgatgttgaatgtattgaacatttattgtgtatttgcaacatggcaggcactgtcataaatacttaacataaaatatgtctttttaattccagcaatagtcctatgtgtactgttattgttacctccatttcataggtgtagaaaagtgtagggattttacataacttgtcacaagctgcaaagctagtaagctatagcaccaagattcaaatccagagagtccaacccctgatgtaatcgtaagtcattttccttcctgtgactttgaaaacaaatgagataagccagaagctcacaaatgagcccaaattatttcatggtcaccttttatacacgttactctctgaggtgccaaaaacgttctggctaaatgctctgccaaggtgtcatctggggaatcctaaccagacactagaggctatcatcattcatttacatgccttgattttcaaaagactgagaacaggttgaagatttgaacattgcagcacaaatctgcatcaaacagacagtgtatctacctttcatccccatccccagcctcacacagagccagtgcatttgcccccttggatcatttggcgaggctgtcaagaaccttaacacccctcaaaaagaatgaaatcaagcacagcggcatctgtgccagttcctctctttttttattactgcccccaaagcctataaaagcttggaatctattaattctttctttatagctggaatgtctactcattattatctgagaaaggaagagtcaatttaatacatttgatttcaaagattctatccagtgaagtcatagttcattgcagtcatatcagctgattactgtaaagtgcaacagtctgcatttgtaaaggaaaaaagcacccaagcttagtaggaggtacacagtagagaacgtgggagacatcgggatagcatttgctgctgaactgcattttgcagacctgaccaccccttccactttgctctgttccaggaatgccatttaactgtcatgggccttatccccctatagctgtaggataaccacaagagccagtgagcactcactaaagctaatcaatatttagaagctaaaaatgaaacgaagaaacacacaaatgcaagcataggcaggggaggcttttaccctgtgcctccaagacctatgtctaagctaatacatgcaactgcttctgggatttatggctgcatttattcaaaccctgtagcctctgaagaacagctcatcctctccttccatattagattggaccagccagaggcaggcccttctctgccaacagtcagggaggtgagagtaaatctgccaccatgtagattccatcattctcaactcctatcaggtaactgaaatccacctataatctgtcacccatgccaaggccatgtttgaacttcatttgatgccctgtgttagaaagaatctttcttgctcacatgcttcttaaaagcagaattagatggctccagatgacttaaacaaaaatctgagggcctacaatgtgccactaatgacaggtgctgaggaaatccggggagttgataaccagctaatcagctagctagctatccacgccatgaggcggcaaaatgtcttttcccatactttcctgttagccactggggaagctgccccacagacagtgctttttagagtgcatagagcagacatgggaatataactgctgcacctgcacagtgacttgtcgccaataaaaattcacctgtgtctcatttattgagcctgtacttataaagaggtttatagtctgttgtcttaatgaaccactttaaagtctaaaggggagatagaagagcaatgagtagaggccatttcaccatctcagggccctctcagtttcttccccttgcatagcacctaggaggtttctaacaatgcaagcattaagacccacagctgcctaggacacaggtctttccatttcccaggggtcctgcactttgttaaggtttggtttcccagaatcacaatccctcctcttaaaggctaaaaacacatgaaattgtattttcacaactgcatagcaagtcgcctgtccactcagttatagtggggatgcaggatccaaacacgatgactcccagaagacacgtcctggtgaattacgtgttaggcacactgcagaatgcaaatgtaaacaagtcacttgagaaagtgtcttaagttcctgcccttaagaagcttataatttaaatacaccaatggcttgtggacaaatcattctgaagcaaaacagagatgcaggtgataaaaagtgtgaacagagcaaggcagaaaaacaaaagtaaggattaacattaaccaggggacctagatgatgaaccaaacctccctgatatgtttttcataagaaagtgtcttagtaacaggggttttgtggctcgatcaggttaacaaaaggaagagtgtgtgggtttccagccctgtccaaccaccacttgtggtgggatcagaatttggactccacgctccaggttcaaccccagcctcattccaaccctgtcaagcacatttctaatcaaagtttcagagtcctatgtccctccaaaatcagaagtacagttccccagagagcagacagtagttctaccattagaaaagcattcccactatttatttagaaaatgggaagcagcaatagcacaatgcttacatttcatgttttaaaatcggactagccaggcacagtggctcacgcctgtaatcccagcactttgggaggccgaggcaggcggatcacaaggtcaggagatcgaaaccatcctggctaacatggtgaaaccctgtctctactaaaaattcaaaaaattagctgggcatggtggtggatgcctatagtcccagctacttgggaggctgaggcaggagaatggcatgaacccgggaggcggagcttgcagtgagctgagatggtgccactgcactccagcctgggtgacagagcaagactctgtctcaaaaaaaaaaaaagaaaaagaaaaaaaattggaccaaactaggttcaaaaactggctccatcattttcaataaatcacttaacctaagcctcactttccacatctataaaattagaatagtatatatcacaagatgtggctgcattaataagactagacttttattaaaataattaacccagtgcttgacacgtggccagtggtcacaaagtatattagctataaatattggtattaaattttgttctttctcatctcccactgcttcaatcgactagcctaaatgcatgtgtattactattattattatataaattacactccagatcagtgtcaggtacatccacatgttggtgtgacctgagactctatcctagccacatttcagtatagttcttggaactgcaaagcttaggaccaaatcctggaccacaaattcctcgctgaaagtcttgccctaaccaaggccagcatgtgccactggcctgtgccacccacccacctggccctcactcaacacctagcacacacagccctcagaagctcagcatgtgctcagtttccactggtttcatgaacattctactcttgtctcccagctgctccgagggaagggccatactctccccattactcaacctcactgtggcacatggtagaagcctgcacagttttcctgtacataatatgacagtgtccatgatttttctctccctctgtttttatgatagccaagaccatgctaggctgggcgaatgaccacaatgattactggagctgagcctccacccagttctgcagactcttaagccctcttcctttctccacatttcctagagggtattctcaaggccatggtggctactgcagtttccagcaactcattcctccttgattactgcccctttccttccctcgccatcatagtaatggtgagtaacagtaacagtaaacataggaacatttttctactctattctaattttttttcaaaatctgattgcaacccattaaactcactccacaacccattacaatttgaaaaacacctggtatctgtgattccaggaagatgacatgctaaaaggagctctgatcatttgagaaaaggaattccccaactttgtgggaacaaaagagctgagctctaggggtaacagtggaggaaataaagtgtatggaggtggaatggggtggtagttactgatactgtagaaaaatagggaatggttagatcatagaaggtcttgctaagttaaggagtttagcctatgctgtaagtcacgagcaggcattcatttcattaataaatggatacaaggatacacaaaacatagcttgcctttgtggagcttatagtctcttctgcaggaagagggtgtggagggagacaaccaaataatttgttaacaaatgaacaaatggcacattatgataggggcttgggaagagtttcaggcagcaggaacagtgtgcataacagcatagaggtgagaaaagcatggaacattaagaaaacagaaagagttagtaaggaatggttttagacaggaatagctctcccagtcctggccccaaagtcctttctctacaggaggaataagttatttgagctaccttatcttgaaggaaatgattatcgttatgtttgtaaaatatgacaagcgcttcagaataaagaatgacacgaaaatacgtagaaagcagaagataggatcagagaacccatctatctctccaggtgttgaagagatggccttcctagaaatatcacagagacctgactaggaaatttgccttcacggtgtgtggagctggtcaactatgaagcagtgtctcaggcatattatactttaacacctttattgaggtacttacataccataaaattcactcaggttaccaccatccaatattgaagcattttcatcacccaaaaagatccctccggcccatttacaggcactccctgttttcctctccaccctagccaaccagtaatctactttctacctccgtagatttgcattttctagacatttcatatatacagaatcatacaatatgcaatcattgtgtctggcttctttcacttagcataacattttgaggttcatgcatgctgcagcctgattcagtacttccttcatttttattgcctaatagtattctattgtatgaaaacactacactttgtttacctatccatcagttgatagacatttgggtggtttccatttttgggccactgtgaatgatgctcctcatgaacactcctgtacaagtttctgtgtggacctatgttttcatttctcttgggtacatacgcagaagtggacttgctaggtcgtgtagtaagtttaactttttcagaaatagccaaactgtttttcaaagtggctgagttatttcatagacccaccggcaatgtatgagagttccagtttctgcatattcttaggtatatttttaaattcagatttacatgtattgtggaggaagcatcccctggataaaggtttgactttatcaagtctgtgaagtgcagagttcacatgatctcacaacttatgcacattccaagtttcacttaaatgtacttaaaaaattttgagagctgtccatttgaaaacatggttgaaataattcagtataaaaatgcgatactaaacaaccaagtaaatataatgatcatagaaattttaaccagaatatttgtcaaaggggagttattaaggaaccatgcaactcaaataaaaatgttccttgcaaactaaacaaaatctccacagggacaaaatcctgattgtgaatcctgcaaaccagcagcaacttatagaaggcagcagccacacggaggaaacaggaaagaaggacaggggattatttttttaaatctgatgcaacttgcattgtatcaagtgatgagatacaagagaccttgcttccagaaaagaaaagaaacagacctggcctcaaagggacagagaacttaatagtcacaggaatgtccctgctgctttgaatacccccaggtactctttgcaaacatacacactaattaaagggggttgggggactgaactggcaagagctttggttcagagatcacagagggacacccagccttcaaaccccttcaacagactctttcaatctagaaagcaaaccctgtatctggggctcggatctctgtatctctctaagatttattttaagtatcatacatatttcactgaatgtctacgatttcctctcttcatagagaggcttcctcctgaagaaggaccctttttgtttccagtgatgaggacctataataattatccactggcactttttctggtgcaatcagtgaaatggaggtttaggtacccagctggtcaggttccagcagatttcccatgctaattttcagtcactcaaagaaaacaaaggaaaaactaagattggtttaccatgattttaaagaaatactgttcctcttccctttccccctcccccaaaatgtgtaaacttctatatttcacacttttacatctgttcttctcccaaaataaaagctgtttatattcaagaaatgatggctacaataccagcacaagttacatctttaaaatactcccagagagaatatacatattgttcagacaacagagtgtctgtgcaatgttctttccctgaatagcatctgggtattggctctagaaagcactacagcgctttatttgtttatttgtttgcatggaaagaaaactgagtactctctaactggtgctggagctaccaatttaaagaagacagaagaagcagaggccttttaggaagagcaaatgcttagttttgactctgtcaaccattccagagtaagacaccagcaacagaaccacctggttccactgctacccagagtatccatgctctgaaagtcttggagctcaattgaaaaatcgcagcactcccaaactcaaagggccctttcaaccacgccaattgcaacatatattatctcaagcgttggaggaatcagataaacaggctgtgaaaaagccatttcaaatttgtagctttcttagacagagtctatgatttcaccaccactagaaaggaaactgctccaaacttagttccagacggaagttttcaaatgatgtcattcattgtcccatctagagcagttagtattcccgatttaaaggcttgaacagggcccagcacactggctcctacctgtaatcccagcacttttgggaggctgagcccaagagtttgagaccacgctgggcaacatagggagaccccccatctctacaaaaaaaaaaaatttcaaaaaattagctgggtgtggtagcacacacctgtagtcccagctcaagaggctgaagtgggaggatcacttgtacccagaagtttgaggctacagtgagccatgattgagccactgcactccagcctgggcaacagagcaagaccctgcctcaaaaaataaaataaaaataaaatgcttgaacaattccctgatactttaatgatattaacacctcttctgagaaaactggagctatccctctaagtgtcaatactgggaaaaacctaataatctttaaccaggtattttttatatctagtctgatgatgattgtctaaccatcggtttttccttcaaaatagttcttctatgaggggaggtcttcaaatttacatttttaaaagcattttccccagcaatgagtataaaattttcatgcacgctcactatcagttgtatataaagttgctttaacaaccatacttgccatcaacttttcctccatataaacagacatgcaatataagcaatgtgcttatctaagaactgtggattaaatagcaacatgggacacttttgtggctaggtaagagatgcttacaagttgttgttacaaagaaagtctgtgggatttcccagtaaggaaatcttcaacctgctgtctagattccaaatatacattccatttcccaggtctcaaaaaataaataactcgaagattttaggcttctaacagaagtagggctgaaagaatttgtgaatatggattctttctttcagtttccaagcaaatgtcagcacctcctggggcttcaaactcaatccctacaggcctatagggaaaaacaggaaatcgacatcagaaggatgcatcttgttgatcaagggagtggggcttttctgcaccttgaataaacttgctaaaaaaaaaaaaaaaaagaaaaagacatgtcaatgcaaagaacaatgcaaagtacagaattatcaattgaaagttgtagacttttcaatttcaagtatctttgagtcttacaaacaattcaaatgcaaatattagtaaaaaaattttaacttccatactcctaagaatgtgtactgtccacaatttctctgaggtcatatgccttatgaaaaagttgcacttaccataaataatttactatttcctattctgcaacattttcaggcatacccaaatttccatgaatatattttgcttttcttttttattttattttattttattgagatatggtctcgccatgttgcccaggctgatttcacactcctgggctcaagtgaagcttccaccttggcctcccaaagtgctgggattacaggcatgagccaccatgcccagccaaggaaactatcttttaaacatttaggccagtggttctcagactcccacatgcttctgaattactaggagggcttcttaacgcaaaagttgctggtccccatcctaagagtttctgattcaatagttgagcgagcccaggcatggtggctcacgcctgtaatcctagcactttgagaggctgaggcaggcagatcccttgagcttaggaatccgagatcacgtaggaaagcccttctctataaaaaatacaaaaatcagtcaggtatggtggcacatgcctgtagtacttgctaccccaggagctgagatgagagaatcacctgagaaccggaggtcgaagctgcagtgagctgagatcgcaccactggactccagcctgggtgacagagtgagaccctgtctccaaaaaaaaaaaaaaaaagttgagagaggcagggcctaacagaggatcctgaagctgctggtccaaggatcccactttgagaactgctgacttagggagttaaactgtcaactagcttttagaaaatcacaacatgcaggataacatttactgagaatctaccaactgcagaactctctactacctactgagtaagccgcacaggtccttgctccaaacaccatctaaattggcaacacagggtatacgtgcgaggggacaatacacagacacatatccaaaacagcaagaagtagttaatacagtcaaactaaagatgtttcatttctccagtgcatttctttatgatgtatcctacggtgcagttaaatctattactctcagatggacattactaaaccacaatgcgtagccattcttccttgcactatgccacttcatttcacttactaatggcagtttcatctgaagccagggcatgaaatgtagagagggacctcattttaaagcttatttatgttattcgtgttgtagcaactgtaaggatcagtgtgatgatcaacactcagatttcagtgataagttatcaagcagagtcatcgagtgcagatatgatctaattctgccatcaggctgaactgaaatgcacaaaaacagtccaacagaatctgaactctaactttcccatcattgtataggtttttaaagcatagctagcaccaactttcaaatgcatacttttctcatgaccctgtcctgagtttaagtgcatttgtatccagattataatcagagagggtatttaattagataatgtttgcaagtactttgaagatataaagtgctctataaatgctaaatattattattattgtttaaatacagtttgcaattactgcttacaacctgttccacccaccacactgctatcatttgattacaggcagctttaaaaaaaatacctagaggtagaaatgatgaaaccatattcatgtgaagccctggatttttaccctagacataaataatttataggcattttaaatggaggattaggttataaactgtagtaaatcaagaaaattgccctctgcaagaccaactaccataaagttgtgtcaattttaatagtttcttacttataaaccaggttgaaagtagattatagtccagaatacggagctttttactctggtggtttcctgttctatcttctattttctccattagaatcttaaaatatctacctatgtgaaaaactgaaagcacaacttaagattttgattttagcaattgtctggcagattaaggcttgagaatagtctctattctatcatggccgtagctcaccttgctatcttctatgatcatcacagagtcagctgtctccaattcttaaaaaactgaaacctttgagcctgattccacacatcctccaaacacacttgctggataattttccagaaagaatgacagtttaaatgtaaacaagccaagctcagtggctcacgccggtaatcccagcactttgggaagctgaggcgggcggatcacctgaggtcaggggtttgagaccagcctggccaacacagttaaaccttatctctactaaaaatacaaaaattagttgggcgtggtggcgagcgcctgtaatcccagctactcaggaggctgaggcgggagaatcgcctgaacccaggaggcagaggttgcagtgagcagagatcgccccactgcactccagcctgggtaacagagctagactccatctcaaacaaacaaataaataaataaataaacaaacaaacatcccctagatacactccacaagaatgtcactgttaatccccaaatagctaccatattaggtttttaaggttttaggcaagaaaaaaaaaaaaacacgttataatctgacattggtcatcttacaaaacaaagttacaaggaagaaataccttggaaatagctcttaaaacaccactatgctcatgaaagacaacttgtgccctaaaccaaaggcttctgggaagtctgtgagcctcagggtgataatacaacagataattctgatgtcatgacaaggtccataaatcaaatgatggctatgtgagtcactattggcagtggctttgggccagtcagtcgtaagctcagccacttagtagctctacgatctttggtaaactaattgatttttcagagtcttatgtgttcatttataaatgctacacacctacagcacaagaaattggaagccaatctggcaatatctagagccttagagatcattcatacactttcattctaaattcaatttctaaggagttatcctaaggaaacagagatgcacacaaagacttatatataaggatgtttattgaagcactatttatcagttggaaagttagaaataacctcaagcttcatcaacaggaactggttaaatatattatgatccatctccacaacaaaatgctaagcagtctaaaaacatgattagaaagttgagcactgactgaatattttattacacgttaaattttttaggcatgataatactattatggttatgtattttttaagtacacaaactactgaaatatttataaatgaaataatatgctactttaaaataatatgggggagaaggtgggtaggagtacagatgaaacaggattcattatgggggataattgttcagtagagagattattaacccttttatctactttttaataagagttttattgagctttaattcacattccataagacttactcttttgaagtgtacaagtgacttttagtatgtttcacagagttgtacaaacatctgcactatctaatttgggacgttagcagtcactccctgccagcaagcattagtctaccttctatctctatggatttgcttattccagacattttatataaatggaatcatacaaccatgtgtcttctcgtgtttggcttttttcacatagcataatgttcatccatgttgcagtgtgtatcagcacttccttttattgtagaataaatattccattgtaaggatatactatgctacattttgtttattcattcattggttgatggacacttgggttgtctcctatttgaggttactataaatattcatgtacacttttttttttttttttttgcatgaatacgtccttagttctcttgggcatatacttaggagtgaaattcctgggtcacatggtaactctgtatttagcattttgagaaactgtcaaactgttttccaaaatggctgtaccattttacattcctatcagtaatataggagcattccaatattctgtctacttattattattatactttgagttccgggatacatgtacagaacgtgcaggtttgttacataggtatacatgtgccatggtggtttgctgcacccatcaacccatcatatacattaggtatttctcctaatgctatccctcccctagccccccatttactgacaagccccggtgtgtgttattcccctccctgtgtacatatgttctcattgttcaactcccacttatgagtaagaacatacagtgtttggttttctgttcttgtgttagtttgctgagaatgatggtttccagcttcacccatgtccctgcaaaggacatgaactcatccttttttatggctgtgtagcattccatggtgtatatgtgccacattttctttatccagtctatcattgatgggcatttgggttggttccaagtctttgctattgtgaacagtgccataataaacatacatgtgcatgtgcctttacagtagaatgaattataatcctttgggtatatacccagtaatgggattgttgggtcaaatggtatttctggttctagatctttgaggaatcgccacaccgtcttccacaatggttgaactaatttacactcccaacagtgtaaaagcgttcctatttctccatgtcctccccagcatctgttgtttcctgtaatctgtctaccttttaagtttaaattccccatgaaaaagagttttaaaagttatgccatagaaaaagattaatagcatgagaaaaggctaattattaggtttaaaaaataggttacatataatatgtacaatattatctccactttaaaaaaaatctatttatccatgcataggaaaaaactactaagccatacaccaaagtgcatatgtggttatcattaggaatcataagtttaaataatttgagaattctttttattttttctccattttccaaattttctgcactgaccatgcagaaaccattgcaatgaccattgcttttacaatgagaaccagaaaagccttttaaaaattaaacaaaatttttgggaggccaaggagggtggatcacctgaggtcacaagttcgagaccagcctggccaacatggtgaaaccccgtctctactataagtataaaaattagccaggtgtagtggtgggcacctgtaatcccagctacttgggaggctgaggcaagagaattgcttgaacccaggagacggaggttgcagtcagccaacacggtgccactgcactccagcctgggtgatgaagtgagactccgtctcaaacataaaaaaaaaattaaacaaatttttaacaactcagcaggcttagtctgctttctttcacagtctgcattttttgggccctggagccccaggagtcttcgtagcttcccactcaggttaagatacagcacatatttccagcttctacaggtggcctctttgcacatagaatcgtaacctttattttcaacatctgaagcattgctacttatctatattgattaacttagctgagttctcctctaccatctaattagatttggtttcttcacagtggagcacaggctatcttcagtgtgttccgtacatacaagcaactttataaccatctttgtatccatactttgttagactggtttttgtgttgtgggaatgactgattcactaagatgtccaggatgttggcaatccagttgagggacgtggtataacgggacccagcactgcattcgaatttcatccttggacaagacaagtaacttctctgaccccaaatttctacctacaaaagaggtaaattggatcaccaatcaccaagccctaggcagacagatagataagtagatatatagacaaagatatgcaaacacaatccccctttacttttcattttagccttaacatggttttatggctttatcctatttatgccttttatcagaaggtgccacaacttactttttggaggtatgaggtgtaataaataaataagatcccttttaaatgaatgaattaattgcattcacacaattgatatttattcaatcaacatttatcatgtgccagacacagttcaaagcaccaggaatgtggtgctgaacatgcaggcaagatccctattctcacaaaacttattaggctccagttgggacagccagatttttaaaaaattcagatagtcacgactgccttaaagataataaagcactgaattggacagtttcagggtggaagggagtgttactttacagatatattgcaaagaaagcctctctgtttagtagggagcctctaagagggccctcagtgacttctgccttctggtgttagttaatattcttgtgtagtccccttcgaaatgaatagggctgacttgggtagccaacagggtattgcagaaatgatggtgtgtgatttccaaggctaggtcataaaagacatagtggcttctgctctgctttcttgattcctctatctggtaaaagtgggcacgatgttatgaggatgctcaagcaaccaatggagccacctacgtggggaggaactgaggcctcctgccaacatccagcaccacataagtaaatcatcttggaaagagatcctccagctccagtcaagccttcagaagatagctcaccttgccaaaatcttcctgcaacctcaggagatacctcatgctaaaaccacccaggtaagccacttctgaattcctggcccacagaaactgtgagatataataaatggttattgttgtttaggccactaagcttgagggtagtctgctatgcagatacataagtaataatacaggcagcatctcaccttagacctaaataataagatggagccctccatgtgaaatttctgacacggagaactacaagaatgagcttggcatattcacaaaacagaaaaaaatcagtgtggctagagtgtagtaaaagacaagtgcaggctctcttctccatccaaccatgggtgtagaaaccatgccaatgttgtcttcagctcagccccagcaactagtagcacccaataatcaggtactgaatgaatatatacacaaacaaataaatgaatgaatgctggataccatgtgcatttcttcccctacagttaatcacatttcacagaatcacagaatactgggcctgaatttaccctgcacccaaacttgcaccttctaatacactaatcaaacaaatgtttgtaacatatgcaatgtattgttaaagtctacaaatttcctacttgatgcatactgccaaggttctaatttcactaactagagagacagcactttaaaatctagggttacttcagagtctaaatccgggtatccagcagcaacactgtaagggagtacccagcggaagtcacagtcagcccttcgtcctatcactcggtcttcaaaaactagaacaacactttaaattataaatcagaatctgacagctggaaaaaaatagctcatttaaaaattagaaagggatgttacgttcagtggcaattcccagctcattgaggtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccactcatcttacatgtgacaaaactgaagcttagagggcaaggtgtcagagccagctttatgacgctgggctctaactcccagctgtgtgcctcattaaacctcaccatctcccaaactctctctacccgctcactgccagctctgtcaagataaaaactcaacgttgtcttccagtgggccaccccagaagcacaccctttcccgcccatctattactgtttaatcaaaacagcagtcataagtattatccgattgttgaaataattgaaacacactccaaacacacacacacacacacacacacacacacacacacacacacatacgccttgcaattctaacccatggtattttaaatctctcaaaacttagaataagacaatggagagaacactttccttggcagaaaaattctagaaataggaatacctacccaggaccaggcatagtatttctcgtaattggtgcccccggaattgtactctatgtaattagcatccactggaattgtactctacataaaaagtgtccccaggagtcatgcaacctagactataatgtaattcatgatccctgaaattgtgccatggtcagcaacaggccccacctttctgaggtttctatactctctctacatagcaccacctccagcccttctaaaagggttgcacagtatatattttgttaattcaaaatttatttgttgaacgaacgcctgctgtgtaaagaaaactggtgaggatccctaagaaaatcaaacgttgcctctaaaaaggaattgtctagtagtgaatataatccaagacagaaagttctgagtgttatgaaagaggtgtgaggtcagttctgagacagtctatgagtgggagggacaacttgagagaaatcagagacttctgtggaaaaggtggtctgcgaatgttcagcgttggggcagtaggtacagaaaggagactaagacagagcgccccctacagagcatccatgggggaatgaaattgttccctgccgcaatgggggagtggtcgtcaaaactgcagagctcggtgggaggcccctctgaattgccgctggtcttaacatgctaaagagtttagttttcagtctgtagactaaggagacagagaaggccttgaataaaaacaaccagattgaaactgtgcgtttggaagactcacgtggctacagtgtacgagaaaccagtcagaagaaggctggtggtagagacacaggaggaggggaggtcctgttgcgggtgttgcccaggggacagtaactacagcacttgcagggaacagtggagacaaggggacccatatgataaacattaagggaagaattttaagttggggtgatataaaatgtgttttgagaaactgagggcacccccatgagacaaccaggacatgtaaaaaagagtggatagaatcatgtttctctaaagggaaataagcttccaaccagactggaaggaatcacaagcggaattcatccaacattttctacttaagtcctccctctctctccactagagaccttatatttatatgtgcagaataacatttcattcaaaaaatatcattaagattttcttagaattctcagcacactgctaacaaaccagtttaggccctgttctcagagagctacttcccccacagaaatgtaagaatcaatttgacattaaagcatctttcagactcaagttactccagattctatcaggaagggaatcagagactggttgtgctcagctgggcatggcggccatgattcaatcacaggagcgcctggctgggtggactttagaaccactatcactgagagaaggaatggcgtcgaaacaagaagggcacggaagattaattccagggcagagacacagaaagaagaaaggccgaacgggcaagactcgaaattataagatatcaaagagttttacagataagggggaaaaaaggaatatttcctgaaagaaatgtactgggtactctctcatcaacaaaatattacatgacctcctaagtagataattatgcaaacagcaaaccatgacttacactggcttttgtactaaagattactccagttaataatgaataatgaaaatgattatgcatatttctctgatgttctgataaataccagcacaccctactttttatgaggcaatgccattgtaaagaaaacacctgtttagtatctctgaaaaataaaaagaatatctaatgaaaaaattgccatgctgttatcattttgagatactgttatcaactcatgcaactttactaaaatctcattttagaccaaatttaattaagtgctctggagtaatgaactaataatgtttcgagatttctttgagccccatgagacctctcaccagaaagttttaaatactgggccattagtgtatcattttatgtgtccactctatctcccaagggaaaagataaaactttaggaaggcacagtcatgatcaatgtgtttgtatttgaataatcggtaatacataaagagagaaaactttttttaaaaaagaaggttttaatgaacaatgctgatagttgatactagtttagaaatatgttaatctccaaaaaacttcagggctgcacttacctcatatgtaatgaatgcttaatactgggggcgcaaagctcaattcaggccatcaaagaaacatacaaggtcacattggtacacaaaaggaaaaaggcagctaaggtctgtggaggtactgttaaaaagagtcggaaccttctgatatctttttctgaagattattttccttcttttcttagtcttcttttttttttcttaaacaagatgtcactctgtcactgaggctggagtgccgtgacacaatcacagcctcgacttctcaggctcaaactatcttcccacctcagtctcccaattagctgggaccacaggcacacaccaccacactgactttttttttttttttttagagatggagtctccctacattgcccatgatgatctgaaactcctggtttcaagcagtcctcccacttcggcctcccgaagtgctgggattacaggtgtgagccactgtgcccaggaaagataattttctattagataaaatcattgcaatcaaatgttgatggtatcaattttcccactaaattctacttaaccatgggatagcatatttgtacagtgctgtatggtttttaaagcattgccttaaatactttattgattttgaaaccagtatgtgagaaaggcaaacagttgtgatgattcttattaactatggttaaatgtcctacccaaagtcacagagtgaataagaggtggacatagaactggggagacagggttcattccactccattcattcaagcattcattcacgtactcattcatccaactaatggagactatggctccaaagatgaacaagatctagcctctgccctcaagaagtccacggtttagtaaagaagcagaaaggaaatcacacaccaagtaaaacatgagcatgaaaagtgtagcaaagggatgtatgcaaggctttcagatgaggtcaattcttaaatctgggtttcaatggagaaaggaatggctagggaatgagggctaaggggaaagacaagtgtagatcatctaattttgttcaaatacaaaagtgtatgtgagtcctggcagaagctgagagtatgaggtcagcagcagccaactcctggccttgaatgccttaccctgtgggccaagttaaggacagccaaggtgcttaggtccagaaatatgctaatctccaaaaagctttctgggctgagctcgcctcatatgtaataaagcacactggtggcaactttcatctcttttaatactgagatgtcttgaagcaagaatgactcaagccccaggtttgaatgagtaaattgtttgctgtagcctatgtatgtatacacacattttcatacacccacgtggatacggtttatatccataatactacacataatatatgtatccacatagataatacaaaacatacacacaactctataaacctcacatgcagagccatctgaataacatgtatgtttatactgaccccttgagacatgctctgatggacacaggttactcagagaggttacctgtgcaggacaaccatgtgtcctaggtgatttcagacagtcgtttgcctgcagagtaggcattgaaccagggctggacaagatgaattccaaaggtggcctagagctccatggtttcatgtatcacaagcttacttgcatgaagtagtttcgccattctcaataaataaaattccctgaccctggtgaaattattcctttctgctattcttttgtactcaggcagaaaatgtattattgatttctgattccaccacagaaagtgtgacttagagaaaagagcactgaatgaggagtcaggaaatctagattatttcctcaaaccacgctcctcgctgtcccctccccttgttactgtgtgaccttgaacaacttacttcacgcctctgggcttcagtttcccaagtgttcaatgaaaggagtggctgagtgttctacaattctctttccagctctgaatctataaaacaattccagcccatccctcaagatttagtttatctctgagctctaaaaatcagggctaaaactggattcaaagtacctattttctaaccaaagaagatcctgcttcactcacttttaaaccatgcaaatcttgcataatttaaatgatcagtgctgtcattggttgctctggtttaaattatgcattgttgctatttggggaaaatttagactgggtccggtctggaatcactggctgagaacaataagcccccaaagtgagaaggataaaggcctctctagacaggatctgcttttaatgctttgagcccagggtttacaaaaagagcattgactgtgtacattaaagagccaccgaaacagcgagggactggtaagtctgcagcaaattctcccagaagccactgaccttggctgcatttcaggggtcaggcattccccaggaggggctcagcaggcagactttaccaagggcttaggaacaaatgagacatctcatctagatgaggccacctctccaaatgtggcaaggtggagatgatctgccctctgatttgtggagattacctatgtggcctttggacccactccagcagacacacctcacccacaagactggtcaaagaccctggccctccaggatataactgtctccacatctgcatctaagtcttctagccagcagttcctggtccccaagctagctgttgccctctctgtttccacacctcccagcaggcagaaaaacagaagcagagccctaagctgatagcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatgaatgagctttggctgcccaactatcagaacagcccatttcaaacggcatctctgtttcttctcaactccttacttgccttgctgaaacctcatctcttagcccaacagattaagacgaagagagaaagacttattcaaagagatgtggaggaaaaggtttaattaaggagaccaaagagaaagtaccactttgatcacaaaggtagcactttaatatatcagtgcagatagcggcaatgtcagaagtactaggaatccaggtaaatggccccaagattcagcatcaatctaacaatgtattcctcaggagggcgtgtgaacttccatgcttcatccatcctggtgtctccctgtagagagccaccatgaattccttctcatccaccctccatacatcaagtatatgcactcgctttctttttaattttatttttggttcgggagaggaagaagcagtccttaaattggtgtccaatccttctcagacacccgctgctgccaccatccccacccctcacccccttccaggcaggcagcatctaattaaaatggcaagaaagctctgcccccttccccaaaggagtgtgttgggatcgggagttgggggtggggaagcgtcgaagcagcacttggattcctggtattctgatctcaaaacaacagcaaaatggattctatatcagtgatgtcttagtcaatacaatgaaacggcgtctgaggtaattcacgtgaaggtaaacgcaaaccagtggggctggggggagggaggtgctctacaaaggactggccacagacacggggaaaacacacacagacacacacacacacacactcgcacacactccagggagttccggtctgattgaggaaaagcagaaaacacatccctttcacctgcttaagttcagccataaaactgaaacgttacagccacaaagtcagaaagaacaggcagggctgagttaaagccataaataaaggtgagtggcagactggcatttaagggagcgctgagagggcgcccgggcgcgggaggtagaaaagggggagggggaggcagttgccatctacaagaccagcatagcaataactgcccccttggagcggcaggttcggcttcgcggggacagccagcctcacaatgtcatcttgcaggtagctggaaaacgtgaggggccagtgcctttattcacgctggcattctttttgcagaagggacagtcgggtctcgcgccttggcaccagacaactgcccggggcgtgtacacacacacacacacacacacacacacgcacacacgcctttcattttaatgctcttacaccggtataagatgaaactggcataagctctacgagccctcgggagagcctaagccacggccagaggaagacacgtaccgcacagcccctgccgtaggggctcagccaggagcacctcagcaaccccgaatcaaaacgggaatccaggttccctccccgacgcattctcccgctgctgtccccctgccccagccccagcccccagtccacgcaccgagcccattcaccctaacccaaaccactggaaagaaaccagaaaacgtcctgctcaccctcagagccgagagatctatttcatccaggcttcgagccggggagtcgctcgccatgtctacttcttcgctggagaaatggaccaaaaccaccccgaagcttttcccttggaaattccaccttggtctatttcactcgcgtcctcatgcgggtgtcgcgccagaggccccgggcccagcctcccccgcccaccccagccccacagcgccggatcccgatcctccgcgcgtcggtccgccgggtccgggagcccagcctgcgcggatctccaagccccgagcagcggtgcgtgtgggctgagcgccccgatcggctaagggcgctggggctgcgtgggtgtatttaaatgggacatgcttctttgcttgtgcgtggatggcggctgcattggctgttataat

SEQ ID NO: 968 - DNA, 210090 bp, Homo sapiens
caggtatatagcatttataggcatttcaaaatagtcactttgaaatgttgagcagattcatgatagattttcaaggctttgaattatttacattttaaaaagtttatcagatattgcaatgttaaagataaattatttgaacttctagtaggtagtaatggtgtcagagaatgacaggtaattaagtcatacagtacatcttgtgtccacatttcatgcaatttttgcagaatgctgtactatgtaaactgctactgcaaaaaaaaaaaaaaaagcaattattgcactgaattttccataaaatccctccaagtaaatcttatcacccctttgcagatgagcatcttgtctttgggaagatgcaatagaaaaggaacttgccatagaaagcagtagtaagacttcttatatgagactaagattttcatttcattagctctctccttcaccttgtttattaattctacaagcatttattgccatctcctatgtgccaagcactggtccaggctctggggatacactatgaacaaaatacagtgaagtccctgccccatggagcttacattctagtagggggagacagacaaacacataaatacaaaatatcagagggttcaaaacagcttagaggtatcttgcctgaattctgtttactgcatatcctcattcttgggcaatgataaagtgaagagagaggccaacaatgggctgcagcaatgttgctagtcccagctctaccatctacacattgagtggatttaagtgagttctcatctgatctgagcctcagtttcctcatctataaaatggggagaaattggattaaattacttataagggaaagggtcctttcaggcttttttcatgagagtagggtgctgaaaatcaagagccagtttgttgactcctctaaggtttaaaaaatatttaaatataaaatctaagaaatccttagagatcccatacactcaatacttcaaatgccaatctgaacttctttcatcaatagcaaattcttatttacaatggctatagaatgaagtcattttaccatctttagccatatgaaaaataagttatttacttataaaaacattcatttttattattggttacaaaatctcaccttatttgtgaaatgttccctagctatgagatcctgcccttgatgtgacactatttctctcttctgctaacccctatccctgactttgtgctcctgtttaatttttccaactgaagtattagctttatgaaaacagggatcggctgcttgcttctttgaagaacaacccaaatgagagtatgtccaggtaatccatagacatgtataatcattacacctgcattttgttttacaggtacaggccttttggtaacccacattagctctttagactgtcagagttgttcagcttagtaaaatttagtttatcaaagggtactctaacatccgaaaaggaaaaacacgtttccagactaattcacagactagggcattgtaacttcactggaagccctggtgagaggcgttaatacatatttaataatgtaagtgaagtagcacatattttataatcaattaatttttctcaaagaagataatgtagcagaagacctgaatgtcaaacaaggttagactcatacttactaacttggtaggagttacgatgcctctgattctcttgaaagacaaactgtattcactagtttgattttgaaatgtagagatcaaatttcaatcaacccagcagctaaggatgacaggaaattttacaggactagaaggaatcatcttctcttatctggatctgatcctcctcgacaccttgggggtttccgaaggctgtgtgctctcagttttagctggttgttacgtaatcaaatatcccatgcatgtttttacatttgatcaggtgggcctaatcacaaggactcatgttgtcagtgcctttgggagcaaaatgaaataaatctctgtctcaatattggaatttattccttcctgttgcttagtggtgtcaagatacagtgtcaatgttaccagaagtgcctaacacagtctactgtgtaggctaaagtctgccgtgttcgtacagtgactgaaaaggaataatgactatatcctcatttgggtgaatgttactacttcaggaccagatgagcaggggcatcccatgtaaccatgaagaatcttgaagcagcattacaacatctaataataaacaatctctcaaacagtgcctgtatgaactgcaagatgagggcaggtccagctagacattggctgcataaatgaagatcagagaagaataaggagattcagacaacttttggcaacctagatcacagttactggtaaattcttgttacaaaggaaatggattttggtatacggaatttgaatatgtgttttactcaacagagtacatgctaccaacaagaatgcagccccctttttacaagttaggcagaaggaattataaagtcttgctgatgtttacagtccttacatcaatgtgactgcagccctccccagtcattccaaaaggtccttgggttggatacgagaatgcgtcaggcctggctttggctatgacatccccaggaagtcactgtgtgcagtgtggtctccagggtggaagtctttgagctgccaatgaatatctcttaagtccaaacctccatgggcactatggcctctttggtcccaacagaaggcagtaggctttcttcagacaagaaataaaaggggaattgcaccaaaaatccacggatcttcttcagttcctcctcagctcgaatgggatcttccttagctaatacgggcttgtttataaagtctctcagctgaattaaattgtgtacttcatcattgggaaggcaccggaaaacctgattagagcataaatagaaaaatgagtgaaaagtttaaaagcgagcacatggcctttatggaaaataattattccaacagacaagacctctgttgtatgaaacatattattagtcttatgttacagcacagacctgatttaagagttggttatcttataaccaacaatagatagatctgctacaaacagatagatctgcttccatttaaaaaatcatggttagtggcaagaaattacactaatgttaccccacattaaggttaattttttttggataataatcatccctgaatttcactggagcttctggtctaagaggaatattgcatattatattttccctaacttttcttgaaagaggctcatatctgtacctttacatagcattatcaattgttaatatgtaacacttactttgctggttgaaaatgagttttggatatcataacacttcacccctgaatacttctctgcaggtatgtcttaagaataaggacatgtgcctatataatcacagcactattctcacacctaagaaaattaattatataatgtcatttaagttatgcttcatattcagatttatcctgttatccccaaaatgtcttttatagatgttttcccccaaatccaggacccaaataaggctgtgcactgcatttgtaaaattacattttaatgactctatgcacatgacctatttgatcatggccttcggtccatgaaataaggatgaaataaggttatacaggggtcaggcgcattgggtcatgcctgtaatcctagcactttgagaggccaaggcaggcggatcacttgaggtcaggagttcaagaccagcctgtatcataatacaaaaattagctgggtgtgctggtgggcacctgtaggcccagctactcgggaggctgaggcaggggaatcacttgaacccaggaggtagaaattgcagtgagccgagatcatgccactgcactccagcctgggcaacagggtgagactccatgtcaattaaaaaaaaaaaaaaaaggaaagaaagaaaagaaacaaggttatacagacagtagacatgtttcattaagaataataagtttctctgctggaaggggctctaagagaaaaattgcgtattttccctaatttttttttttaaagaggttcacgtctgtccctggaagtcatgaagaagaacacagacttatccaacttctcacagatggtcaattagtctgggctagaacacagcttgaatagttttccctgatgggcaactagctacttttcgaagtaagctgttctactgttacgcaactcttaactcttttacattctttattataaccaaaggatagacttcacaggcaatgcatttggtatgcatcaaatggagccggttttaaaacacctttctaaaactagagctgtccaacaaatgacatgtcttgttattaatattaacaagattcatcataaggatgaatactgtttactatacactatgtgctaaaaccattcactagactattctttgtcctcataactacccttgtgaatattcctcccaatttataggagaggaaaaagaaactcagaaagttaagtcactatacacaaggttataacaccagcaacggggtgagctaggctggactcagctgtggcttgtttttttatgccatctgcccctcttctctttgtcactagacatgtacaaaggctgggtaaccaggtgctaaggatgctgctgatgggattcctgcatcacaggagagactggaatgctgctaaagcctcttctaaaccaaaatccacaatgctttttgcctttgtttttcagggtccacaaagaggtattttattacaacctggacatgtattagcttttttacgtttattaagaataccctgtaccaataatatgcagaaataacaatatgctttttgtgatgagattcagtgaaaagaaacggaggaggggaatacgtgaacttcaccttgtcataaattgtagcatttcgagctgctgttgaaacccacacctccttgaagaatttgtcactcactggatcctgaatgtcctcacttgggtcatcaagatagccaaggacaaccctgaaatacaagtgacctccacattgagtaactgagataaagcagtttgttgcaggatatatgtctattatatctatctctatatatgcaaatatatatatgcaaattatttgagagaccatgacctagctactctcatatcctcagagtgcctgacataaaagaaactattgtctgaattgaccacacataaacagcggactagacataacaaaaaattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatgctcataggctgaatgtttttttctgagttcaccaaataagtgagtatagacagagaagaggaccgggtgtatatcaacagtaagggagaggaggaggaaccagcgaggctggagaaaagccagaggatgtggaatcctgaaaccacacaaagaagtatgtcaaggagaactgtccaattcagataagaattgaccaccggctttaacaactggacatcattatattgttaccctccttgtatttaaataaatgtagatttgcatcatcattttaatggctgcagagtttcctatcacgtgaaatttattgaaccaattatttcattatggacttttgggtaatttccaatttttcattattataaacagtgttacaatgaacacagtttattcatcatatgtgattttgtacatttctgtgattatttcataagaagaaattttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacgagaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggcaatatattattttccctggcagtattttaattataagaaatttatattaaatgcagagtaaaaataatatgaagtactctggatgttcttttgaggactaaagtttgagagaaaactagtttaattttatgttgatgtatttaatgaaaattatttaatatttgcttattcatcaaaaaaagtgggacagtaggaaaaccacaaaaaattatttctgttctttccgttcctcatatctatcactttaaatgattctgagtcctaattgtgtggacaatggtttctcttgagtgatggttatatctgcaaagtttggataattttctaggacttgaactgttcagcttatagctgtgaaatttagtgcatgtttgattctgtctctatttagaattgatttcacattgaaataagtctctctatttctattttaaaataggccagatggaaaatggagtgaaactgcattttttaagtgaaaaaaatggttgtagtctaggccacaatatttatctttgggaatgtttcctaataaaaagaggctaaaattgacgcaatgtttttgtggtgcttttaaatatattatctgtgtttgccattggggcaaagtgaaaataattattgaagaacaactgcctctttaacacaatttgaaaaatgcgaagtaaaagaaagcacctagaaacaaagttagcataagatcagcattaaaaaaatgaattatttactgtagaataatcttcctccccaccaataataaaaacccaaagctttattgaagaacaataaaatattcatataaattgaagtccataccttgttcttcaacaagatgactcaatattataaaggtgtcagttcttttcttcatctataaatccgctataattccaattttataaaactagtaagaacttgagagaacgtgagtaaacaattctaaagtccatgtggaagaattaatgtttatgaataaccaagattattttgaaaaagaatactaatttgaagaagtggtatggcaaaaagtagtcttaaaatgcacagccacaataattacatggtatcacactggcatgcaagtaaacagactttcaatatggcataacagagagactagcgagaagccagaacagatagtgattcagtgtatcttaaaggtggactgcagataagagaggcgaagagtcctactacgtatcgtaaggttccagatcatctggttagttgagaaaaagagtcaggaccccgacctcacttcttacactaaaatacactgcagatgttaattgtaaaaagtaaaaccaaacaagcaccaggagaagacacaagtaaatgtttaatcttaggctgaggaagctattctaagcatacagaaaaaggcaggtggggaaaaaaaagaaaaaaacagattgatttgattaataagaattgaaaaatttcccccaaattctccaaagatgactaaaagccaacaggcaaacaaaatttgcaacacatatgacaaaggaataagcatcctacacatatttaaaatacttataaatcattaaaagaaagttaaacaacaaccccattaaaaagtgggcaaaagacaatggaaaagacatttttgaaaagaagacacacaagcagccaacaaacataaaaaaatgctgaacatcattaattatcagataaatgcaaattaaaaccacacaagataccatttcacaccaatcagaatgactattattaaaaagtcaaaaaacaacagctgttggtgaggatgtggagaaaagggaatgcatatacactgttggtgataacagaaattagtataacctctataggagacagtatggacacttctcaaagagctaaatatagaactatcattcaatacaacaatcccacaactgggtatctacctaagttgtcctaaaaatgacacctgcacttgtatgtttatcacagcactattcacaatagcacagtgttggaatcaacctaaatgtcctgagcagacaattacataaagaaaacacacacacacacacacacacacacacacacacacacacacacacaccagagaaaactactcagccataaataagaatgaaatcatgtattttgtagcaacatgcatggagttggaagccattatcctaaatgaaataacagaaagttaaatactgcgtgttctcacttataagtgggagcaaaacagtacatacacatggatgtacagagtggaataactgacgttggagactccaaaaggtgggtgggtagaggtggagtgaaggatgagaaatcacctaatgggtacaatgtacactatttgggtgacagttacactaaaagcccagacttcacccctacacaatgtatccaggtaacaaaactgtacctgtactccttaattgtataaaaataataaaaaaagaaagttaaaccttccatcgtaatgggcaaaggatacaaataaactaggcaatttatgaaaaaaattatacatggctaataaacatatttttaattctaaaaaatgtgaattaaaatggtgaaattccatgtgaaatctaacaaattggtgaagattaaataaactcagtcaagatagaaggaataagccctctaaaatattgccagtgatataataagagatcaaaggagacaataaagaaggtgaacaagaaggtatctacaaacatacccatttttttatatcagcaaaaatatctgccaaacaatgagggattaaaggaattatggcatacacatacaataaaatataatgtagccattaacatattgtagaagaatactcgatgacatggaaaatgtgtgtaacattgtttaaataataaaaaacatgtaggcctgcaaaattctaattttgttttaaaaagggaatacaatatattaatatctatgtatagaaaaaagtggaatgacatataccaaatgttaaaactgttatcacaaggtgatggtattacagatgaatttaattttcttactggttttctgtatttgccaaatttgtacataaaaatgtgctgtaatcaaaaacctctaccttctataattattacacatttaaaaagttataaagaaactcatgactttaaagagaattcttaagttcttacggaactgaaaagatataacatacattccagcttacaaaaggaagtatttgtcttttatgtatgccgcagtaggcaatcaatgggttaattagcagggtaccaatttttaaattctcctctgctaaacaaaacaaattaccattagaagctaattgaattatcaatggtttgaaaatcttcttactggcaaatcaagtagtaacaaaggcaataaatacagcaataaaagttgttagaaggtattgatagattttgagggatggattttttgagctacttagacagagacagcagaatgtctctacaactgaggcttatgttggtcttggaagccgaagtctggattggtaggaatgagcgaagtggcctctgcctttgccgggagttaagtgctcactaagcgcccatctgcaagtgagccagtttccaaaagggaccatttaacacaaagaaaacaacaggctgcagcgcagtgcccttcccgaaagggcataacgcactgatcttaactatatcggggccacctgctgcatcccactatacagtcctcaccaaaattgcattatggcaaatatagttctagaatcataaaactgtggacttcctacaaaggcctagagttgggagagtagtcagggtgttccacagccggtggggaaatgagtgtctgcagggagcaagggaaacagtgaaaggagacgagattatattacttgttccttgtgagataagaagccattggacagtagtgagcagagaagcaacatgatctagaaggttctagagggaccactgtgttgagaaaacacaacaggggacgtggacagttacagcgcagcccttgaaagttctaaataacactttattgaatggacttatttaggatcgcacagctgaaacgagcccagcttcctagcccagtattctctctgcttcaccacagattagtttaaaatttgcatcttcttgccaaagatcagggatcttcgacacctggagtcattttagacctgaaaacagaagtttccacatttaaattttacaccagcagtcactggcataccccttcaataatttttattatatccttgtattactggaattaatttgattttaaaaacttaaatggaagctggagggtttgacctggtctagtcctaattcagttaaggactagtatttaattggctcacgtctgtaatcccagtgctttgagaggccaaggcaggaggatcacttaaagccaggagtttgagaccagcctgggcagcacagcgagacacggtatctacaaaaaatttttaaaaattagctgggtgtggtgacacgggcctgtagtcccagctactcggaatgctgagccaggaggattgcttgagcctaggaattcaaggatgcaatgagctgtaactgcaccactgcagttttttctactgcacgtgacagtaataaaaagctattaaaataaaaaatattcatgtaccacctaaagtcatttcgcatactactggtggtacatatcctatattctgggacacactgttttagatgaagaagaacctaggatgacccatgtgctcagggctagcggggctgggtcccagcgactgctgcagtggaaatgcatcagagagacacactttggcggactgacctaaagcactgtagccgaagtcctcgggcaaaccggccagcttggtactcttttccatccattactgaaggaacagtctctgtatcttgcacaatgacagccatttcactgtcacgctttcccagcatgctgcggtcatttatgttggcagagcctgtaaggagaaacagtgaggctgaacaaccttcctgttgtggcagacactgttggttgccctcccaactcaattcatccttgcaaacaaaaccgtaattttgtccaggttttcaagggaagatgtgtttttagggaggtggggccctccctaacccaggggtgaatcttaatcagtctaagccagccatggtaatttcattatttttattagtgactggcttagaaatgggctcttgacatggtgctagccaatgtgacatgaaggaaagcttctgagaaagagtttcccctttgtataaacacacaaaaaatggattctgtctcttccatcctttggatatcttggcttgaagggttggaagaagacatgattccaggagctgctgcagccatttcacaaccactagagaacaaacaaaaaagcttaaagaaaatgctaagtagaaaaaagagccaggcatggtggctcatgtctgtaatcccagtgctttgagaggccaaggcaggaggatcgcttaaagccaggagtttgagaccagcctggacaacatagcgagacctggtctctacaaaaagtttttaaaaattagctgagtgtggtgacgcatgcctgtagtcccagctgctcggaatgctgaggcaggaggatcgcctgagcctaggatttcaaatttgcagtgggctgtaactgcaccactgcacttcagcctgggccaaagagcaagacttcatctctaaacaaaacataaaaataacaattaaaaaagaagaaagattctgggtctttaagtcattgaattagccaacctttgaatattcttaccttctgtcatgtgaaataatatattttccttattttctacattgttccttattgtttcacacacacttctagttgagttttctaccttgtggcacaaaagattctaactgttacaatcatcaagcacttgaaaaaaggcatgcctaccagttcagtaggaaagatggctttgcttttggagttaagaatcaggctctctgtaggctttaactcaaagtcacataactgtgaatgtcaaaactcaagagtaccttcataattaatagagtataatctcaaatacagattgtcatttgtggctttgggctttctgctttcttgcctccctcacttgtgtagcatgccaatagcttctgtagcaactttcctccattctattttttaaaattattaattctctttattagctcaatacctggttcattcaaggagtccatttttttttttaaatccaagtgagctgagaatgttgacttttacatgtgaagggcaaatattttgctattagttcaacctgtgctttctgcagtcctctgctgtgtattcaggaacctcatcacgtttttttgcattaatctctgcagattcatgcatttgaatccttgaggtgtcctgcaaactacagaaagggcctgactgactcttcttgttcctcttgctctagctgcaacaactccactgcttcttcagacgtggagcagaagggtcaggttgaacaggcaccctggcggccctctgactggagcagccagagctataaggtgacagcagccctaccagagctcaaatggtgagatgaatgagaaaagctgccctttcctgaagagactttactgcctgttgccagaatattgtcatgtggttaatatataaatctatgatgactatggatgtgagtgtttccccatggtggccctgggtaacagagaaaggatcgagcaccctacagaaatgtgagaatgctactggagtgctgctgaaaagtgggaacctttgaaacactttgttttgttagcaccaaatcatcctttatacatagacttacatcgtggttatgctataaaatttgcagctatatctttgagcttgacagttgccccaacattaatttgggcaattcacttaatctttctcagctttaatataatctttcataaattgagataataatatagaccttgtagggatattgtgggaattaagtaagaccatgtgaaagcacttaatgatttacaagctgctctacaaatgttaattattactggcattattatcagatccttgttaactctacaataactgcaccggagaatgctgccataggaaccgaccatttgatggaatgtagcatttgtttaaagaagcctcctctctggcttaatcgccccatgtgtgaactgtaggagctcaaagattgaagatcccatattgctactttaggacttttactgtgcccctggagccagcagaggccgctgtcaggcgggggctgctggattgaactgacatcactgctttgtttcgggtcaggagaacctgggatgtgagccagcctggaaagccccctccgcacacacattctcccacgcgcccccattcctctcccaccacagtgggccccgacactcccgaggtgaggaatacatttccagcattctgagctggaattattagacagagggtgtcgttcttgtattttaagggccaacatggaattacccagataactgactctccaccacattaaataagtgtgttggctgctatttaataggcatgtgaggaaagaaatgagaaaattttagatgaatgaataaattagatataataagatatgatggatgtaaatgctccctccatttgttcctgtattctgaaaatcaaattcagaagaacagttgtagtattaccctatttttatacaacatatgaggaagaagacagaacaagagatctagaaagatacacactgaactgttaacaatagtaggtgcttttcagtgaagagagagaagaaaataaggggaattttggtcttttactctataagcatccttcttgtttatatgacctgttctgagtgctattagaaaacattctaaaaattgtgaatatggcaaaatacaaaaggctatatgaaaatatgtgtgtaaaacttaagcaataataaaatagtcatcactgaatttattaccctggccaaaaacaatattaccacatcccagaaggctttgtgcaccttcccatgcatacccttccctccccaagaggaagacttgatgtttaactttgtgttcatcatgctctgaatgttttcctaaacaacaaaaaaagagtttacttctgacttgtttttaatttatataagtggaatcatatatcagatagtcctttgagatttgcttctttcattcagtcttatgtctttgagatttttctgtacataattgtaatgcatttcttttccttgaatgaacacactagggatttctttatttattctgctattgatggatgtttgggttgcttccagagttttgctgtgatgcacaattctgctctacatagctgagtatttgtttcttggtatagacatgtgtgagtttcttaggctctgtatgtaggcgtgggttgctaagctgcagggtgtatgactttactaggtaacaccagaatgttttccaacttacactcccaacagcagtggaggggagtctgtattgctccacagccatgccaatacttagattgcccaacttttaactgtttgccagtctggtatttttaaaaactcttatttgtctcatgttaatgagaagcaacattttttcacatgcttatgaggcttgggtatgttctttttgatgaagttcctatacaatttctttgcccatttttctttggacatttgttttttcttattgatttataggagttctttatgtgttctgtgtattaaatgggttgcaaatatttcagtttgtggtttatctttttattctctttacagtaccttttaatgaagaaatttctgaattttaatgcagttggatttatctttcctttgtggtttgtgcttattttgtgtgtctcacttagaaattgtgaatccttgtgtggtatgcagaatagcagctctccaaaatgtccgtgttcaaatctccgaaaactgtgaatatatgttcaatggcaaaggcgaactaaggctgtatatggaattaaggttgctaatcagctaactttaaaaatagagtgagtagcctggattatacaggtggacccaatacaatcataagatctgtaaaagtgaaagggagtcagactgagttatgattacagaagaatgggttgagacttttggggattttcagagatagaatgttgctgactttaaaggtggaagaaggggctgtgagccaaggaatgcaggcagcctctagaaacaaggaaatggactctccctaacggcctctaaaagaatgcaacagccctgctcacactctgattttagtcctgtgggactcacgctgaatttctaacctactgaagtgtcagataataaatttgtgttgttttaagctactaagtttgtggtcatttgttacagcagtaatgggaaacgaacgcacgaactctaccccgttttagtttgttttgaaggaaaactggttcttctattgagcacactgggctactctgtcttttctgcctacttgtatttcctttgcctccaggtcagaagttctcagctctgaccacatatgagcattacctaggaaagctaacaaggaagctttttaaaaaatactgatgccaaaaacaaaaccaaaaaaacccaaatgcctggccccaaaccagaccaactagatcataatttctagaaataagaaccaggcattggtataccactccatccctgtatccattgttaatttatatttttgttttgatccatttaaaagcaaattgcagacatgaggaaatatccccctctttactggggcagcccttcaactccagcctctcatctgccacagtgaagcctgctctttaaatcctgagactcatgagctcgacttagtttctcctcctacccacacttgttgattgcccctgaaccttcttgttctggtttggcaacatccatcctagtgtttctgctctcatatggaaggagtagctgcctctcctccagccagtgatctctgggagggcagtggcgctgttttactcacgtttcgcatctctctattgtgctttgcagtgggttagtgaacattaaaaacaaccgtttcacttagtcatcaggataggcttaaaatctacttgaaggggagcttggctttgttttggaaaccaaatatatgtgtgtctggttaaaggctaaaattaagataggtaagaaaactggatttggtcacagatttcatgaccagcagggttacccagggccacaggcaattaaagctatgcacaaaagagatcttcagtgtgagaaaacaaatatttcctcatgaggagtaaaatgaagataaatggtcatttttcttatgtcagctattcaatcattctggcataagtttgccatggaagaaaaattaatcatacattacttaaacctcctttaaatgtttaaatacttccttaacacctataaaatattctcaacctaacttctcaaactcgtctctgagaattttaaacactgttttctgtgttaggaacttaaatagggtgaatgtgttagaacagtaacaataaacctgcttattcttgagtttccaccgagataaaaagaacaaaagaaactctggattttttccttgggagaaatcgattctctaaggcacttggggaaggaaaaaaggaatccagcctccaaggactagcaagtaagacctctttagactcccagggccatatcctcagtttcaagagaatgtgtaagaattgtgtgcaaaattgatcaagtattgctaaacaaaataaattggagtctttgagtgtttagagacttttccagaaaataagtcaattaaaaacctcaacaaatttatttaactgttagctctgttaccaaaaactaatttgtatttatacttcatgtaaagtaaacgaggctgaaagtcaaaatgacctttcaaaaaaatatttacatctgtcagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtatgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaagcatatttattgtccaaaattttcaaaacactccatgacatttagtttcttgaataataggaaagtatcttattatagctgataaactacatttcatttgaaacagatgagcagaattcccattagtaggacacatcatctctctaaataacatgacccacactggttacctcatttacctggttgattatttatactctatcatcctggacttccaatactcattttatataatattaatattagaagtcaaaataattcaatgatggaagaatgaagctttctatgtatataaaagaatgaagctgaacatctacctctcttgtcaagctaatctaatttgggtagaatgtacaagttatttaggagagtaactctcctgaatttgtcagtgggaagaggcctttggaaaagtctcctgtgtatccttgacaagaaatgactgcagaccttagtgcagggctacatcctatcattagtacacaattcccacttcatccatacacatcaacaaagttggactgctctacatcctaattaatgacatggaaaacatgcatgttaggaaaaatagtggtaatgcatagaggcagcaatattttaccatccttctgatttcgacttttgtacaacttcagatctgtggtaatggttaggtggatgtggtataaacacatacgaattaccacaaggtactcacttatgacacactttccctccccatttatcccccaccaatccctgaaatctgggcacttggattgtaaataaaaataaggggatagctgggtgtggtggctcgggcctgtaatcccagcacacgggagactgaggtagaagaatcatttgagaccagcctgggaaacacagcgagacccccatctcaaaaatagttttaaaaattaaaaaaaaaagggagtaataaagaattagtgaaatctggcacattattggactgctgggttaaacagctgcctctggattctgcaattttcacgaagtccatttaattgctctgtacctctgattcttcacagataaaaatagtttagttcacaaagagatgataaatgcttgaagtgataggtactgcaattgccctgatgtgattgttatacattgtatgactgtatcaaaacatcgtatgtaccccatgaatatatacacctattctgtacctataacaatttcaacaactgggttagaaaggatgtaagagaagaggatggcttcagaaatgttttagttatggtgttactgtctgtttcaaatgcaaaggatgcttaggaggaatagcagcaaacatttttgcatggggtaagtcaactggcaaggaatacaattatagaccatatactgtacttaccaataataacagtgttatcatcagcaattaacaacttgctgtggacatagataagctcagttactaggtttccttcgagctctgcatgtgttctaagaccacagaatgatatgtaatttatccactgattaccaactgcaaatttaaaaagaaattattaaaattaatatgaccaagctcaataaacgtacattaaatcttattgtttctcaaaacatactacttagactgttcagaatagattgtatattatatgtatatgttttctatttcagaattcatccaggatttatttttgatatctgaatttcatattgtcagtctgaatggctttctctctctctctctctctctctctatatatatatatatatatatatatattatatatattttttttttaattgaagtgttttctgtcttccctttgctaaggcaatccaaaaagctattcatatatgaacattttattttaatgatttgatgagttaactactgaagagtgatggttaaaactgagctggaatagattaaccaagacttcagtgtgacatttgcttctatcctgcttgacacttgctgcagtttgaatcagatgcaaggtgtgtgccaaaccacctgatgctacatcatttgtagcatattcagcgtgaagcatcagttaaattctgcagactttgggtaaataaaaatgttggcaatgaaaaaccactcctccctttagatcattaaaattaggaaacagaagaatccttactacattagacttagaattttcttcagagcaagcagcaccaggtttgtacttcaaaatattgccatccctctaatcacatgggggccattcacatgataagaagaaatacattccatactaagccaagtcataatcatgacccctgttgtgagtgttagtcacaggatttttatggtctttctcccacacagcagttgtcttggataagcaagtctgataccaagaataaatggagtggaaccaaactatcacaaattctcatagaaagagagcatacatttttttttgtctttaagagaatttgaagcatactaatagaagggtggcagttcatctcccatttactgaagtttccatttattactgatggtttctattttgctactgatgttattcagtgtttctattaagtttgggtatcttggaaagaaattcattcataggttatgtatagagatgcctccatttagagatagctctcccctcatatatatatgagtgatgttgtatagctgtgtttgatgagagttgaaatgttggtatactagtacaccatgtgtaagagatgcatttctaaaacgtttcatgtaaatgaggtttttgcaatttattcccccatttgttaatgttatattggaaagacacttcatctgaagaatcacctccttttttaagtcttttctgatccatttccttttttaagcccctcagacctataaaattcctggaaaacatttctaaataatgcctagtatcttacaaacatttatataatcttcaagttattctactgttgtacaggaactgggtcttacacatttttgtttctcatcctttcacagtgctaaaaaaagctaaataaatgtatgagtggataaatgaatattcaggtatcagctgaaactaaaaaatattttaccttttaatttctctgtatcatctactctcctacagctggatcatgatctagaatttataagtttaagatacaaagcagcttttcaaaggaatcatggagcaggacctttgctaaagtaaatatttttttacagtaatttccattaaaattcacattgaacaatatagtagaccagtggttctcagcatgcacaaagaccacctctatggaatttgttaaaagcagattcctgtgactcttcacagaattctgattcagcggaaatcaattcagtaagtccccgaggggatattgtttctgaatgacactgccatagagctttgataattatttaagattagtatacactaagaaaataatacaccatgaccaagtgagatgcattccaggatgcaagtctgctcatatgaggaaatccattattagacattatattgatcaatctagggagaaaaataatataattattttaacagatgctggaaagcttttgacacaattcagtatccactcctgataaaagcaatgaagaaagtaggaaatgatgaatactttcttaacatgctgaaaatatatataatatatgtattatatatttatatgcatatgtgggtataatattttcaatactatttaatattgccttggaagtatcagccaatatagttgtataagagaaatcatataaaaagtaaagtcatcttcacttgcagatactgtgaaaacatacctgaagaatcagtaataaaattatatcaaataataaaaatattaaatataataacaggatataaattaacatatagaaatcaatagcctttatatacacaaaacaataaccacttagagaatataatcacagacaaagcctcatttagaatgacaacaaagaaaataaaagagataaacttaatggttcacgtgcaaaacttttataaagaaaaagttaaaaaactatcaagacacaagagtagacttgaacaaatggaaagattgctcttgttctgggatagaacaattcaccattagaaatatgtcaactcttcccaggttaatttataaatttaatgtgatctcattacattacatgagatcgcattaatgtaatgtaatataaggtaatgtaatggtaaaaatgccaacaagttctcatggagttagataacctgtagtttgtatggaaaaataaacatgcaagaataaattgagaaaaatggaagagaaaagctatgagtcattagccctatcagactttttttttttttttttttgagatggagtctcgctctgtcacccaggctggagtgcagtggcgtgatctcgactcactgcaagctccgcctcccgggttcacgccattctcctgcttcagcctcccaagtagctgggactacaggcgcccaccaccacgccttgctaattttttttttttttgcatttttaatagagacagggtttcaccatgttagccaggatggtctcgacctcctgacctcgtgatccgcccacctcggcctcccaaagtgctgggattacaggcatgagccaccgtgccaggccagccctatcagatattaacacatactataaagtctgtataattaaaacagtgcagatctagcagataaatagacagatacaccagtgaatgggatagaaagtccaaaaagagatgcaaatacataaggaaaatttgtatatgataaaggaaacagctcaaatgataaggacaaggccttttcaataaaaaggtgctagtacagttccatagccacctgaaaaagataaaactccaaattttttttaacaagaataaactccaaatggatcagagataaaaatgtaagcaaatgaaaccagacaagtgttagaagaaagcaagggtgaattcctctatacttcaaatgtaagaaagattttgtaagtatccagaggcaaaaaaaaaaaaaaaaagatttgtaaattggttagattaaaaaaataacaacacgtttgcatgacacaaaacacgacaagcaaaaaacaaaaggcagaagacaaactgggagaaagtattttcagtacatgtcacagataaagaggtgataatcctaacatataaagaactctaaataattgaagggaaaagaaaatcaaaatcttaatagaaaaatgggcaaaacacatgaatagacaattcacacacacaaaagatacatttgaaaagatatccatcttgactcataattataggaatgcaaataaaaatgacgttgagaaaccatttgttatctataagattggcaaaaaataaaaagtacgacaacatattctgttagtgagaatgggttgaagacagactctctcatatattggtgatgaaaatgcaaattcatacaaattttttgaagggtcatttagcaatatctaacaaagctacctatgtgtttacctcctgactcagcaatcccactctagaaatttatgctaaatatataccttcaacaaataagaatatatgtatatatattaatatatacacagttacccattgtatgtagttccgttagaagcatataatggttgttgaagacaatctaattgcccattcataacacagtgattgaataaacgcaaatccacatatggaagactatgcagtgttacgagaaatgaagatctctgtgaattaatagggagtgatttccaggatattctgttaaatggaaaaggcaaggtgaacaagagaatatgcagtatatttttttgtgaaagagatcaggagaaataagaaaatatacaactatctgagcatttttccaagaagaaacacaacaagattaacctagaaactgatgaaattggttaccaataggggatggataagtacagggtgaaaaagatggttggggtagaaactgaaagtatagaggaatggcatttatttaaatatgttttttgtatagttctggctattggaagcatagttcatgcattcaaaaaaataatcaagagagatttaaaaaaaaaacaaaaccctgagagttccccttcctagtcaaagaaaggggtgacagatggcacctggaaaatcgggtcactcccaccctaatactgcgcttttccaacaggcttaaaaaatggcgcaccaggagattatatcccgcacatggcttggaggctcccacgcccacggagtctcgctgattgctagcacagcagtctgagatcaaactgcaaggtggcagcgaggctgggggaggggcgcctgccattgcccaggcttgcttaggtaaacaaagcagccaggaagcttgaactgggtggagcccaccacagctcaaggaggcctgcctgcctctgtaggccccacctctgggggcagggcacagacaaacaaaaagacagcagtaacctctgcagacttaaatgtccctgtctgatagctttgaagagagcagtggttctcccagcacgcagctggagatctgagaacgggcagactgcctcaagtgggtccctgacccctgatccctgagaagctaactgggaggcacccccccgtaggtgcagactgacacctcacacggccgggtactcctctgagacaaaacttccagagaaatgttcagacagcagtattcgcggttcacaaaaatccactgttctgcagccaccgctgctggtacccaggcaaacagggtctggagtggacctctagcaaactccaacagaactgcagctgagagtcctgtctgttagaaggaaaactaacaaacagaaaggacatccacaccaaaaacccatctgtacatcaccatcatcaaagaccaaaagtacataaaaccacaaagatggggaaaaaacagagcagaaaaaccggaaactctaaaaagcagagcgcctctcctcctccaaaggaatgcagctcctcaccagcaacggaacaaagctggacggagaatgactttgacgagttgagagaagaagacttcagacgatcaaactactccgagctacaggaggaaattcaaaccaaaggcaaagaagttgaaaactttgaaaaaaattcagacgaatgtataactggaataaccaatacagagaagtgcttaaaggagctgacggagctgaaagccaaggctcgagaactacatgaagaacgcagaagcctcaagagccgatgcgatcaactggaagaaagggtatcagtgatggaagacaaaatgaatgaaatgaagcgagaagggaagtttagagaaaaaagaataaaaagaaacaaacaaagcctccaagaaatatgggactatgtgaaaagaccaaatctacgtctgattagtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaaggcacataattgtcagattcagcaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggaaaaataaaatactttacagacaagcaaatgctgagacattttgtcacctccaggcctgccctaaaagagctcctgaaggaagcactaaacatggataggaacagctggtaccagccactgcaaaatcatgccaatgccaaattataaagaccactgaggctaggaagtaactacatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggaggcaggaagatctaccaagcaaatggaaaacaaaaaaaaggcaggggttgcaatcctagtctctgataaaacagactgtaaactaacaaagatcaaaagagacaaagaaggccattacataatggtaaagggatcaattcaacaagaagagctaactatcctaaatatatatgcacccaatacaggagcacccagattcataaagcaagtcctgagtgacctgcaaagagacttagactcccacacaataataatgggagactttaacaccccctgtcaacattagacagatcaacgagatagaaagttaacaaggatacccaggaattgaactcagctctgcaccaagcggacctaatagacatctacagaactctccaccccaaatcaacagaatatacattttttttcagcatcacaccacacctattccaaaattgaccacatagttggaagtaaagctctcctcagcaaatgtaaaagataagaaattataacaaactatctctcagaccatagtgcaatcaaagtagaactcaggattaagaaactcactcaaaactgctcaactacatggaaactgaacaacctgctcctgaatgactactgggtacataacgaaatgaaggcagaaataaaaatgttctttgaaaccaatgagaacaaagacacaacataccagaatctctgggacacattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaattaaatagacgcaataaaaaatgataaaggggatatcaccatcgatcccacagaaatacaaactaacatcagagaatactacaaacaccgctacgcaaataaactagaaaatctagaagaaatggataaattcctcaacatatacacccttcgaagactaaaccaggaagaagttgaatctctgaacagaccaataagaggctctgaaattgtggcaataatcaatagtttaccaaccaaaaagagtccaggaccagatggattcacagccgaatactaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaacaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacgtgattatctcaatagatgcagaaaaggcctttgacaaaattcaacaactcttcttgctaaaaactctcaataaattaggtattgatgggacatatctcaaaataaaaagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagaaacccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaatattccatgctcatgggtaggaagaatcaatatcatgaaaatggccatactgcacaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctattcaataaatggtgctgggaaaactggctagccatatggagaaagctgaaactggatcccttctttacaccttatacaaaaattaattcaagatggattaaagacttaaacgttagacctaaaaccataaaaaccctagaagaaaacctaggcattaccattcaggacataggtatgggcaaggacttcatgtctaaaacaccaaaagcaatagcaacaaaagccaaaattgacaaattggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggctatcagagaaatgcaaatcaaaaacacaatgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcaccattctcagtaaactatcgcaagaacaaaaaaccaaacaccacatattctcactcataggtgggaactgaacaatgagaacacacggacacaggaaggggaacatcacactctggggactgttgtggggtggggggaggggggagggatagccgtgggagatatacctaatgctaaatgacgagttaatgggtgcagcacaccagcatggcacatgtatacatatgtaactaacctgcacattgtgcacatgtaccctaaaacttaaagtataataataatgaaataaaataaaataaaggctgaataattaaaaaaaactctgaaatgtaatataaaccaaagtaaatgaaccaaacctaatgaagttaataacataatccaagcaaatcaagttaacaatgtaatcaaactacttttgattacagacatttgagtgtatacccttaggctaaaggcaaaacactataagcaagtgttaaactctagtaagtagattcatttttcatggtggtatgggccagcaatcccaaacctattttctgtgtattaaaaggttgaggatatacataaatatgctgcggataatgggagccgtgtttctcactgtgaaagaaaggagctataaacataaaaagagggatagctagaaggaatcctatgctgtgggattggaattggagatatccacatgacaagaaagagagagaataggtttgtgtgtgtgtacaaaggcccaaagtagtgatattctagtagcaatgatcacatctagcacccagattttgctttataaataccatttttcgctaaaataacctaggttccttgaagaaatggctgattgcagggctagtgttgggaatatatgagtctgggacaccttgttgtgccagtaaaagaagatgattagcggggacatgtccaaaaatcatcaagccacctttaaaaggccctcattggccaaatctgggcaagctgaactccaagatcttaactcactaaataagagaagcagctgtaagtccatactaatataaatacataaatggggaaaaagggaaaactttccttacagtagaattccaactaattaatttaaaagaaactaataaatatagaaaaaaatgatggaatcacaaagtcagcatttggtaactatcatgataattgattcacagaataattaacgcatgctaaaaccaggaggtcaatggttgataagaagcaggatacttatatacacctaaagtgttttcctacaaaatactattaattatgaagggaaaaatagtggagaattctggcagacaccaccttcactaagtgatcaaagttaatataaccagtaaggttgttcctgctatgttaccgtaagaacacaacctcacttctgtgatactgctccaaaaaagcataagctaaatctaatcatgagaaaataatggacatacccaaattgagggacagtctatagagcaactggcctgtactattcaaaaacatcaagatcatgaaagctctgccaccccccaaaatcaaaatgattgaaagataatttcagattaaaggaaaataaagacatgtgacaatgtcacaaattattgtgagctgaattctagcctaggaaaaagccttttttcctcttttgctatgaagtacattcctaagacaactggcaatatttcaataaggtctataaactggataatagtattatatcaatgttcatttattttgatatttgaactatacttgattaagagaatgtccttgttttctcagaaaccacatacatatttagggggaaattggtatcatggctgcaacttattccaaaatgactcagggtaaaaaaaaaaatccctacatctatatatgaatgtatctttctattgagagagaatgataaagcaaagaaagtaaaattattataacatctgtgaaattaggatgaaggatatatggcagtcctggaagctgttctataaatttgagattatttcaaaattaatttttttaagattaatgatactgactagcttttagcagcttgaaggtttaggacatgtcatattcgtaattttctaaagcacatctatgtgccatgccaaagcaggcctacagagtatcagcaaaacatcaattagtaagacatcctgtcagcccacagtccatacctacttcccactcatccttgactatgcaataactcttacgaagtaattaaatctttatttctttgtgaaaaatggccttgggaagagacctaacagttggttccagtaacatgatctaaaagaaagataatggttcctagccagaaagtagacattttggacaaatgcgagtgtggcctgtcaaatgctatggggacacccatttatgatgtgaataaattcaccatgaactctatacggaaagaagaaaaaacaaatagagaaaatatttcagccagtactttattctgtgaaaaaaactgccttgacatgtaataggtacaaaggttggtgatgttaatttatgttatgaggatatactagagaaacatatgctttttgaagaaaatatgagcaagccaggagcatacataagcattaatgtgaagaaatagatgaacaagtataagaaagagtcccaaattacataatgccatggaggtatctgagaacctggagatttattcagatcccaggacatacctgttgtgaacattggtgtgtgcatcacacaccggggcctgttgcggggatgggaggctaggggagggatagcattaggaaaaatctctaatgtaagtgatgggttgatgggtgcagcaaaccaccatggcatgtgtatacctatgtaacaaaactgcacgttctgcacatgtaccccagaacttaaagtataattaaaaaaagaagagaaattcaatacaatagactcaatatttataaggaaatttcgtgaaaggacatcaagaattgttacaggctttcgttccttgtagcacttagtatatgtacgtatctaatcctgattgaaaacttctggcccttatcttaaattatactaaattggctgctaaaataccaaaattaacaaaaattataaaaacaacaaagaaatgctttaaattaaacattaaatctctgaagactggtatatcagataattatatactaatagctgctggttttcttttcaggaattttaacatattcatagcagcagttttgttattctaaataattaaaacagtagagaactatatttctctatccaattagagattagctagttcatgtatttaaaaccactacatatacaaaaacaaagccaacaatacaaccttgtactttagaaacaggcattatgtaattaatctttgctctctgtctagcatatgaacattttccccactgagatgccttattttgactgttcccaaggtacttggaaatcttttcataaacaggcttagcattgaaattaattcttgtgttaaaaaccaatttgcacccttgaataggcaaaggcaagaaaagggtccagagccaaaggaaatactttataataagctcaggacatttttactgttgagaaactcaataataagctgttttgccctatatcctcacctgcgcatttttacaagccactgccagcgctgaatgattttcccgattttattttatcgatatatcttttataaatttactaattcactatcatcttcattttaggccattagaaaatagagacagagataatactctggcaaatctctgtcctagatacaatgagatgcaacttttggaagtattcattattggtgatgtacatatcttttgtctaaagttgcttacaaaagttttgtaggttgagcagaccatcagtgaaaaattactgaacacacaacaccaatatatgtacatatgcctattttgaaattatatacatgtactaaaaacttgtcactattttaacttgtcaatattttaaatttgtatttaaagtttccaaatcatttaaaaattcttacaatttataaattttatactacaaaattctcgtctttaaagtgtacaaatcagtatgttttataagtagtacattcacaaggccgtacaaccatcaccaccacctaattttaagacatttttatcactcccccaaaaaaaccccacactcattaacagttacaccccattccactctcctctacaccctattattctaccaactggctctatggatttgcctattgaagacattttataaaaatgaaaccagacaatatgtggccttttgtgcctggcttctttcacttagtgtaaggtcttcgaggttcatctgtgatgtagtatatgtcagttcatgcctttttacatctaaataatactccactgtatggatacaccccattttgtttatacattcatcagttaatggacattgggttgtttccactttttggctattctgaataatgctgctataaacattcatgtacagatttttgtgtggacatttgtttttaatatttgggtaaatgttaaggagtagaactgctgggttataggctaactatatttaacttttgcagaaatgccaaactggctttccaaagaagcagtaccatttttcattcccaacagtaatgtgttagggttccactatttacacatccttgccaatactttattattattattattattatggccatcctagtgaatgtgaagctgtgaggttgtattgtgggtttgagttgaatttctagtgactagtgatattgagttttcttttatgtacttatcatccagttgaatatcttctttagaaaaatacctgtttagctgctttgcccattttttattttttgagttatttttatttttattactgaattgtaggaattctttacatattctgtacactagtaccttatacatatgatttgcaaatggttttctctcattctgtggggtgttttcacttccttgataatgttcattggagcacaaaggctttcaagctttcatgtttgatgaaatctaaattatctatttttatatgtttgcttgtgcttttggtgtaaaatccaagaagccattgtcacaatgatttatgcctattattttcttccgggaaatgtatagttttagtttttacatttaggcctttgatccatattgagtgaatttttgtatatggtatgaggtaggggttcaacttcttttttttttttttttttttttttttttttttgcaagtggatatctagtttttctagcaccatttgctgaaaagactattctttctccattgaattgttttggcaccaccttgctgaaatttaattgaccataatcataagaattatttttagattctcgactctattcagttgacctgtaagtctaactttatgtcagtagcacactattattgtgggtttactgcaagttttgaaatcacgtatgtgacacctccaatttgttcttattcaagattgttttggcaatgctaaatgccttgaaatttcacatgaactttcagattagcttgtcaattttttcaaaaaggtagttggggttttggtagggattgtgttgaatgtataggtaaatttggagagtactgccatcttaacaatgctaagtctttcaatccattaacacagagtatttatttatttatatcttccttaatctctttcaaggttttattattttcagcgtaggtatcttccactacctttattaaatttattcctaaatatttaattcttttgatgctattttaaatcgaattgttttcttaatttcattttcagtttactcattgctagagtataaaagtgaattgatttttgtatactcatcttgtatcttgaaacactgctagactaatttattatctgtaatagtatgtgtgaatttcttagaatttcctgcatacaagatcatgtcatctataaaaagaggtagttttactcttcctgttcctttccctttaaaaaatgtatatttttcttgctcaactgttgtggctaaaacctccagtacgatgttgacaaaagtgaactttctcatctcatcactgatcatagaggggaaagctttcagtctttcaccattaagtatgatgtcagcttatatgtgacatctacacataccatttacatggctgaggaagttcctgtgtattccaagtttgttgaggtttttttgttttgttttaattatgaaagtgtttgggattttgccaaataatttttctgtgtcaatgagatgattatgtgtggtttttgtcctttgttctattaacatgatgcattacactgactgattttcagatgttaaaaccaaccatgcattcctgggaaaaatcccatttggtcatgatgtataatcctttttatattgttggattcagtttagtagtatttcactgaggaattctgtggtacattcacaaggaatattgatctgattgatctgtggctttcttttcttttcttttgagacggagtctcactctgtcaccaggctggagtgcagtggtgcaatcttggctcactgcaacctcagcctcccgggttcaagcgattctcgtgcctcagcctcccgagtagctgggactacaggtgcatgccaccacgcccagctaatttttgcatttttagtagagatgggtttcaccatgttggccaggatggtctcgatctcttgacctcgtgatccacctgcctcagcctcccaaagtgctggaattacaggtgtgagccaccatgcctggtccttttcttttcttataatgaccttggtattggtatcaggataatactggactcttagaatgtgttgggaagtatagtaatacattgcttaatgagaatgtgagagaaatgtgtcattgggtgattttgtcattgtttgaacatcataaagtgtaattacacaaacctactacacaaatcatatagtctactacatacccaggctatatggtatagattattgctcctaggctacaaacctgtacagcatgatactatactgaatactgtaggcaagtgtaacttaatggcaagtatttgtgaatctaagcatagaaaaagcatggtaaaaacatggtataagagatcaaaaatgatacacttaaccagctgggcacggtggctcacgcctgtaatcccagcactttgggaggccgaggtgggtggatcacgaggtcaggagatagagaccatcctgactaacacagtgaaaccccatctccactaaaaaaatacaaaaaaaaattagccaggtgcggcgatgggcgcctgcagtcccagctactcgggaggctgaggcaggagaatggcatgaacctgggaggcggagcttgcagtgagccaagattgcgccactgcactccagcctgggcgacagagcgagactccgtctcaaaaaaaaaaaaaaaaaaaaaaagatacacttacatagagcacttaccatgaatgaagttgctctgggtgtgagtggtgaataaatgtgaaggtctaaactattactgtacactactgtggactttataaacactgcgcacttaggctacattaaatttttaaatttatttaaaaataaaataattgtaccatgccatgggtatgactgtgacatcatttggtgataggaatttttcagctccattataatcttacgggaccaccatcatgctgcaatctgttgttgactgaaatgtcattatgcaacacataactgtattcctttctcctatctatttttggggaaaagtatgtgaagaattggtgttaattctattgcggatggtagaactaattagcaaagccactgggccagggcttttctttgtgggaagattattgattgctaaattaatctctttacttgttattgctctatttagaatttcagctctttctagaagcagttttgggagtttgtgtctttaatacaataccattaatcgtatgtatcaatctgactgggccaagaggtgcccagtttaatattgtttctgagtgtgtctgtgaggggttttctggatgagattagcatttgaattcgtggattcactaaagtagattgccctccccaatgttgctgggcatcatctaatccattgagggccagaggagatcaagagacagatggaaaaagaattcatgccttttgattcttgcttttctgcttctgttggaatctcggtctgctcttacccttttactaccattaacaccattggctcctctgattctgaggccttcagacttggatgggaattacatagccagctttcctgggtatccagcttgcagattgtggaaattctcagcctccgtaattacttgagtcaattcctcataataaatcttttcatatatatatatgaaagatagatatataaatatataatatataatatacaattttatatattatttatatatagcacataaaatatatatctatacatatatttataatatataacatataagtaatatataaatatatcatatattatctatatataaatatatcatatattatctatatataaatattttcatataaataaaagatatatatgaatatatattatatagatggatatataaatatacatgtaaattatatatttatatataatttttaatttatattttatatattatataaaattatataaattagatataatatattcatttttaatagataaatattttatttaatacataataaataatatatattcatataatatatattatataaatatatattcatataatatatattatatataatatatattcatataatatatattcatataatatatattatatataatatatattctatataatatatattatatataatatatattcatataatatatattatatataatacctattcatataatatatattatataaatatataaacatatattcatacatatatctttcatatatatgaaaagatttattatgaggaattggctcaggtaattatggaggctgagaagttatatttacataatttctctctctctctctctctctctctctctatatatatatatatatctcctattggttctgtttcttgagggaaccctgactaatacaatgtctttaaaggaatttgtccatctatctgggctaatttgttggcatacaactgttcatagtattctacactccattttatttccgtaaagtcagtagtaatgtcccctcttagtttctgattttggtactttgaatcttctctatttgttacttagtcagtccacctaaagtttgtcaactttgttgatcttttcaaaaagctaacttttggtttcactaattttctctatttttttctattatctcatttatttcccctccaatctctgttatttattttattctgcttgctttaggtttagttttctcttctttttctactttcctaaaatgtaaggttaggttattgatttgagatttcttattttctattaaataatataaatgtttatagttataaatttccctgtaagcattgctatagctgcctctcataagtttggatatgctgttttcattttcattcatctcaaaatattttctactctcctttgaagtatcttctttgattctttggttatttagaagtatattgtataatttccacctatctgtgaattcccaacatttccttttgttatttataatttcattccattgtggtcagagaacatactttatacaattccttaaatgcctgtaccaaatgagtttcttatactttactgaggggctctgtgtatgtgtgtgagggccacaggccttacatgctcaggcatgcagtttataactctgccttaggcttcactttctgcttccacagagcctcaaggtcagccagaggtgagagcttagggccttctcaatcctttcctgagcacgtgcattgccctgggccgttgcacacagccctacacagacccatgacctttcagattcccagggatatgttggaagtttctagtgcccactaggggatctccttcctcagcttatcctcttaagatttttagtcagcttcttgctcactcaactgttactgcctcttcagtcagctgtgatgctaaataaatgttgctgattgtttttgataaataccaggttttttaaaaagtctacttgcactgagcaaggtctgagtcaggtgaaataaatataagtacttagaatgggagtttaaagggaagtgccagacaggtcaaataatgacaatgtgagaactgtgggacatgggagccttaaccctgatctgctccctccaatggctgctaggctgctggttttcaccctgatttgagcagctgttggcttttaagattatcatggagctgagaagagggagatgggtatatggcaagttaaaatgccacaaagcttgctattcttaccaagattcagctgtttttcttgattaaacactccttggattgttacaagcctttagttaatttccccatccaaagaagttgattgtgacaacttttgtcagtatttttgttgcttttatgtaggactatatttttggagatccttcctctgccattcctgctgatgtcctaatttcttacttttaagctaaaaatatacagacttggaaagtctattattttctacccacattccagtacatcatccagtgcaccccatttgggaggctaccagtataaaataaaaacttccttcaaaatactcaattcaggtttatattctatctgaaggtcatatcatgaccttcacatgattaggatgagtccttctgccttttccagacctcctgcagcagctccattctcttggtccattggattgaaactcagaattagctgacacttcccttcctctcctgcttccacatcccctcaagtcatccctcataatcttacccacacatgatcctccttttccattaccagtgcacctttgtctcttgcttgccaccatctctaccctgtttaccaacagtaaatgaatcttcatataaacgtcagtttgatgaatttgctccaggggctcagagggtttccaccaacctcttcttgccttctggataaaacctagccttcttagtgtggctgtccacgttttcacaatctggacccaacttgaactagaagtcatacaacttgggttctgattccagcttagtttgtaatgatacacaaagatatagagcaaagatatagagcacagagatatagagcaatattgagtgcccactatatgctgaacccatagttcagggagctatagataggtaaacccctagttacaatatattgtagccaagaactaggtagaagaatcaattaagaacacatctgaggctgcacatggtggctcacacttgtaatcccagcactttgggaggctgtggcgggtggatcacctgaggtcaggagttctagacaggcctggccaacacggtgaaacctcgtctctactaaaaatacaaaaaaattagttgggcatggtggcgcacacctgtaatcccagctactcgggaggctgaggcaaaagaactgcttgaacccaggaggcggaggttgcagtgagctgggaccacaccattgcactccagcctgggcaacaagaatgaaacccagtctcaaaaaaaaaaaaaaaaaaaaaaaagacgtctgcgaaagtgtctttgaaaagtataaaaaattgtatccagtagataaagaagaacaaacaactataatacctcataaagatgattgttattattaaaacaactatatataaataaaaataaatagaaattacaaagatgctcggtttttattacctatttagtcttggtgtcttcatttgaataatggtttgggcaacttaatgagaataaatactttattacaggtgaacattttgtggggtaccttttataaacagagttctataatcacactgtgaaaacattaatgattactgatacctcaccttcataataaaaaacaatgatatgagaaaaaaagcagttacttacgctctgcttttaactgtccaaggatggaattttctcctctgcacatggttctgaaaatatgtaaaggagaaaataattacagaggtttcaaaacaaccaatcccatgcagtatctgtaggtttaatcctaacacaagtaaaaacagaacaagtgcttctatgagaagatgctacatatatatctaaatgctaaaaacagttacatgaatatcacttttgtaatgctactaatagggacatgatagttgttttgaggtaggtaaatggaaaagttataaaattcgtgttagatttcagaaagagaggctattaaaaaaagaagggtcatgaatgaactttccctcttacaaaactgggtaacagcaaagataaatttagaatgcatcagtagataagaatacttagagaatcacattgctctcagaggtgaaaagggcaagcacttagcagaataatttacaaattaaactattagaatggactgtctttaaattcagcaaaaccactaaaaacgaaaaatatagtctcaaataaaggactctgctaatgattttgtttcttaagactctgataatcactgatgaattataaaatctgacaaaaccaaaaattctatgcttcatctgcttgctctatgagagtaataaagagtatacttatgcctgagaaatgctattattaaagatgatgccagcaaatagagatgtttttgcataataaaaggttatagtttttgtttctgaacaaaagccaaatgtgttatttcattcagctggttcgaaggcaagaaaatagtcatagaaaacaattacaattaacaatattacaaaaataatattagaatggcgaatgaaattgataaaattcaattaaacattatgtcagagccttaaatacttgaaaagctttatcattttataaatcagataatattagaaatgtgcaaatcttcagtccaagtatataggccaaagcacagttaaagctctcttgtactgtaactaggcagaagcaccctggaggaaacaaacaaacaaaaatctttccttgaaatcctggcagataaacagatacaagcttgaaacatcagtaagaaaaaagaggattaaaaaaaaatttccactacaatggtgcactcgaactgtgcacagatcctccagcaggagcatctggcgagggggcccaagcaggagggcatctaagtctccacccccgatttgaccaaggccctgacccctaatctgctttacttaccaaaggttctatgtaaagtatcattcgtcctctcccacctttcagaagggtttgattagaaaggtgagaaactacaggtggttcagaaaaataagagattttggttaagtgaccctgagagaaggtcagaggtgcatttccatccccatctatgcaggctttctagcctgtgctcccccaacccaccagctagcactttccagcccttttcacaatgctccactggccaaatctgaagcctcaagaggaacccaagtgtgcccttttaaataaatataaaaactcagcttttaaaaatatcaagcacaaaactttccctaaaattttaacaaagatgtggtagagaaaacaaaattccgggaatttatttactaacagaggctatcattatcaaccttgttgaaggacttgctacctaaagaatcataaccaaacacaagcaaatcttaccatttcaggcatttaattttttctctatttactgcaaagtacatgtaaagctcaatagctatttacccacttaaagataagttttaatcaacattatacatatatagaaatagacagtaactatacaagaaggactaatattttagttcttttatgtttgccatgtgtcttaggccaatcatttatcattgtaggctccatttgaattttatcaactagcaaacgggccaagatttgaaagtaaaataaagtgttcatttgttccccactccaccgaatggatgtggagaaacactgccattcccttcatcagcttacatgatgcatgaccgaaagctcaaaatagaccatttagagttttggcacctgtagttgaagtgcatgattgcctgtagagcatttcctccgccggttgaaatgtctccttcgaaccctggcagaagtggtatcacgacatatacccggtatttctggttttccctgcaaaggtcagatgcagagaaattcacccaaaaaataaaaggtagtatcaattttagatgacagccaagcagttcacatggtttttgagattgagtgaatggcttcctacaacacgttctgtcacatttcaggacttgggagggtgtgctgttggactggaagacagaagctgtcatccaggctatcgcttcatagcctgaataacaagctaaacttggcagtaaagtagaaattgtacccattgtctctctacagcataatcgcttgtaggacaaaatgcagtgtaagaaatccttgcttggatcccatggaaagaggcgggtaggggaggctataacaaagttttggaaaaagaacttaatagttaacacagtacctagctagagccgtggaaatagtagacattcagttaataattgttgagtaaatcagttctcatagcctagatcgcaggggcaaaaagacacactggacccattacattttccaaaacagaagtcatcattatctacttagaaactctgagttttcagctgtaaaatgttaccctaggccctttaagaattctgagtggccggccgggcgtggtggctcatgtctgtaatcccagcactttgggagtccgtggcaggtggaccacgaggtcaagaaattgagaccatcctggctaacacggtgaaaccccgtctctactaaatatacaaaaaattagccgggcgtggtggcgggcgcctgtagtcccagctactcgggaggctgaggcaggagaatggcgtgaacccgggtggcggagcttgcagtcagcagagatcgcgctactgcactccagcctgggtgacagagcgagactccatctcaaaaaaaaaaaaaaaaaaaaaaagaattctgagtggccagtatgtatatttaagtcccctgcacatacaacacaatatttcatgtcccattctctcaagtgattaatgacaacctttgaaagaaaatgaattctactcaatgatataacaatagaagaagaaagtgtagctttctctctttgacgggcattcagaaaatcagaaatttgaagtatgctccaaataggtaccatttattcagaatcaaaagctattaacgttcttgtctctatttataggatatacagggagaagaaaaagcctcgaaaggaatgtgacatacactgtgatcaatgaatctcgctgggatatccgggaggactatattcacacaaaggtgttgtcattggttaattttcaagtccgatcctacttaaacttctcatttctaaagtgcattttcttctaaacaactaaatttttctttcatgtgaatattatcagtactctttgggggatcagattttattactgatgtctctaaagtcgatgtcagggcaagtggaaagagaagttcagggcagaaatgactaccaacaatgaaatttggaggcctgtgagtttggctgccatgctaagaaacaaggatcttgagtaggttgttgtaatggcatggattattcactagatggcaaacatagtttgagttggaaagaagacattaaaaaatgtaaactgttcaagtttgctgcttggtaagaataaaaggctcacatccctaaatggtgagcaggatagcgaaaaagaacagacaaaaaaaaaaaaaaagaaaagaaaacctaagctattaagctatttccccacagccaacatttaaaagtcaaaaaattaaactggacagttaaaaatggatgtcatttggcctcaactgccttttcagaattcaggattatactgccttacagtataatcctcccatcaccacagcccagtgacaggagactaccaccctttgttcagaggtacaccttcctactaataaagcttggctcatcagccttctgggcctccagtgaatcccacttcttctaggtcaccttattggctatttcctctgccaagccacttggctcttccagtcagagttgttttattcttgcctcggcactcatagcacatggccaggatgtctgttctgcactctttctgctttacacgatagtgatacacacatctgctctctaggctatgtgataagctcctttgaaacacaggatgcctgcccacatatctttctggttttggtagtacccaatcaaagacccttgcacatgctatgcactcggtattatttgctttaggaggatgggatcaggttggaaaaatgtttctggggaagtttctggtagagaagaggttaagctgaacaggaattttttcctttaaattaaattacattttgtttgtaaagtgtatataatatattacatacatttttttctttaaataaaattatattttatgtctttaaattaaattacattttattgtggtaaaatacatgtaatataaaatttgccattttacccttttttttttattttgagatagagtttcgctcttgttgcccaggctggagtgcaatggtgcgatctcggctcactgcaacctccgcctcccaggttcaagcaattctcctgcctcagcctcttgagtagctgggattacaggtgtgcaccaccacgcccaggtaattttgtacttttagtagagacggggtttctccatgttggtcaggctggtctcgaactcctgacctcaggtgatccgcctcggcctcccaaagtgctgggcttacaggagtgagccaccgcgcccagcccccatttttaagtgtacagttcagtggcatcaattacatatacaatgttgtacaactatcataatgatctattcccaaaccttttcaacatcccagacagaaactcggtgactatccagtcataactaccctgtttttccctgcctgcaccccttggaaacctctaatctgcttgtctctatgaatctgctggttctggattttgcatataattagaatcatacaatacttgtcctttatgtctgacttgtttcgcttagcataacatcttcaaggttcacccatgttgtagcatgcgtcagaattccctcctttttaagactgaataatattccatggtatgtacatatcacattcatctgttaatggacacttatgttgtttccaccttttggctattgtgaataatactgctataatactagcatacagtatctgtgagtccctgttttcagttctttggggtttatattcaggaatggaactgctgggtcatgtggtcattctatgtttagcattttgaggaactaccaaacaggttactttcaaatgagtaacatatgctcatagtacaaaatgtaagaggtagatgattatacagtgaaaaaaaatctctctcactccttcatcctgagggcaactcctgttaacagtttcctccatgttcttttagaaatagtgtaagaatttataagaatatatgtattttttccttctacacaaatattagaatactataaacacttttctgaacatgatttttatcatttaacagggtatcttggaaatccttccacataagaacatagttactttttttttttttttgagacccagtctcgctctgtcgcctaggctggagtgccgtggtgcgatctcggctcactgcaagctccacctcccaggttcatgccattctcctgcctcagcttcccgagtagctggcgctacaatcgtctgccaccacgcccggctaattttttgtatttttagcagagacggggtttcaccgtgttagccaggatggtctcgatatcctgacctcgtgatccacccgcctcggcctcccaaagtgctggtattacaggcgtgagccaccgcacctggccagaacatagttactttttaagaacagggaggtaatattctaccatgcatctatactttaatatttaaaccagttctttactgataggcatttaaattgcttctaattttttttctatttcaaagtaactattttgatatttacgctgactaacaaaagtaatttttcacatttgttggaaaaatcttacaagtggtattgctggtctttgacacaaatgtttgtgatgatgtttgtaagagacagttctattttatctttttttttaagcaaaaatgattttacaagggagatctcatatgtatgatattgagaaatgtcctataaaaatattataaaacattcttgcaaattttagtttgtaggaatcagaatattcacattttcttgtttttaggactctcttagctccataacaagccctttgctattttacaatatggtagctcataaatttcctgaatgatgaaaattttaaactgcgttcagcaaactagtggaaactatttagattttcactgctgtagaaaaaagggctctggaatttcaaacgcaaaattgtggttgaatgtaagccaaagcacagaagattccatgggacactgtgtccaatctgcctccttgatccaatccacagaggacaagagttccagctgctgaggaatccaacgtccttcggaaatactgaatcctcacaacatgggggttgtggaaatgatagcattcagcttagggtaagaatctgagcccctagtgtataaaatatttatgatcttaaaagcaatcttgcttttggggctagtgggcactaagccccggataactacccatcatgccagcaatcacttcatccacattagttcaaagcaatttctaccaaacagcattctcaggcttcttgttaaaagtttttcttcaaaattcactaactcttatggcagtgctacgtataatagctaaaaattggaaataaatgtccaataataaaggaatggttaaattatgttgagccagtcaatggaatgatcaccttgtagccactaaaaatgaccgctatgaaggctcagtagcacaatacttctggtactgtgttaaaatggccccaatgcaatgttataagagaataaaaatgtggcaggccaatgctataaaacattaaatcatttttccctttaaatgtgttaacttcccccactctgtgaccggagaaacgaagcaggcattgctcccggggtggcactctcacaagggaagcaggacacaaaaacatcaacttcttttagatttggggaactggagagattctctaagctgaggcaggagtgtagagaaataagagcaagactcagggcaaggaatcagtcctttggcctcaagctgagttcggggaaaaacaggatagaccccactctcttttcaatgtgaggatatgagagccaggaggatctgtgccttgctttcaggtgaactccagagaaatgtggagcatgtcgttcagcagctatgcgatgtggcaggagcagaggagaagtggtagagaggcaggcctgaaaggtgaaggctgacgtccccaagctacgttaagcagatgccagaacaggccggagggagatcaacatcagtgtctggaagcccctttccaaagatccagggccccatagcattaagatcaaggacgggatgtggagggagaggaggcaggagtagaaccctgatgctgaatatagaagggaaataatgagaaatcactgaatttggccacatttatcaggaagtgccaaaactaaaactaaaacccctcctattgtgtggaaatgcgcttgagctagaaattcagatgaactctaggaaaagaaaataaattacaattcaacagaaaatagtagtgtgtgtgtattagccaggcgtggtggcgggcgcctgtagtcccagctactcgggaggctgaggcaggagaatggcgtgaacccgggaggcggagcttggcagtgagccaaaatcgcggcactgcactccagcagcccgggcgacagagcgagaatccgtctcaaaaaaaaaaaaattaattttaaaatttttgtgattgctataaagctgtttgtacctttaaaagcagagtacgaatgtaccatgtagatgggtcacagcagtgatgtacctctactttccttttcttgtttttctctgctgcataagcccctcctccttcacccacagtccctcctcagcatgaaggacagttaggagaagcttgatctgctcacaactgggtctcagggtctggcaagaaggccccgaggaagcttgatatgcttcgctagtgacaagacactttatttttttgagaatttgagatttatagtttgtatttcattactgtaaacttcaagagctgctataaatcgtctcgttgtagattttgcagcagtgaatactgtcagaaataggaagaattgtggttagggcttagggtgtgtgtgtgtgtgtgtgtgtgtgtaaagagaattttatactatggtggtatcaattatgttggaattggatctgtagcttcttggtcgtttgggacataaccccttttattttgtgcttggcaaatcctttaaaaggagaagatccttctgggcttcagtttcctcatctgcacatgaaagaactggctaaaatcatgactagtccactagaaatgctggccctatttagcactgactttacctatcctctatgtgacttcatagattatgaactattatatattgtgcacaaacacacatcagttttctcattggttatcttttgaaaatggcaagctttcaaacataagaatgctgagggattccccagcatgtttgacttagacttcaccctgggcttgatagtctttggcaagcctagccctgagtggcccccaaatgaggttatatagaaccttatactaaactgttcccactatggcccagacggttttcattgtcatttttaagtctccttcttccttcctctcttttccagggcacatgctcaggctcaaaatgagtgctggcccctgccctgtgctaatctttacatttctctatctgctgaggttaccattttatacaatttttagaatagaataaaagcatttacatgacctaaatcaaaaggtctcctgccacgatctgttgtcatctgtgtcccaaggtaacctcttctccagaaatcgtacagagcttgggagttatcccacaagaaaaaatgtgaaaccaatgattggcatacttagataaaatgtgttttggccaggcgcggtggctcatgcctgtaatcccagcactttggcaggccaaggcgggcggaccacgaggtcagcagatcgagaccatcctggataacacagtgaaaccccgtctctactaaaaatacaaaaaaatagccaggcgtggtggcaggcacctgtagtcccagctactcgggaggctgaggcaggagaatggcgtgaacccaggaggtggagtttgcagtgagccaagatcgcgccactgcactccagcctcggcgacagagtgagactccttctcaaaaaaaaaaaaaaaaaaaggtactgcagttgaattttctttaagacaaggcttctgaaacaagcccaacatgtcttttcagtttggtacaaaattataggatatggtaattatggacatagatttttctttaaacccaagaacttttaatctatcaaacattgcttttaaaaaataaaacattcatctgattttttttttctttttgtgacagggtcttgctctgttacccaggctggagtgcagtggtgcaatcatggcgcactgcagccttcacctcccaggctaagagatcctcccacctcagcttcccggatggctgggaccacaggcatgtaccagcacactcagctatttttttttttttttttttttttttttttgtagagactaggtctcactatgttgcacagactggtcttgaactcctgaactcaagtgatcttcctgcctcggcctcccaaagtgctagaatcaaaggcataagccacagtgcccagctcattcaattttttatatttcaaaataaagtatttttcatagatttctgggaggcttaccattcgaaaatttctacatcccttgaaatgggggaagctttgtagcttactggtaaaaagcacaagttgaggtcctacagacatggtttgagtcctactcctatccaaccatagctgtatgacttggctaagttatctaatttcactaggcctcagctgcctcatctgtagaatgggagtaattacacaaccaatcccataaagttgatacaaagactgaatgaggtaacacaggtatagcactgattatgtggaaagactcagaaactatttggtaacatttttattcaattatatcaattgctgatttcaattagaaggcttgcatatcttcaaataacaacaaagtaaatagcatctaaaattaaaacaatactaaactaaacacatattatgcttcagaatacattttgttttactttatattttggggagagtgttatcagatcaataacagggaaatcaaaaattgattcccaggaagagtcagctataggtttctggcagcaaacctctagacagagtgttgtaatcgtgtgcctaaacaagtcacatgatgaacaacagccagtcgtgagaaaccaaaacaaatttttcttatccagaagtagccgtccaataatttaaaatacggaacatttaagcatcttttaaattaaaacatttctttttctagcataaatactaattttgaaacagctgatttgaatatgatgcctctttatccttgcttcaatttacagtgaacaacatatttccagatgatgaatatcatggaaatgctataataagttcttacatgaactggtgctttacagcttacaaactactttcacatatattcatataagctacgtagaacagataatattattcgtggttggtgaagaaacagcgtgtcagaaggacaaactgacgtactcagaaggtcacatacctgtggataacagagctggagagaatccaggtctccagacatctggtcccccaataatttcagatttcccagtgtggtatttcccataccacccacttacaggcaagcagtagctcttctacagttataagaagcatgaggggcactttgggaggccgaggtgggcggatcacttgaggttaggagttcaaagctagcctggccgacatggtgaaaccccgtctccaccaaaaatacaaaaaaattagctgagtgtggtggcgggtgcctgtaatcccagatactcgggaggctgaggcaggagaattgcttgaacccgggagatggaggttgcagtaagccaagatcacaccactgcacttcagcttgggtgacagagcaagactgtctcaaaaaaaaaaaaaaaaaaaagaacatggtaagtttgaacaatgttcaaaattgttgttttaatgtagtttaatagcatatttttaatgcagtttaatattaaaacatagaagcattaagtcaactgactattttcattgtgtgtgtcaactgtttgttgctaacactataaaatgcactttctcacttcctgactttctaccaaagcagaaaaattatgcatgtcaagtttccatgtgcaaagatctgagaatctcctcagaaaccattcattcatggcacacagtgtttaaaaatgtgtctacctggatcagttggtcctatcttttggcttagtcaaacatggcataaaacagtaaattttagactgtggattatgattttttttctctctgatcgccaatcacatttgagctgtcaaagaaaggtttcaagtgggttgggcagctggcttcaactctgagacagttttacttattagagtgaagatttgttttttgttttttttttattctgattcccccggctgttctgaggtcagcatggggtaaacatgagtctgaggctctaggtcatgtcagaacatgaaggctttgcaaaacttatttctataaagaattatggctgttgagaaggaaccagaggaagtgagaggaactgagaaattgcttaggggaattgttgtgaggctggattccaacgctggcagaaaaatacttagaccagtccagggagttggcaatttgaagactcagatttctccagggtaggagggacctggcagagggcctgtattctttggtgaggcctggctgactgcggactgtcatttccctccatctgctttgggctgcattctattctttttcaaatagccaaaattatacttgttgctaagaatgtgactttggcagggaagttctgagtctcagaaaagtagagaccagagaagtctatggagagagaggggtaagtttgggatggcacatcatggcacctaattagtgaaaaggggtcaccccagggtggcaacctgcaaaatatgttgtttctttcattttttatttatttatttttttagagatgaggcctcattctatctcctaagctggagtgtagtggtgagattatagttcactgcagcctcatactctcaggcttaaggaatcctcttgcctcagcctccaagtagctagaactacaggcacaccaaaacatctggataattttttatttttttgtaaagacaggtggtctcaaatttctagcctttagaaatcctcccgcctccgcctcccaaagtgctgggattacaggtgtgagccaccacacctgcccaagataagctttttaattctgcctttaccttgcctaacacaagctcacagaacacaagctcacagatttgaaattaagtgaaaatatattttacagttgcaattaacatagggagattaacaagaatgcagagacgccaggggtgaggggaacataaaatatgttttgagaatgtgtgtgtgtatccactgaaagtctaaatgtgtgacatatgtaccattttgaaaatgtgtctgtcaaaaaaatgagactattgagagatcagagctaaatgacacaggtttatttgaaatttgatgaactaatttcccatttttcacaaagcaaacttgaaattgccagtctttaatgtgctctgtcaaactccaagtgtaagatacaatctgcaacaggtgctactttaccataatttttaaagtcacagatcccttttcctttcaggagcagctcataagatcactaggaaatgttctatcagaaaatatcttgaagtttcttgtagccctaaaatactataattttatttatttatttatttatttatttattttgagacagagtcttggtctgtcacccaggctggagtgcaatggcatgatctcagctcactgcaatctccacctcctgggttcaagcagttctcctaccgcagccacctgaacagctgggactacagtcatgcaccaccaagcccagctaatttttgtactattagtagagacagagtttcaccacactggtcagactggtctcaaactcctgacctcaggtgatccacccgcctcagcctcccaaagtgctgggattacaggcgtgagccaccatgcccagcctaattttattattttagaagtccagatttttaaagacaaattactacagtaaagaaaaatattctttcaggcttccaaacacttaaaaacacatctttggaacagtataaaataccggggccaggccccgatccaggaaattatgatccagtaagcctggaggtgagtcaagctctctgtaatcttgcaaaagtcagtggtgattttgatgtgtagtcacaggtgagatccactgtacacactgcaggatatgatggatgctgtagtgtgctgcctagatcccctcaccatgggatcaagacatccatcccatcagctactgagcatgtaggccacggaatactcacagtgaagtcctccaggtatgaaaagtatggagtcctccataggtgaaagggacttgcctcactcaaggtcatccccactccctagggtcagcctgcatccaatggctggtcaataggggaagggaactacaggcccaacacatttgcctcagcttggggaagccctgaatgggtttttaatcctaaccatcaatgcactagagtcatgtggtgtgaggggaagcattgggttgaaagtccaaagatttaggctcaaagctgttttttgcctattgtggttagtggcctagacaagtcacataacctcttgaatctcagtttttaatcctaaaaatgggaacagcaacaacagcaataataacaacaataacaacaacaaatacatgacctactctcaagtgtagttgtgaagattcagtgagataatgtagttataaactgtgaatcacataaaatgctgatagttactgttataatatgtccttaagtataaaagtccccaaatattatgtgaaaaaagatatcaaagtaccacatgacactggaagtaaaaagtgttttaattcccaaatgcatatgcacttattcttcactgcgtgcattcaatgacttaaagtaatgaaatataatggttttgcttatgtgtttgttctgctacttttaaatggagctgaaatcagccataagaagaaattgtccctggtgccaagacaattcaatgtggaaagaatagtctttttaacaaatggtgctagggcaactctatatccatcaacaaaagaataaaaagttgggcccctaactcaccccatatataaaaagtaacaaaatgagtcaaatatctaaatgtaggagctaacactataaaattcccaggagaaaacaggcataaatcttcatgatcctagatcaggcagtgatttcttagatatcactatctatattccttagataccaaaaggacaagcgatacaaggaaaaaaatagataagttagcttttatcaaaataaaaaaaatttctgtttcaaatgacaccagcaagaaagtaaaaagacaagccatcgaatgggagaaactaggaatcatatatctgatatgagacttgtatctagaatgtataaagaattcttacaactcaaaaataaaaagtcaaataccccagtgaacaaatgggcaagggatttcagtagacatttctccatagataatacacaaatggccaataagcacacacaaagatgctcagtatcattagtcattagagaaattcaaatgaaaatcacaatgaaataccatttcttaaatggtatttcacacctactagaatgactataatcaaagagagagataataataagtattggcaaatacagagaaactggacctctcatatactatgggaatataaaatggcagagccgctttggaagacagtctggcagttcctcaaaatgttaaacatagagttagctataacctgacaattctacccctagagaaatgaaaatatatatctgcacaaaaactagtaaaggatgtttatagcagcattatttataataggcaaaaagtagaaacaacccaaatgtccatcaactaatgaatggataaatacaatgtggtatatccacatcatggaatattatctggcaataaaaagaaatgaaatactgatacatgctataataatagataagcttcaagaacattatgctaagacaaatcagtcataaaagaccccatattgtgtgactccatttatacaaaatgcccagattaggcaaatctatagaaaaagaaaaatcagtggtagccagaggctaaaaatagaaggaatgggtaatgactgctaatggggtttctttctgagtggatgaaaatgttctaaaattgattaggtggtggttgtgcaactctgtgaatacactaaaaatcactgaattgtatagtttaagtggctggattatacagtatgtaaattctatctcagcaaaccaattattaaaaaaaaaatcccatgagctgaataaatatgacatacggtaacaagaatttaaatataacccatagcaaaatattatgtctgttttgcttttttaagcgaacacagctcatagtctgctattaaataaaacaaatcacaaacctcatgtgtgggaaacagactggccaggaagaaatttttgtgccttggaagaattcaaattccctagaaagggcagtcaaaaatctttagcaactgactcagactaaaggcatcaataacctattgctggctgaaccaaatttaagctgctaggaaatgacagtactttaaaaatgggctttgcaaagtcattttagtaataaatacaagaacatctgcagcgagaactctcagccaaaggctgttacctgtgagctttcaggatcctctgggcaatggcatcgcctatcttgttgaacacaactttgtcatcagcacagcttatgaaaaactggttctatgagaaataaacaagacaatcatgttagtctttattttcttagcaatatacgtaagaacaatactgtaatatattttttaaaatgtttcacacagcagatgtgttctgatcactgaaatcacatcaagaaagtcaacgacacagaaaaaaagccgcctcatctcactcagggtctcatctgattccaggtcatatcacctgtaacacttaatcaagtggaaagttacactatattatttcaccatgagaattccttataggtgattttctaaattacattctcagaatacttaggaacactgcaaatttaatcaatggggaaactagtttttttcagattcacatgttgtataaatgcttatgattaaaaattctatattggcaaacattctatctcatgctaagcttgcttttttaacagagtagatggtaaagcctggtctagttttctccaccctttctccattatttcctggtatctgctttcaccttgtcttgtttgtctgggtctcttattatctctgaacttctattttaagtagcctcaactctcttttgtatgttgcatatatataagccagttaataaaataaaaaatgtttttttcctctaagtacttctgctatttatatatctacaaaatagtctttaaaactgttactagaaaacaagttacaacattatcataacaatgcaaaatattttgttgctgcataaaggaatgtgaaaaatttggtgcaaatattactaatgttatgtgttcaaatagaatagattgttataacacatctgtaatttataaggacaattatcacaaagtaatatttgctaatcatctcaaggtaaagagatatatatgtaacaactcgtaattatcatccctttgtggcattatcatttttatgactatataagcttttatacttaagtgcataaatctgtaaaatgcctccagaagacaaacttacaggaagacacggtgcagaaagtcttttgagaatgtgattccccttagggcatcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactactgtcacattaaaaagaaaagctgattattttattttttattttttttatttttttgagatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctcaaagtgctgggattacaggcatgagccaccgtgcccggccagaaaagctgatgttaatgctactaaaaagagatgaagcaaaatgattctgggcaatagatgagccagccttcacatctttccatctctatggtataattgtttaaattaataatactaatagcattactaagctccagactttatgcagagttcgctcattttccactaatgtcctatatctattccatgatgccattcaggataccacactgcatttagccagctaatatattatatttaacttaggtttctctagccaggctcatgaaacaaataaagctccaattcttccctgcttgtctctaatgaattgttgctgtgcagagcgggagagggccaggacccaaggggaagaaaaacagggctagaatggttttcctcagttaacccattcccctatctacctttaaaaaattcaatgggaaagaaaagactcaaataaggaaggaaattatgctatgatttattttttccattattgtgactttttattttctcagggtttttcaagttctctgaactatttttatattcactttgaagagtaatttaagttcccaaactaaactcagtgtccccagattttctcatatgctctaaaaattctgggatgaaaaaaagcttcctaatcaatagtagttcacacaggattgaagaaggtggtacctgctcttaatgttctcacatcttccttttccacgttcttttccctgcactctccctactccgccatgcccaaaccagtggcatccagtggtctctattttagcaactcacccctgtgtgtgctctcctgaaatagaacttgcttcacacttaaaccctccaacccaagcgaaaacaaaacttacctatccatgttggggtatttctgtctaatactattacaatgagttgatgatgcattttaacagcaaagatttgtgagactcccaatagaatcttgagttaatgacaatgcagagccagttccaggtatgcttgggaggtcaaaattcaggtgatatgaaccagagcttctccagcacttttcacgcctcaaaatatacttattaatatgaggggtcctaagtttggggaccctgaaatctctgcatgatatttaagggaaggcagtttctcacacgaatttacatgagcaagacttacttcgatatagatatagtgcctgctgttctctatcacatggacgtaagcggcgtggatggactcttcatggtactttataccagcagaccaatcagcagcagagcggagcaactacaaggcagcaatcagaaatgaacaagtattagcaatggagaggacatcagatatattaatacaatgaagtcactcctttttcttccagacgactgaatgattacagtggcttgagtgtcatgtgtgaaccaaaggagagtagtggggtggggaatgctgctaaggaagaggggagaaagggggcaactggtccttggatgtagtccataaggaaggtcctcagctggaaatcacatcctgaatataccctctttcatccaggattattttcattcaaaactggaaaccacaaattgtggtttctacaaagactatttcagaagtacctcttctgatggctgtgagtatggtaaccatttgtattcctttcctatgacagtccctcaattataccagaatccctgttgttctggtgcatttattcagagcacccatctttactcttaaaagggtactggtttggaccatatggtatggccatcctagctctgacttaacaatgtgattattccttttcccctaaatagatattgttcagattaatacattctaaaaggtaggtcatttggcatgtgatcttcattctacctttaatagctgtctgttccatggcacgccactttagtctaaactttctaatggcataataaaggaaattaatcacaggaaagagaactggggctcagagaagcaaagaaacttgcatggtgtcacagaggtactagcatcagcatcacagcttgaacttgctttttgtcattccatatccgaagtttttctactatgccacactgttttgccacttcatcacatgtgtgtggcatgccagtcaatttgggattgatcccatcacctcagattaaacccatcgaagtggagctcctgacttttttctctaaaccatttcccatttcaaataccccactggccaggggcataccatcattctattagtctttggcatgcctcttctccttagcgtctatattcaatctcacatctacttcagtttattctttggaggatttctcagatttgcctctttctcatcgctcacattgcctcgctctacgcagacactcacctgtccaggctgtattactcgagcttcttctcgctcagacacctgaatataggttatatacactgatgcagagcaggactgtctaggttcaaagtctggctcaactatttactggctgttgatcgtgtttcttaacctctttgtgcctcagatttttgttctataaaatggagttctactttatagggtcatagagaggattaagtgaattaccgtgaaatgtgtagcaggaggcctggtatctattaagtggttataagtgttatattaatgagcattagaagatgtgtttgagctgtggcaggtcatgtcagggatgctgcagagcagactgtggctgtgcacagaagaaaggatgagagaacatggaaagaaggtgttctcaacactcagcaaccattggtcatcacttttttccaacattctaactagcattgcagtatgatgttggcatatagtaggtgcttaaacaatagcatgacacacagaagaattagtataaaaataatacttgctatttctggtttgaaatgaatattaaaactgtcccttataaggtcaactgatattgaaaataaaaagaatgctcccatactcattaggaatatacaaagcgatccaatacataatcagttctatgtctgctgtatataaaaggcctggaaaaattcttgttcaaatcaataactttaaaattgcaactatacggccattaaatccaaaactcacacttactaaaaatcgctgactgtgccatcctcagtagtgttatttctttatccaatatgaggtatttattacaaaatatcgccaatcaaagcattaaaaaaattatcagatgaatatgtgcaacaaaatttcaaaatttaattgtcaacatgaatatattaaatatcatagaagagaactcataaggaaaatttagataaatattatccacactggaaaaatatcatgattttacatcatctccaaggagctgcattattattcatcaggtagaaaaaacaaaggttgaagaaatagaagttttaattcttagtccactcaaattaatgtttaattttgttactaaggaacatagcactgaaaatgcaggctactttgagaagattctcatgctatcctgatgtaattctatacaactctggaggcaacgtatacaattgcagattacactggaaagaagggaacctccaggattttttttttttttttgagacggagtcttgttctgttgcccaggctggagtgcagtggcatgatctcagctcactgaaacctctgtctcctgggatcaagtgattctcctgcctcagcgtcccaagtagctgggattacaggtgtgtgccaccatgcccagctatttttttttatttttagtagagacggggttttgccatgttggccaggctggtcttgaactcctgacctcaagtgatccacctgtctcagcctcccaaagtgctgggattacaggcgtgagccaccacgcccggccggaatctccatgatgtttaaatgacttgtccaaggtgtaagagaatttacatataatttaaatatcatggaggttcagtttcctccactgtacaactgagacctctccccatcccctaaagctgctgtgaagaaaaaaatggcataacaaacacaaagtgataataatggtatgtggcacttagtactagatattctatatacagtatgtccacctctgtaaaaagttataggcaaagtttataacccacccttgctggtaacatctgagtttttccctcgaatccaaaaaccttatactttctttcctttctcactctcaaaatttgctctgactcaatgaactcattcacataagattcaataaattcattcacataagatacacatgaggagaattacatcaatgtcagcttgcatatgaagtctaatagattcagagtggcttcctggacagctgggttaagaggcgattcttgaaagcaggtgcactggggaagaattctgagattgatcctcaatggctttcatggaaggggacgcctgaaggtcacatatttgccattttttctgtgaaggataatggtaaatgtttctctatctgtaggcatttaagtatttaaaatattaaagcttcaagccaaaagaagaccattttatggccaggggcggtggctcacacctgtaatcccagcactttcggaggccgaggtgggcagatcaactgaggtcagcagttcaagaccagcctggccaacatggcgaaaccccgtctctattaaaaatacaaaaattagccgggcttggtggtgcatgcctgtaatcccagctactcgggaggctgaggatggcgaatcgcttgaacccaggaggcggaggttgcagtgagccgaaatcatagcattgcactccagcctgggcaccaatagtgaaactgcgtctcaaaagaaaaaaaaaaaagaccattttatatatcagcctgtgggagagcataataagaaaaagcggagggggctccctgatacctgcaaaaccatcaagtatgaggggtttcctacctcctgaggggcttcagcatcatctatcccattgcctgagtccaagccccgtatcctttacttacaataaaaactcattaattaaaaaatgtcatcatttgtggctaaacttgaaacatatctttcaagcaacacatgaagaaaatcacttgggattgttattcatttactactattctaattagttaaaatctccctatcaccacaagaaaaatggaaaatacgaatttccttcttgctctgcctagaccattgaactacaggcagggaaccctgaggttatataaaaatcaacttaactgctttaaatgcttgatggcctaggaagttttatcaacagtcaaataagtcaaacccattgtattcgtctgttctcatgctgctaataaagacctaccagagactggataatttataaaggaaagagttttaatggactcacagttccacatggctggggaggcctcacaatcatggcagaacacaaaggaagagaaaagggacatcttacatggcagcagggaagagggcatgtgcgggggaactgccctttataaaaccatcagatctcatgagacttattcactatcacaagaacagcacgggaaagacctactctcatgattcagttacctcccactgggtccctcccatgacatgtgggggattattacaactcaaggtgagatttgtgtggaaacacagagccaaaccattatcacccattttgattgatttccttttgttttattttttcacctttttccattgccactgagatttccttttgttttaatatttactctcttcattttcttcactgacttcaccaacttgtcttgcatttctgttttaaaccaatgtaactgagataaccctcaaactgttccctcacatgcaaaaatatagcttatcttaccgtcccaaatgtgctgggaatcaaatctaatctatacttttcaaaccacgagtttgaatacataattttaaaatatataaaaaatggcatatttctgattttatggtttaacctcaaagctgtaacttggactagtcattttcttcgtgctacgtcttattttttaacctaaaatatagccttctctttaaccacaatccctaatcaccttccatcctatgggcccaagtcaaatgtatggattaaataacagaaatttctttctgaaggaaaacctttggatctttcttagtatttgtcccaaattcccttcctttctctcatcataatgcttttattccctataaattcagcacatatatgaattcctttttatttccctgagattccaagtcaatcatggaacaaagactatttaggacaaaagcactttttatatgtttcacaagcagaggccaactgtgtagaagctcacaagtggtatgcattggggagagaagggaagcctctgattgtcgggcctttttcttccagactgtactgagaacagcaggcaaggagcatcaagaaattgacctagttcaagaacctgtctcatcttatcaagctctttcttttcatagccacttttctagttgagtgtcagccattcatatcacagtgtgcagttattcacataggatgattcctttcctgaacaaaagagaaaagttaattttgaggctgaaggacagaaagaaaagataattattgaagaataggacttaaggtgaaagaagtcctaggaaacacagtattagttgggtgttcttgggagccagaaagaagcaaaaggagagttagggatggatttggggctgtggcaacagaaggtgatacccaaaggcaaacaggacatgaaactttgctctgctagagccccagcagttacaaccatcctggtcttactggaaacagtatccatagctaattaacctcaggcactgaagccaaactgcttagaagcaagtcatccccaccacttactgtttgtggttttgagatggagtctctgatgcccaggatggagtacaatggcgtgatctctgctcactgtaacttctgcctcccgggttcaagcaattctcctgcctcagcctcctgagtagctgggactacaggcccatgccaccatgctgaactaatttttatatttttagtggagacagggtttcaatacattggccacgctggtttcgaactcctgacgtcaggtgatctgcccaccttggcctcccaaagtgctaggattacaggcatgagccaccgcactagacccccactagttaccgttattttaacctctcaaagtctcagtttcctcatctgtagaaacaggctgcacaggagtttagcttacagactgctgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcactttatttttcacctatctactttattctctcacaccattctgggatacaaaacattttgctgtcctttcagatctaacagatccttgggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactgaagacattattccagtagagttatttccatataggcaggaattctcagcatgactgtccaaggaatggtttctactatgagctttaaaaaggattgttcccatgtgttgaccccatgttgatgctgacacggcattcagcattttctttcagcttaatagacatgtcaaatatcctctgtctttataatatatcttaaatgccattaagaccattctggaactgagtttattctagttccttcaccttctctgtgtagaagcagtttcaggaccatctctcccacttcctcctgctacccatgccttttcctgccatgtcttctctgagtgctcttggcaggcttctgagaaggcccagcactgaggggaaacatccaagattcttttaaaagtacagtggaagctgctgaagtcagctgtcaggtctagataactttttcaggagcagcaattcgtgctggtgggcaggcatccatactgcctgccgtagctcccctctccctggctggctgtgtctccccctctggaattgccagtggcgtgtgaccaatgtttctgtattaaaaaaattaataactaggtgcccttctccagaagaaagaataacttgaattttatctattatttactttattatgtcaaatactctttctccccattccaatagatttatggcataaaaatttctatctagaacaagcttggtgacctacccagagaaatgttaacttctttgttgcaaactttttttgtttttgttttttagacgagttttgctctgttgcctaggctggagtgcagtggtgtaatctcggctcactgcaacctctgcctcctgggttcaagcgattctcctgcctcagcctctcaagtagctgtgattacaggcatgcgccataacgcccagctaatttttgtatttttagtaggacggggttttgccatattggccaggctggtctcgaactcctgacctcaagtaatccacctgccttggcctccgtaagtgctgggattacaggcctgagccactgcgcccagcctgttgcaaacttttgaaacactagcgaaagcttgaaggctgtttttgatggaactcaaactggtatactcttctaaatgctttgcatggattaatttaaccatcaccacaatcctgtgagacagatactgtcatttatgttttttaaatgaatgaaacatactgcagagtgaagtaattttcccgaggttacacagctcatatgtcacagagctgagatgttaacacagtctggctctagaatctatcccttaattgctaccttatatttttcttcacaattaaataagcttgtggcttctaagttacattatgaacagtcaactatgttaaaatcttgttctcactcatatgtggaagcttaaaaagtcaatctcatgcaagtagatagtagaatgatagaaactagaagctgggaagggtttgtgtaggcgggtacagggaatagggtggagataaagagaggatggttaatgggtacaaacatagaaggaataagttctagtattcaatagcagagcaggttgactatagttaacaacagtgtattggtatttcaaaagagctggacgagaggacatgaaatgttccaaacacatagaaataacagaagacttgagatcatgacactccaaataccctgaggcctctttaataaaatcaatgcaaatttacaaatataaagctgagaacaggtctagaaaaggcctgggtggctgagggtcctaaagctaagcaagggcctgaagctgcaaggaacatgagttcctgaagggagcaattcattccctacttacagccttaactccagccagtctgtaggagattttactttaggcactgagatggcaaaaagctaattatagaaatagcaggttttcaggaccagaggaataaaataaattataatcttataatcttggaatttaagagttcatcagtgatgtcctagtttcttaactcttatccttccttttaatttttgtcctatttatcactgccatgtggctaaatgtacctatgatgttttaatttacttagatattttccttttctctcaaagatccatagaaacaagtttaatgatcaaggtaaaaattctgagcaatggcttctatttctatttagtgataagtgtcattctaactactttaaaaattaagaagtgtatctgtggtggccatttgagttttattttgtgagggatcataactatagcaggaggattaaatagaaagtcattaacacctgtactttgaatgatacctcttgtatgaaagacaatgaatgaaaattttccctttaaatgtctgaagggactcagatcagattcataccaaacataagtctttcagatgacaaaactgggctcagggaggggtaatggcatgctgaggccacatgctgctatacaatcttcataccacaccaccttgtgtgcttttatgatttgttagcgtgaaaatgcatgttattatatttagctggatatttccagcagcactgcctagcgacacttttatatacccattttatatatccattatcatgctgcaaaatttatattaccaagaactagatgtactacaggagctacctgagtcctttggtgatctcaattagtgccctggcccatcagtcatgacacagttcctatggttctttggagactttgtgacactaaactatctttaactttttcctctgtcccaaattttcagttagttcctagtcgtgatgtccctttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacatttggtctcaaggtatttgtttggaaagatggaaacagataagaatgcataaaacaagagattctctgtcaaataagcttgggaaatgcgcacatcatattccttcttggtggttttataatacactgtagcataaaaaaggtgctaaggagtcctgtattaaagaattctgcaaaaccttatctgtccatggaaatctttgtggaatagttatcagcatctcacaggtaaattcagtttggaaaactctctcctccattaatcttcattgaacattcctgcatcatgcttcttgcccaatcgaaaaaaaaaaacatccaaagttcactagcacttctaggaccaggtccaaattcactaggacagcactccaggtgtagcccccaccccgcccccgccctggccttatgctgtctaacttcatcagtgcctctctaagagcgaatgggttactgcagtcagtccttttgtcttctgagcaagcaggactattccttagagtggacacccagttctgtccctctggatttccaaactcttacagcatgctggtccttactgtcacaccagcatttactcagagaccataccttgcactgtaactgaattattcatctcagctatctctccccagctaactaagtttccagaggcaaagaactcctttgctgtctgccctctcgacacccaagtgtgctttgatgacttcaccatgcaaacggacaacacttagtaaacatatgttggctgaataaatgaatgaatgagtgagtaagtcttgttaaatatccttggctttgtagattcttgagtccaggccacctgaacatgtgagggattaacatatgagcttatcagatctagtctcatttcttttcttttagtttttatttttattttttttttttgagtcagtctcgctctgttgcccaggctggaatgcaggggtgcaattatggctcactgcagtctccacctcctgggctcaagcaatcctcctgcttcagcctcctaagtggctgggaccgcaagcatgtgccaccatgcctggctaattttttaagaactttttgtagagatggggtctcactatgttgcccaggctggtcttggactcctaggctctcctcctgccttggcctcccaaagtgctgggattccaagcgtgagccaccacacccactctagtgtcatttctcacacaacatcagtgatgcggaaaaagcgaacgaagagaagcattttatagagtctctattgacctcaccaggcagcaggatgagactatgtgagtcagggctttaccaacagtgaagtggaaaatatatgcatatgcaacgctatgctaaaacttccttcattgattacaaaaatacttaattcccagcaatccattttcaacagatacttattaacatcagctaactttgaaaaattgaccaccacgtcaataataatgcaagttcaaatcttaaattcttattttcctaataacaagtttcttattttatattctagcattggtaattttttctcctctacgtagaataaaattaaacaggttcataaaatattcatcaacttacatataaatcatagctatctctatgcctctgagtttaaattagttttctttttagcctgggatgactaatatttgctgccgatatttctctcaagcagcttatctttttttttttgagatggactcttactctgtcacccaggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttatatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccagactaggatttcaagctccacctctgttgataactagctggccggccctagataggcctcagagccccactaggtctgaattttcttatttgtagtttgagatggttaaactggatgtggtaaactgttgtgactctattaagcaaattccttattccattaaaagggcctctagaagacatttggttaatcaggaactaaaattagactgaactacaactagcttcctagctgctaagtttcagccacattcctggtgcttaggcagtatcaggtccaggtttactgggtatcatgttgctagggtcacttcagaaggaattacaggaatagccttggctgtggccttttctaaggacatgcatttattatatttataagagttttaaaaagagactgaattgaatccatttaacataggaaatataataacaagtattaaaagatccatttagttttgctttagaaaagcagtcattgaaaaatctgaagccaatgtaataggcccttggtccaataacagtaattttactcagtagcattttgtcaaaaagaaaagccagaacttacttacctgtacgttagcatggacagacccaggcacttgatatctcaactcatgggctgttgtttgagactttggaagcagaaaaggataagaaagggaccgatattttgatttcataatctaaaataaagaaaaaggataaaatattcaaatgagaaaaaagattcattctccctactttgtgattataaaagaaattcatgcccaggtgcagtggctcacgcctgtaatcccagcactttgggaggccaagaagcggggatcacttgaggtcaggagttcgagatcagcctggccaacacggtgaaacccccatctctactaaaaatacaaaaattagccaagcatggtggcgggcgcctgtaatcccagctactcgggaggctgaggcaggagaatcacttgaacctcggaggcagaggttgcagtgagtcgagatttcatcattgcactacagcctgggtgacaagagtgaatctccatctcaaaaaaaaaaaaaaaaaaaagaaaaagaaaagaaaagaaattcaggttaatttgaaaaagaaaaagaaaaatgttaatggtggacatttctaagtgaagggctacagattatttgtgtttgttttctacttctcacagtcctgtttttaccttttgtaggggaaatattgttttatatttgtaaagacaggttaaatataatctgtagttacagaactttataattgcaaaaatgagactattgttttataaactaattttttactgattatgttctagatatcttgtcacagcaatatagtgggatatcattatttttaataacttcatagtaaaatggtataaaagaatcatttgtttaataaattcctattagtaaggatttctgttatttctaattttatttgaattattagaagccatatcaaaataaattaccttattggattatggctttagtttgaatacccggaaatagtttttctggatcaaagattgcatactttaaaaaagacttattggtgttgtacaaatttatcctccctggggtagcatgtatgagcacaccacaaaaaccaccccaaacctaactacaggtatcagcagagacttttatctttgccagtatagcaggttaaaagtaacaccccatttgtttattcatccatctcccctaaatttttgttaaaaaatttcaattagaatgtccactaaatttttataatcattatgtgaatgaaaaacaaagttagactctaagtggttgataaaactaaattctttttccaaacgaccaaggggaatcatgactcattatcccttcaagtaaataaagtgaaactttaataacacctgaatatgtactttttttttttttttttgagacagagtctcgctctgttgcctaggctggagtacaatggagtcctctcagctcactgcaaactccgcctcctggattcaagtgattttcctgcctcagcctccagagcagttgagattacaggcacccaccaccatgcccagctaatttttgtattttagtagagacaggttttcaccatgttggtcaggctggtctcgaactcctgacctcaggtgatccaccagcctaggcctcccaaagtgccaggattacagtcgtgggccaccgtgcctggcctgaatgatacgtacttaacttatgaatgttaggtttgaatgttatgtcaagttcttacaagtaatgaggacacaatctggataaaaggaaaatggccccaccttcttaatacttcttggtttgctcagaaccagctctcagaatcctgtaccaatataaacccagtgcaattccagtcccatccaactggatgggactttaaagctcaagccctctcatctaaaccaggctcctatccccctataacagccctgcaaatgactaccgagcccaggctactaaatgcttagtcaacactgtgtccaagatgttaacaaggttaaaatcaggacccacacagcagcacctgtccctaggcactctgaattgtctatggtgtggacattcgggaatgtttccctttttttttgcccagatgcccaggcacccggacatcaatgcagccaacagcagagcagtgacacagttgtggccacaacagtctcttcttgctaccagcctcctctaaacctcttctctagttaggcctgcctctcttcatgtggataaatcatgatagcaacatccaagtacttttgtgaagttccagcgctggatgaagtgacgtgccacatcacgagccgccttcccgtggactgcagaggcaatgtcatgccagggcatccggggcgtggagtacctgtcaatgaaatctgcccgggtgcaccaggcaaggatcagtcattaacttcagtgttggggcaaagtctctctgactccaactatgaaactaaaaggaaacgtgggttagtgcccactaggtatatatttcttggcttgcatagaacaacatttttataatcaagggaaacagatttcacattcagggacatagtctcccaggcacttccccacatatgtttccgtttcacttaggattagataatcactagacatggcaagatgtgagttggtacaaattatctaaggctgtgtatttgatattatattttttattttttatcctgttgaaacaatggcaggcaatgccatctctatctcctcttaaacatataaacccagtgataacctgaaaatatgccattctaacgctggaaatgcaggaaataagcagaatagaagatgatcaaagggagcctaccatttcctgaaaaattactgattattgcccccaaaatatgcctataaaaatctggatttttcagacagttcagctctatttcatgttcttttcttattataactgaaaaaaaagtccttaagcacatgctaatgactaaatctagtctccaaagttttaaaaaattttcaaaaatcaacggaagcaaaacaaaaggcatttagatcatgcacatgtatacttgctgagatgttcaaaggtaaaagacaaaatataaccagcaccccaccattatgatactcaccagcaaaaggtttatcaagttgaacccagtctttgaagacgaaattgcagtagtcctttccatgccagaatctggtttccccatgcagctctcccacacctgtctgtaaactacggatggacccggtatctgtgaatgcagcaagaccccctcagagactgtggttcaggtgagtcccagaaagggaggctcaactctcatttattaaacacctaaaagcttcttaatttcttaagacacaactagggtggcatctgtccattctattacaggctgtgggctaacaaggttttacagtccttacaagtttacttttagtgggcagttagggctacaacaagattcatcattaaacaatgaaatttgaccttctcaggcagttgagtaacttatttccaccacctaccagatcactggaagaactatcacagaattaactgtgaataaagaactcacaaggtggcactatgagagcagtaaagctggtggggggctttcaggggcagagtgggaagggcggggaggggagaggtggagaaacctgagacgcaggggcaataaagacaccatgccacttctttttcctcaaccaacatggtgcacacctgatgcataattcttttgcattaaagcaagaacctcaaatttacagatagcccatgttccagccctggaattaattagctaagtgacactgagcttcagttttttagatcataaatccattatgcgtaaaatgaagaatttggcctagataacagctaaaatctgttgcgctttaacatttatatacttcaaatcatagatggcatttataaaaaatatggtaacaacagatgaaagcttatgatataggtgcaaaagcagcaatctactatagcatttcacaaataactgtgccgagaccattgacttacggctaaatacaaagacaatgaagtaaaaagatgcagaattacaaatcacaaacgcagcacttggcacaaaagaggcatttaacaaatagacactgaatgcaaaaatatgtgttgaatgaataaatggtactgcttgcagtagccagtgagaggactacactggtcctgccaccaacacactgtcccagaactgtctttgtaaaatgcactctttgcttaaaaccctggaaggttcacatactgcctataggaagctcaagtcctaagggcttagtgtgcatagaagactcttcccaaactggtgccaatctatctttctagtccttgtttttccccacccaaccccaggccccatgcaaatcacgtgtttcactgtattataacaggtgtggactgccatgtctccatgcagttggcacattattacttctacctgaaatgctcctttctccctcttggcctgatatcctaatcatccttcaagagccacattagctatcacctgccatctccccataaggaagaggcagtcactagcactgctgtcatcccactaacaactgccccaacacctctgactctgtgacgcaattgtatcaggatgctcccctgcccgcatcaatgcctcaccagtctataaactctttgggagtgggaaccaaatcttctcactgccagtagctccaagcacccaggcaatcaataaatatttgcagaacaaatgtttttatgtaatcaccacacacaatgctaatattctatctcaaactgaatcattaacctttcaaaggctattaaagttttctacagaagaaaaatgatttaaaatgccatagattagcaaaatgaaatcatgttaaaaatagacttctattgacttctcccagtgatttattttcctgctttatgagactgaaaggccaaagtacgggtaggtctgtttgctcatctataggctctttattgtttacatagcactttgttaaaagaagaaaagagggtgagaaaagaaacaaaagggatgaaaaatgagataaacaatatttcaaatttcaaatataaaatacacatatacaatttgctttcatcaactgcaaaactctaagctaaggctttacataaacacatatacactcatttaaaaattatctttcacctaacaaccagttatgataaggaaaataaaggaaattcttagtctcaggaaattatcttggtactaattgaattcaacctgctcataattcaaatttgtttttgtttttagccatggcctaaaaactattccacataaattagggttcctcctcagtacaaatgaactattaaggcaatagagccaaatactagttcctgtgaaaacagtagctcagaattacatgagtgtggtcgagaggacttatggcatcaacaatgctgatccaagggggtctcgttaggctgctatctggctcccaaatgatttcataattgcacctgccttgtcttttggcacagatttgtcaggccaattttctgcatcctcctctgtcagtggctcagattctggctactaaagtttatgagaagggggacttcttgttccttgcctggtgtcctctggtcgtgccacatcctcctccttctattctcatctctcggcttccaggtctccatttttctaccatttctccagcctatccttgttcttctttcctagctcctcctcactaacaaggtttccccctttctcctgtctttttgttttctttttcttcctcttttttttttttttttttttttttttgagactggagtgcagtggcacgatctcggctcactgcaacctctgcctcccagggccaagtgttcaagcaattctcctgcctcagcctcccgagtagctgggattacaggcgcacaccaccatgccctgctaatttttgtatttgatagtagagacagggtttcaccatgttggccaggctcatctcgaactcctgacctcgtgatctgcctgcctcggcctcccaaagtgctgggattacaggcgtgagccaccacacccggcctctcctgtctttttctatacaatttctaaaatgtgcacctgcaaggatggcttctgttttggactccaaatctaaggtcacttccagtgcctcacttgacattgtttacctagttccctccagaactttaaaattatgtctaacactaaaatcatcatcattccataaaatcaagtctttccttgagatttctgctgtctgtgtgtagtaactcaagctcaaacctcggaatcacctttggctcctttattcttcgctgacttctccacccacctccccacggcttcccagatcatgatgaaaatctgctgattctgcttttggaaaaagtttctcccatttacttcgttcttgaactcactgacacaaccttgtcagactccctgtgtctctactataaacgctataaagcctcacccttaattgctccctgcccctagggattttccaacatttaatggaagaggtgcaatgtctcagtctgattttcaaagtcctccgtaaactgctacagatatatcccaccagctcaatctgcacaaatcagcccttaaccacaattccaaaactccaaaagttctaacaattcaaatgttttttcatagctgattttcacagctcatttcataactcacaggtcagcaaaatctgacctgaactgacaagaggttatttattatctttattgatcccacttggtgttgcacaaacataaatggtttgcctacattccaggtatttcctggatcctgctgggagtgtaatatagtagagggtataggtattgtattacctttctaaaatccagaactttctgatttctgaaatctgattccaaggattttgtatgagagattatagacctatatgtatttaccacattctacactcagtctgagatgccgaaataaatacttttgcatttcctatatctgggtcttaagatgtagtatctacctaaaatgcctgtttttctacctttttagtctctacctaccgaatttctacatatgttcaaggccagttccaatacaggcactgaacaagttatattttaaaaaatattttggttttcaaaattttttggaatttagaatcgtggttaagggtttgtagacctgtatttcgtctgtggatcaatgatgactcttgcagtaggagtatcttccctcaatgaattactaaaatattaggtttgtaaaatatttaaaactcatgctcacctattagataacaagctatttaacagcactagatgaatcttacacatcctatccattgcattcctaagaacagtttagaaacagcttaatattatcccttgtgacgagacattcaaatttgaaaagcctgtctcaactaaattgcaaaaataatttttccctcacttacctatttaatattgcttaaaaggaaaagatcagcacatagttgctgaatagcattaggagaaacacttaatgtagatgacaggttgatgggtgcagcaaaccactgtggcacttgtatacctatgtaacaaacctgcatgttctgcacgtgtatcccagaacttaaagtataatacagaaagaaaaagaaagaaagaaagaaagaaagaaagaaagaaagaaagaaagaaagaaagaaagaaaaagaaagaaagaaagaaagaaagggaataaaattcaacactttaaaaatagtatcaagcaaaattctccctcttagaacataattctgaatgaaaaaaaatcttgaaaatgactgagtgattttgaaaaacatatatttcagatatgattcctaaccacgtttttagtgcagtttttctatataaaaacccatagtgatgttcactccacactgatttctgtatgacaccaggaggtttaattcaacaaggagcccaattcaacatggtcatatgcggtcaagtgaaattgatattgcagagaggctaactctctttgcattctcaggaaaaggaagtcattaactcaagttcatattcagttttaaatttctaacgaagagtcactccatgcttaatttgggtttcaagttttataaggcaacctgagtttttaaggtattacatgatttaaatctagagccttgctctttaaacttccttcatttttttagtagaacttttcttttttgaaaacaagttcagaaggaactccaataattaaaacagatacaagtgggattgttctggttgaagaggtaccaatagctgtgggagggtcctggggttcacctacttcaatgttctcctcaaagccttttaaaaactccaggatccaaggaatcgactttggaaagcactgctctagaaggaccccatgatcctttggcttttctttttaggtaaactgttttcattttaaaaaattaaatttgtatttatatttgactataaaagtaaaatgaaaacagtaccaacaatgtgggaaaaaaataaatcacctcacgctccatcttcctaacaaagatagcatcattgaatgtcctttgtcagctgccttcacgaacatattttgatacagtggcaattgtcctcaaattttccttgctcttcccatagccacctcatttcagttcatggaaattccatctttccagtggggccaaagatttggagtcctctccatctctcacatcttgtatctagttcatcggcaaatgctgtcagctcgaccctcaaaatatattcacaacctgcagagtcaccatttgccaccctggtctgctctgaagaatgatccttggaaaatgtaagtcagccctcgcctacccttcgctcaagaccatccgatgacttcctatctcactcagggtcaaaatcttacagtggtctgcaagacctcacataacccaccccagcccacctctctgattttgttcttatcatcctctcctagcccacttcactacagccgtattcctggaacacacccaacccctctacctcatggcctttcatacttgctattccttctgtcggaaacaccctctctcagtttcttatcctcattcttctctttctttcgatgtcagctgaaaactaacctcatgagagatgtattctccgatgagcctttacaaaatagtaactcttctcctatgctcttcctcccggatcatgctcaactattctccgtgataattatcaccacctgaaatgtgtttgactctctatttgtatacacagttcccatccttaccctccaactagttaattgcacttcatctgttttattcaccacatctctagcacccagaatagtgattggcatataacagaaactcaataaacacttatttaattaaataaataaatcttctatgtttatttttgtatccccaactacagttgtaatcattgcccaattccataaaagagatgaaccatttgttaccattcattatgttcttcaccatttccctactctttgacgtttaggttgttctctctctctatctctctctctgtctctcaacaatgctacactagacatatattcagtttatcagtgaggggttgtaaacagatgtcaagggtacttttcatcagcaacaccatacacatgtatgatcagtgtctcagatcaccactgtggatatcacctctgtcaacctggggtaggcgtgagttacttactggactcagcacctcactcacatcttttccacttgctgtcaatcctattgccagcaacactatcagtcataattcagatccataatcttcatgggttggcaacctcctttcctccacttcatttttaacttcagtaataaagcagcaaagttacacattgaaacgataaggcactacctggagctgtttccaaccctttacctctaatatcggccactgcatgcactcttgacctggcttcctagatttcccagaggcctcctacttcccaggactttgaagctttgtcatgcacaggaattactgggagttgtccctgaatccacacatacacccagtactaggtgtatgctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaagctgggacaacagatgcatgccaccacactcagctaatttttgtagagagggggtttcactgcgttgccgaagatggtcttgaattcctgggctcaagcaatcctcctgcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagcttgtccaacccacagcctgtgggccacatgcggcccgggatggctttgaatgtggcccaacacgaattcacaaactttcttaaacattgtaatttttttttgcaactttttttagctcatcagctatcattagtgttagtatattttatgtgtggcccaagacaattcttcttccaatgtggtccacggaagccaaaagattggacacccctgccctagatgaaagaatgctgggaatcattactcaaagtctagcataatttttcaggttcattagcacctgcaagccacaggtgactcacattcaggcatgtgagctagactgtaactctcatctgctaaacaggacatgagagccctggccttaggttctagccaaaaaagcataacatagtaatctttatttctgctaaatcacaggtcttaattatgggcactgggaggatgataaattggaactccattgggcaggtcatgtatcatctctaaccctgagtttcttcatctgtaaaaaggagatgacaatatcactaccaagcactgcaactactcagggcagtgatggatagagtctgtgcaaaataaatgttagcttatgatcttactagtgtcatttattatgatgattacttatccccatatctgaccagcggccaaatccttctttattcccaccacaagttaaacttattagtcattcattaattcctcgagtatctggagtatcttcttaccaaaggctatcagattgtaatttctgaaaattcacacagcatgacacatccacccaaaggccttcaagatttttaactggccaggagcggtggctcacacctgtaatcccagcactttcggaggccaaggcagacggatcacttgaggtcaggggttcaacacaagcctggccaacatggcaaaaccccatttctactaaaagtacaaaaattagccaggcacggtcatgcacgcctataatcccagctactcaggaggctgagctgaggcaggagaatcgctaaaacctgggaggcggagggtgcagtgagccaagacggccctactgcactgcagcctgggtgacagagcaagactctatctcaaaaaaaaaaaaaaaaaaagatttttaaccaaataaaattccagctcccaaatgtgaatgtcatatatcttcttagtcttatatcaaaaactgcattttagctaaataatgcattttacacaatttgaaagcagttggtgctttcccattccagcacctttgctcaactcacctccctcacttgcaatgacttcctatcacctaccccaattaaattacttccaggcctaacccaaatgtcccctcctcaaaaagtctttctgcatcatcagagaggaattcctccctccttccatagaacttccatgacactattgaattgcatgtgccatgcattttctcttattaggtctgttttgtctttgctgctataagttcttagggagtagggatcttggatactacagaatgctttgcacagagcaggctctcaataatatacgtagcataaaaattgcaaacagaaagccaatctggaaacacattcactatgcccatgcagcagacaacacaaccaaagctcaagcctaagggagttctgccacttcacaaattacttaccagcatgaggtctagtgagtccttgctcagactcactggacgggtgaaagagtttgaagtggggttttaaaccatggattaaattgtgatgacttctatagtgattaaaataacctagagaaattaagaatttttttacaaaaaaatacaaatatcaaattttctaaactggaaagcaaagctgatcatttttaaaaccaggcagggctataacatcagtcttaagattctgtgcaacagaaaattgtagggctttaagatggatttcaaaggaatagtaaatttacaagatgtagaaagtctgatgtttgacgaaataagcttgatatatttctggataggaagataaatgtaatttcttctaagaaaagtttataaagtacatctaatacctttttcttttatggcttggcatattttagaaaccctttgtcattctgctaccattagaagtggtaatcgtggtcgttatgacttttgtgtggataaaacaataaatctgttctaaaatgaggcaaacaaagccaccaaatggcatgaggttgaatagaatgatatagcgacctctcaacattgctcattctactccattacagaaagacagattttaaaaacaggtatgtagtgtctggctatggaagaacagtgggtagttaagataaattctagtcaaggccatgacttactggaggtgctgtcaatgctgctgatgctatctgcgtcgtgcaggtggtgcctgtggagctgcttgtagagactaaatttggagaactttcttggctttcctattcctttcagttttgaatccacatcatcaatactcttctggatgggtaggttttgaacaggctcatttttatctttgagtcttaaggattccatagactccattgcggcaggctgagaaaaatttttttttaaaaaaagacactgcataagacatgctgcagtgtggttctttaattcaagtagagctgaagtataaagtttacaaatgatggaggttctataacagacatgcaataatgtctgaggtcagccacagggtagtggtggattcttgtgaactgtttaaaaactaccaaaggaatatgaggagttctgctatggtcttttttcagtaggccaaattcttgaaatttcactccaattaaacttttaatctcaaatacaattacatgggttacattcagtgttgagctcctgaacttgttcctctaataaacattaagtaagcaaggcttcctctgtcaatcattttccctgttccttatgcactaaattgctatttttgcataagttttgcactattttccagcagtaaataagatgaagcccatcaaattttttaataagtgtattcatattctggcagccatttagttgaaatagcaagcagattgatatacactttttttaataagtgtattcatattctggcagccatttagttgaaatagcaagcagattgatatacacatacagatattttggcagctctatttaaaaggcactttgggaagttattcacttctggctcaaattccctctaaatgaccccagactgacctatcctgtttttgtatatctttaagtaggaactttccaaaaactgtggcagatacttaaggctttttactacctaaatctcaattgccacatatttttgtttatgaatcttatttctgaataaaaaataaatcttaattaaaatggaaaacaaagctgaatatgggacagccaaaattccactgaatctgttttcttttcttacaagagaagaacagactcagcaatgctaagttacagctagctaggtggggaagctggtgtttgaaaccaggtctgtctcatgattgacttaaaatgttcttttcccctccaaggagacaccatctcttattcaatgaatcaatcagtcatgctactaatacaaacttatacaaattatgttcgtgttatacatttccataaaggttaaatatacttactgggagggaacccagagacggtcctgaagtgacccgcttcacactgcccacgtctgtgagtctgtgctcattgtcgtcccaccttccataggccaggtcaatccctcccacaaaggccaccgattggtcaatgatgacaagcttctcatggtgagcccacaaatagacggtggatgacacatgatccgggtgtctcatcaccttgagagggaataatccccactgataatatgcttttgaaatgtccttcctgtcataatgaaataggtctgtgttctccctgaaaagcattttctataattcaaataccaaactgtacaacgtatacaccaaagaaaataattttattctcagcatttagcaaaaagaaaaagaaaaaaaaaagactcctatttactcttcaagctcccacgcccatatactatattttggggcagccgccatttagcttgaggtctggcaatacattagaaaacagtcagctcaatttgaaagctggttcccttccccctgtaaggattatgttaaatctggtactaaaaaaaaagctaaaaatatttaactactatttatctctggaaaaatgtgtaatgaattatattgatattttatcagtcattgaattgaaatattaagcatatgaatataggcatatagatattttggcagctctttatttaaaaggtaccttgagaagttagtaacctcttgctttcaaaattatcccagtctgacctatcttattttcatttacctttaggtaaaaagattacaaaagctttggcaactactttcctcttttccttccttccctccttccttccttccttccttcctttctttctttctcagagactcactctcactgaggctggagtgtagacacgtgatcatagctcactgcagccttgaattcctgagctcaaacgatccttctgcctcagcctcctgagtagctgggactataggcgtgtaccaccatgcctggctaatctttttgttttttgtagatatgggtgtcttgctatgttgctaatgctggttttgaactcctggcttccagccaccctcccacttcagcttcccaaagcgctgggactacatgcatgagccaccatacctggccttactgttttcttaataacacattttttaaaaattgtagtaaagtaagcataacataaaatttaccatcttaaccatttttaagtgtacaattcagtggtatcagggtaatgagttagagagtcttctcttctcctcaatttttgaaaaagattgagaaagattggtggtaattcctcattaaatgtttggtagaattcaccaggtccctggcttttcatctgggggagatttttaattactgatcaatctccttaccagttaaaggtctatttaggttttctatttcttcatgatttagtcttggtagttttcttatttctaggaacttgtacatttcctctaggttatcgaattgcttacagtaatatcttagaatcatttttatttctgtagaattggtagtaatgtctctactttcatttctgattttagtaacttgagtctttttttttcttagcccaccaagctaaaggtttgttgattttatcttttcaaaaaaccaacttggtttcattgattttctgtattatttttctatcctctggttttatttcccactgctccaatctttatttccttccttctggtagttttaggttgagtttgttcttctttttctagttcctcaaactgtaaagttaggttgttattttgagatctttcttcttcttgcaagtatagctgtaaatttccccctttgcactgctttctctgtgtcccataattttggtatgttgtttcattttcatttgtctctaagtattttctctttcccttgtgaatttttgttttatcattgcttgtttaacagtgtgttatttaatttccacaaatttgtgaactttctagttgtccttctgttattaatttctaacattatcttgtggtcagacagatgtttgtatatctaccttttaaaatctattaggacttacttagcagcctaacagatggtcctggaaaatgccccaagtgcacttgagaagaatgtgtatcctgctgttgttgggtagaatgttctgtatgcccattggatccagttggtttactgtacgttcaagtcctctgttttcttacttatcttctgtctggttgctctaaccattactgagagtgagatgttgaagtctccaactattatcatagactgtctttttctcctttcaatcatatatttcgattatctgttattaggtacataaatatgtataatttttatatcttgctgtattgaaccttttattaatatataatgtccttctttgtctcttgtaagcatgttttgatttaaagtctattttgtctgatactagtttagccactcttgctcttttttggttactatttgtgtgaaataccctttccatcctttcattttcaacctatttgtgtctttgcagctagagtgagtctcttgtagataccatatagttggatcatggtttcttaaaatccagtctaccaatctctgttttttgattagaggggtcaatacatttacatttaaagtaattatttgtaagatacttctgtaattttgctactattttctactacatgtcttatagcttttttgtctctcatttcctgcattactgtcttgttttgtttggttgattttttgtagtgacatgtttaaattcctttctcatttctttttgttaaatagctatatatttgattgctattttctttgcagttaaatgtaacatcttaaagttgtaacattctaatttgtatttataccagtttaacttcagtaacatacaaatctctgctcctttaacagctcttccctcacagttgttggtgttgcaaaattacatctttagtgggtacttgatagaaatttggtgaatgaataaataatatatataaattacgcaacctaataaatcattctttgggagaaaacactttcattttttctaaccaagtgaaacatacaattgttacatattttaagcctgctggaggtttgttaattcattatgtcttgatgtacctcaatgactgggttatatttattgataggttttagatattggcaaaatatcaaagaactttttcaaattgcttttcatgtttatttactttattagtattttatactaggtgccattgattttttaaggcattttaaatcctagaggagatctctttgctgctatcagtgatcaggggatgtcacagggagatcacatctaagaggttccaggataatgagaagtgtgagaacttgatagagctcgtgaatatcaaaacaactgcaggaaacatgttcttgtctaaactctcactttcaattatcagagtcagagaagcagaaatgtgagatctgcttacccccatcaatgtagggaagataagaaagtacagtattttgctttatttctgaggacacaatgctatttgatcaaatatacatttgggcattctatagattattactgcccagaacaaaacatacctgaaaaaatcctatagaataataaagaaacattggttatcaagatgaacctgaatacctttatgttgggatgtagacgcatcaaagtcctcttggtgtattcactattgatgccaagagcgagttccacctctttgtagagcattatgaagatcctcactccttgttgctgtcacaggagaaaaccgatggaggaatgagtatctctggagggaagttacaattcattttctttttcctttgcactgtactttctttcttttttttttcagagtctcactctgtcacccagcctggagtgcagtggcgcaatctcggctcactgcaacctccacctctcgggttcaagcaattctcatgcctcagcctcctgagtagctgggattacagtcgcatgccaccacgcccagttaatttttgtatttctagtagagacaggatttcgccatgttggccaggctggtctcaaattcctgacctcaagtgatccacccgcctcagccgctcaaagtgctgggattacaggcatgagccactgcacctggcctgcactgtactttctaacttcttttataaacaagtaagataaaattttaatgaaaaaggcaatacaaggaagtgacacataagtgcgtatattgagacacaaatattaaaaataaaaatctatctcccttccattcttacaactggtcatatcaagaaagaatcaataactgattaaagatccaaaacattgaaaactttagtataaaatggacacccaaattcaattgattcatccttccttagaccttggatctaaaagaaaatagacaaggtcaccgtggcctatttaatcgagtcaaattaaatcaaaagtgccttgtagatgctaacatgctatacaaataatacaattatttaacaatattaataatcaaaaagacaatgtccaatccttttgtagttcatgagcatgatgattgtgtgttcacacacaagcgtgagatgtgccacactcgaaccttcttacgacgtctgcacattacccatctcatctgaaaaaaagatttaaacaaaaaccaaaagaccaggtccaatagctaatagtatagaaaaacactggtattttccattctagttctggttggtgacaggctttcaggctaggctaaactgccccttactggaatgctcctctccttctgcttgcccactcatggatccccctccaatgtatagttcagaatgtattacctccaggaaactgtggcttattcacccccaccttgtggattgctttttttactttttaggcttgaatcctccttatttttgtatagtttgcaccattttaatttgcattgtttgcacccagcagctctgaaagcattctgaaacattttgcatatatactggattatgtatctaaatgacacctggcatttaatatcgtagagattaaaggtaaaaattttccataatactttctagaatattacagatgcaggtgtatttaataaaccataataaaaaataattttgttacagtttatattaagattccatggtgattagtcattgtttataagggaaatttgaataaaaatctttaagatatcttactgggttgaacacacctactttacaagaactaaaactttttgtaatgctatacgatctaacataacataggagttaatgtttttagattctagatcacatcacaagatacaaaatcttagagcaaaccaaacacataaacatttctgtaatattgttctgccaatactaaaaagcacgttttggaccctaaattccttataataacacaacacttcaaaatactaacactctatttttcatggtgttagtaatatcttaaaggtgtatgtatttctggaggtgcacactagatttacattctggtgtgcattaacaagatttgagtactaggagaagactcattcttgctctaaaaaaagcaggatcaagaagaatatatatgtcatactatttctctggttaacagctggcttttagtacttgctaattatttattataattatgcaagtactattacaatcaagaatataaatacatatttcagtaaagaagtaaaagcataggcagaaagtgaacagattaattttaatggtctggccagagagtgctctgtaattaaccactgatgaagggctctaaaggaaaattacaatattattttatttttctcctctactgttcagttctatttttggtatttgaatattttagaattcagcactgaataatggttacaaaaaaaaaaaagcctttcactaaaagatataatacaaagggtaaaacccaaaatttcaacctaaatagtagaacattacacctgacattcttcatcatgacccatttattttaagcagatgaaattctgcttcttaggcttaagacattattactcatgaagagtagtagttgcaaattaggaacttggcctgaatcctacagttttctactcacctgcataactaatggatttttgaaataatagagatattaacactaatggaatacattactactctccatttattaatacctgacatttcttctatactgtcttttctcattgaaataattctaaaggaaatagggtagagactttgtctttttagcttaaagacaaatgaccaatgaggaagcaattaaagatagaaagttcatttgtatgtggtttataattatttacctacacctatagccacaataaacagttaattagtgacaagattcctgtgataataaagcaatgcattcttcttcttttggtcaaggtattgactattataaactctagccataaagggcaaaggcgaatgaatcattccttggggatgaaggcattttccaggttgttatagtgtaggcttatacaaaatgtgggaaatatttctgcaaaatgaaagccaaaggaaaaaaaaacctgatgatgttaattctgcaatttaaaaaatacactttcaaaacatcccatgctttagtgcctagtgcctttaaatacccttggggaaattactttttgcttaaagaaagggacggaaattattaataggagaagtagaaaaacagatggcctggagttgcctatgcaatgcagtgtttcttatctctggtgaactcagctgacccaaagtttccatagaataaatttcataaaacatgacttttaaaagatgaaagttctgtcctcttttctaattagttttttgtcaagtagagcagacataacactataaacagtagaaatctttaggagctttagatattcaaactacatgggaagacaatgaaaagaaaatttttatagtggaaatcagtgactttgtttcttagccaacttttcctccgattgctcaagggagcatagtgaaaatattttctaaatgcagccaagtttgtccactgcctgaagacagtttagcccaccccacccccccaacccaggatgctcactaatgtttttgtcacttgccaaggacttccccaatacaatatattaagaaaatgtaaagatgtaaagtaaaggatataaagaaatcacttcctcaccgtttaaaagcaggcagcattgggatataagagcacaaaagctcatgtgcctttttttaaaatccaattttgtttgaagcacatttttgaagctgaagataccttccctgcaagccactgttgcccaccactttgataagactcatttgattttctgtgtagagatgtgattattcctgtcatttctcagttctggacaactttcccttttattggtcactgactgcaactctacattgtgccttgtgatccaggacagaaaatcaacctgaagacaaattctcccattagtctaagtttcataggaaatatcacaagcttctaaggttgagatacacaaaattgcgtgtggggatttggctgccataagtatgatgcagcttatctcacctcttagcatagcaagtgcagaactgtggaaagccctgagatgctgatttctttgagttgtgaacagtctgcctctgaagattggcttttattattttaaatgatggcattgcagatcagaaggccaaagaaataggagaagttcaacttggttattaatcagatacataaaatattctattttttcttaagaaacagccatcataagagatgtttgccatacgttggctataaggcagagacagttcctaaattcctctcagaatatctgcacaatcagatagaagaaaataaaacattcattttaataaaccttgtggacctctgggacctgttaatgcaaaaaacaaatattatgtttcaacctcatactttgcaaagctagtgtgtggctttcagaaactaaattatttatgtgaagccatatttatgtgcatataaaatgtcaatttggagtgatccgagtgttaaaaaatttatgaacaaagtaataatatggtggaatgagattaaggaagagcaactccgctaaatgtaccaccaagaaatcaatctttaattgtattactatttctttaggaaattttaaatatcgctacccacagtttaaaaattaccagctccaagaagtggatgaaatggaaatgaagcactgttatcaggcaataacgtttatttggccatggtgttcacgagggacctcgccagggttcaagggccaaaaaagtaaagagaagtcacactagacacagaaaaggtaaccagacaggtatgccaagggcagtaaacaagcgcatgccagcaaacaagaggtggaagccaggcctgcaggatcttcctcctgagccctaccgaggcatttactagctttctcaagttaacttagatgtcttgtagacactgtatcttcaagtgatctaaactttagctttctgaatcagctcttcccagtttcttccactatcagagtcaccttccggacacctttttttttttttttttttttttttgaaacagagtcttgctctgttgcccaggctggagtgcagtggcacaatctcgactcactgcaagctccgcctcccgggttcacgccattctcctgcctcagcctcccgggtagctgggactataggcgcccgccaccatgcccggctaattgttttgtatttttagtagagacggggtccgacacattattttgatcagaccacccctgcttccccacaccgccctgccccgcacagtactgccccactgtctcccataaagtcaaaccactagcttggctcacaaagcctctgcatcccagctgcaactagcagttccagcttaatcccccatccggctatgctaacactcagatgtgatgaaccaccctaccgtgcctgacaaagtctttggcactgctgtttacatctactacacctagaaagttcttctttcccttttaaaaatgtttgtccatcctaaatgccccacatccttcatgttgtgtggagctccccaactggaccttttccattgggaaagcccaatgctttccctcttgccattaaatcggggcattgtttctgcatgcaactgacacttctgcagattttataagctccttcaacttaagaatcatggcttttatttatgtacatcctcatatgattagccaaatgccctgcacatagaaaacattcaataaatacatattgattgaaacctaaaacagtgaggtgctgattaaatattataagcaaaaatttactagtattagtacagattgctacgcaaggctggaaaaatgtactaaaatagaatcttgagggaaaatggaaaagatgccatttcattgagagaaacatagagaaagttactgcccattcaataggtagaaagtagtctggtaaggctaggactgagcccaagacatgagtccctcagcaagttcgccactggcaaggttcaaatctgattcatggtggcattcttagtgattaccgtagaagctggctcataggagacagtaaccgtatgatgaattatttaataaatatgtgaataatgttttcagaatcaaaatgtccaattctgtaactggaattctattgatgaaacaaactagactatccatcaaaatgatgttgtttggcagaatgtgtttcaaataaatattatcaatttcttttgctttcaatattagcagtgaggtctgactatatttgtggatatccccagaaatactcaagtaaatgcatggggaaaagatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatacaaaaatacaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagggcctattacattaaaaaaatcactagaaatatgaatgcagtcattagtgagcctaggctgcttcagttatttactttttatacctaaaaagcacacattcaatgttcacccagaatgtacagggtcaactccacaggaaacagtttcacatttttaccaggaactttaccaaaaccagagaaaaaacaccaccaactgtgactattcctccccctttaatattattctacaccacattagccccatctagctgaaaccattctccagatgagttttccttttgcttaaatgacaaaataatgaatacaattaaatgctatgctccatttcatcatttattattcaatgatgaaattttattataatttttttgcctataaaattagctgcccataactgattcaaaaataagaattagagatgctaacataatccatgctgtgaattagtctaaaatatttatgcactcaaaagcaataggaataaaatagaaccaaatgaactggaaaacattagttatcctactttttgtcaaactctaaagtgaaaagttatacgtgtgaaaggctttgaaaagaaaagcatttcagagacaacagacagttaaaaaattatatcagcattttctgggaaagtacatactgcttttcgtttaagaatgcagtccaacctccaacgatttccctcaaccactgggcgtttcaggaagatttctggactcagcctgaaacaatgaaaccaagattttaagtaactaaaacaaaatataaagttctgattgtgtcataggaagcaaaggcaatttcagcccaattcaaccccattatcatcctccattgtgatgggtaatccaaagctttactatgagtctaggaacaacttcgtatgggaaaaatagcctttagctatacaaaacatcaatcttagttctttctctctctctctctctctcccccctctttaactgtctctcatacccacatgctcacatatgcacacaggtactgttggttgcccacccacagccaatctccaacttcttccctgctctcagagcctctctcccaccacagactgaatattctagatacttgctttcccagactcctgtgcagctagagcacaacgtgacacaatcctgaacaatgagatatatgaggaggtacacaggggcttaatgggaaagtttttcctccctgaaacacacacacaaacacacacacacacacacactctctctctctctctccctctccctctctttcgctctctctccctccctctcttttgctctctctccctctctctcagagaaagccctgcccacacttccagctttgggatggatgttgtatgggagtatgatgcttacaggggtgcagcaatattgaaattctaaggggaagaccataaccccagaatcactaaatcactctgccaacctcaggattgcccaactttagacttaacattaaatgtgaaaaatacatcctcagtgtttaagccctctttagttgaacattctgttaccccaaactaaaagcattctaatagatacacagacacatgacttcctatacaaagaagcagcatctgagggaacctggggctttctggacaggggagaaggaaggtcggctgatatatgaaatttttcctaggctcttctccttcagtaaggcataaggcagctaaggtaagctaagcttcacaaggcagctaagagtacaatagagtcatttttcccctggggctgggttctaaagttagtttctgagttaaacatgtacatgatgtaacttccctgtagttagaaaaaagaagcagtagaaaatactcctttctccactgaactgctagacctgaggcagcagaggtagactatgtcaggatgaaagccttatggaattctgcactggagtattgccctcccaggcagccctctaagcatgtgaaatcaacagtgctttaaggagctaaagagattaaaagaaatcaattttatgctctatttcattcagttaaagaaaataaaaacccagagataaagtttctaaaggaaacgttattgggtaaaataaataaggaaacagacaaatggaagagtttggacagtgtaagtcttgcatatttaattgagagtaggaaacaaactcaaaggtaatctatgtccaaacaagcaaacaaacaaataaagcacagcaattgatcagaaaagatcaaagaagcattaaaaggaaatctgttttaaaatagtaaaatgcattgctgtgcactgctagttcaccaaaagtgagagatagccaacaacatatatacaattgcaattttttgatgtgtacattaaatatgggctcaaagagcttcggtatgggggagacttttaatgtcatactctgcaattaagtatttatcatcatttatttcatttaatccacaaacatgtgtacccttgtatgctaagcattctacaagatactttgaagaatcttaagatagctcttgaggagccctcaattttgaggataatgcataaaaagaaaaaaagattttgttatatcatgctataaaagtataaaccatggctgcatggcaagaagaaagcagctataacttaccaagcattattatgtaagaatctttacttacttgtaaacaaagttattgtttaatattacatttcattggatctaggacaccagtgactgtaggatgcatcgttactgcatgtaccactaagaaagaaaacatcatgacaactataactgtaagagcataagatgcatcctgattgcggagatattaagacgtacctctaagtaagtgtaccacttagaagatttaatgactttaaatgcttacatgagaaagacaaaaaattaaaaattaatgatcagactttcctttcttaaaagatagaaaaagaagacattaaacccaaagtaagaagatgggggaataataaatataagagtagaacttgatgaaatacaaacctgaaaaaatacagagaaaattcaatgaaactagatgttgactctttgaaatatcaataaaatttgtgaacttctagcaaggctaaaaataaatgacaaaaaaatgattgaaaggatgggctcacatgtataaacccagcactttgggaggctaaaatgggaggattgcataagcccaggagtttgagaccagcttgggcaacatagcaagaccctgtctctacgaaaaaatttaaaaaattagccagacatggtggctcatgtctgtagttccagctactcggggggctgaggtaggaggattgcttgaacctagaaggttgaagctgcagtgagccacgatcatgtcagtgcacttcagcctgggcaacaaaggaagaccctgtctcaaaaaaaaaaaaggagtgaaagacaggtaatcactatagggcctagaggcattataattatattaaatgaataataactattaaaaataactgtatgccaatatttgtggtaatttaaataaaataaacatattccttgaataaaatattttcataatgaaaataaaaagaaattgaaactgacttcatagctattgaaaaactgaatttgtaattaaaactttcctacagggaaaactacagactttgccaactttacagaatttattaaacatttacagaatttattaaatatttgaattttatcaaatatttaagaaagaaatgatgctagtactacctaaattctttcagtaaacaaaggaggaacacttactatcttatttaatgaggtcagcattatcctgatactaaaaccaaataaagacaatgcaagaaaactaaagaacatcccttatgatcacagaagtaaaaatatttaccaaaaacacagcaacttagaaaaataatactacatcatgatcaagtgggattatcctaagatataaggttggtttaaaagttggaaatcaatcagtgcaattcaccacagtaacaacaaaaaggagaaaaacgttattattcaacaaatgcagaagaaatgatgaaattcaatatccattaacaataaatactcccaacaaattagaaatagaaaaaaacttccgtagtgtaataaagggtacctataaaaaaatctatctctaacatcacacataacataacaaaactgcatgctttcctcttaagattagaaacaaggcattctcaccactttcattcaacattttactggtgatactagccaatgcaacaaggcaagaaaataaaatataaagcatacagattagaacagaagaagtaaaactgtctttattcgtagatcacataatcatctataggacaaccctaagcaatctacaaaaaagctaccagcactaataaattaatttagcaaggtcacaagctataaggtaaatacacaaaaatcaattgcatttctagttctgtatggaaaatgaattttaaaatataatttacaataatatcaaaaaacataaagtactcagtaaaaaatttaacaaaatatgtaaagacctatacatagaaaaatacaaaatattgctgagaaaaattacataagagctaaataagtggaagcctcaatatagaaaaagaagtaccacctaaccagtggtaagtttaacatttttctccctttgattccttgacttggagggaaaacttggaaacaggcattggcacagagagaacttcaaaaatcctctagttcaggcttggggagaaagcaaaggatctctggtagtgacagggttgcagtggaaagcccaaagttactaaaacctctgaggcaggggaaatctcctctccaatggagatgtaaatacacctggcttggctctggacatgggtgccatcagagaaagcacattgcagagcacagtaaataaaaacccatctttctggctagaagactaaaaagggaagccatgggaaactaaaaattggggagaggagctcagaaaagcagctccataaagttgtttctgatttcctggctcattcccaagctgcctatgcatggatttcatcctaaacatcactccaaagaggctgagaactgaactgaggaatagaccaccaccgaagtcccagaagggccactaggtggcacacatatggggcagatctgaatagcaccacaaaggcattaacaacaaaaccggcattaaaacaacactcataaaaggctggttggaactttaagcctgaactgaaattggtaaattgcctgctaaaacaaaaatactaacattctccacaggattcaaacaagactcaagagtcttataacataataataaaatgttctagaatacattaaaagtacctggcacacaaagaaccaggaaaaaaaaaaaaaaaaaaaccttatcttgtacagaaaagggaatcagcagatgtcaataccaagacgacatggatattgaaattatctacttaaggctatgtcagatattataaaaatgctctaataagggtgaacactcttaaaatgaatgaaaagacaaaaaagtcttatagaaaaagatataaagaagaaccaaataaaaattttcaaagtgaaaaacactattaccaaaaacactagaaaaacaaaagcaaacaataaattccccaaacctcacaggataggctcaataccagaatggagatcatagagcagcagtccccaacctttttggcaccagaaaccggattcatggaagacaattttttccatgggtgggagctgggggtaaggataatttctggatgaaactgttgcacctcagataggccagcaggcaccagttagactctcataaggagcgggcagcctagattcctcacatgcgtagttcacaatagggttcatgttcccacgagaatctaatgccacggctgatctgacaggaggcggagctcaggcagtaatgctcatgctcgctacctcccccgacaagctctggctcacctcctgttgcatggcctggttcctaacaggctggggaccagtttggcttggaggttggggaccctgtcatagcggaaagagtcaatgaatttgaaggcaaataaataagatactatttgtgtcactgaagactcagaaggaggagagaaagaggaaagttcagaaaaaatgtgtaaagaaataatggctaacaatttcttaaatttagcaaaagatataaaactacagattcaggaagctcagagaaccccaaacaggataaacccaaacatcataaccaaactgctgaaaactaaagacagaaggaaaatattgaaaccactcagaggaaaaataacacattacttagaggggaacaatgtcttcaagagatggaaaatttctcaacagaaatcatggaggccagaatgaaatggaacaatcactttaactagaatgtacaaatacctcctacaactaaataagaagactaacacaatctccctctcaaaaaaaagggaaaagatttgaacagttaaaccaatgtccaaatagcacatgaaaatttgctcaacatgaaacgatgttgctgatacaagctaaaatcataataaaacactactgtataccctttgaaataaagactgacaacatcaagtgctagcaattatgtggaagaattgaaactctcatacattgctggtgaaaatgtaaaatggtacaactttggaaaacactacatttagctcttagtattgataaaatgtggtaaattaaatctatcttctaagataggtgtcaacaaactatagctcacaagccaaatgttgcccatagactgttttagtatggcctgtgagctaagaatggtttttatatttttaaagagttgtaaaaaaaatatgcttcagagaccatacatgatttgaaaagcctaaaacaaatttactctcttgctctttaaagaaaaaggttactaaccatttttgaaagtcagtggctttaaaacttttaaacttttggaccataagctgcagaaagaaatacattatacacccaaaccaacaccgggtcagtcagtctatctatctatctatctatctatctatctatctatctatctacaactgatataaaagtttccaaaattagtagcccttattaccacttacattgtaccctttctttcttttcccttccctttcctatcctatgccattctttttttttttaaatgctggtcacaacttaccaaattattttaatacacaattactaaagaggctcaacccatcatttgaaaaacactaacaatattaaaaccaacttaaagaatgttgcatttaaaaccaacttaaatacttttaaaacatgtattcttttacctggaatagtctttgtttgtgagtcagttagtaatgcaatgctgatttattttctttataacctttgtctccggcccaacctttgtctcttctgtttctctaccctttacaaacaccctcttttaaaaatctctgttcattgtttttcttttgtattctcctgttttattaattctatttctgacacatttaacatactgactccatacagagactggtagataaccccactctctcagatctacgcatactagtgtttggttaagtttctgaatgctcctttttgcaatatgcttgtacaacaagaattttctttacttgtttgagggaagttactgtgaaggttttatttctaatgatgtgttgtaataaaatggtatcctagtgcagtcgtgaaaaataagtaaccccgattcattctcttgctgaaagtagagaggaaaacattcagagttccatctctttatatgtttaattgaatcaacctaaatgaccatcaatggtagactggatgaagaaaatgtggtacatatacaccacagaatactatgcagccataaaaaagaatgagatcatgtcctttgcagcaacatggatggagctggaggccattatccttagaaaactaacacaggaacaaaaaaccgaatactacatgttctcacttataagtgggagctaaatgatgagaacacatggacacatacaagggaacaacacacactagggcctttcagaaggtagagggagaggatcaggaaaaataactagtgggtacaagacttaatacctgggtgataaaataatccatacaacaaattcccatgctacaagtttacctatttaacaaacctgcagttgtacccctgaatttaaaagttaaaaaaattttggtgttcagacataaagcatgaaaatctaggctcaatagaaaaattatttttagtctctctcacatcttcaccaaactttcagaaatattttttaaagaatatagtactcactggcacaaatttattatcacaagtgttcataaaatattcaaccaaagaaatagctcctaagcatgaaacattttttcctcctagtaactgactgaaaagacaaaatttggtaacaatagaaagaccagaattaagctcctccacaagcatgagcatgctggccaccacataccctgtctatcccctctagatcagtgattcccagccgacaaggatcttgcatcctctcccaaccccaaccagggaacatctagcaatgtatgaagatattatggtggtcacaactgggaacttactactggtacctagtggatgccgctaaacaccctacaatgcataggacagccccctacaacaaagaattatctagccccaaatgtcaacagggcaaaggttaagaaagcatgccttataattatagattccagacaaccgaagcaaaagatgtgtttgcattcttgaattagatattgatattgcccacaaaacctagaattagaagggaataaattatgatgatatattaacagttcctataaggtaccttttggaagaaaaccggatagagtaaaataaggggtaattcaggcaactactactaagttcctagaaggaaaacacattttagacatttccatatccatcgtagccagtgttggcatgtgtaatgggttttaactttccaggcagatgaatgattggaactgaagtcagactagaatgcctacaccaactacaggagtaaatttcccaagagttaaatgagtttccgatatgaggcttctggtgactttaataagcatagcaactcttatggatatttttttaaggtggtcacaaagttgaaaccggatgtatctctagaacagctgaccaggcctagtcattacagaggatatttttacggtaacaggcaagtggaactatttcaacatcaaaaggacaatttagaagaagtatattcactggccctcatgacagacataccaaaattagaaaaagacatccaaagacaccattacctctataactgtacttgcattacagtataatctttactgacatgaaaacttggaagtctgcttccaaatgcaaatataaaacctaattgttcaaactaagtattttatgaatattgttgaggccaaggtttttgaaaaggcctttcactgaaggcttagtcaactggttgagaccctggccaaaccatccacagatacagctgattttcataatgtgtaattcttgaacagcactataccactgtacatttctaaacatagagacttccagaaaaaaattcccagggacaaatactaaccaccagtctgtgataaaaatctcttcatttgcctcttccattgcatttgccacatcttcaaaatatcctttggcattaacatacctgaaagacaagtttattgttcctttttgttattaaaaaagaaaagaaaagaaacttatcttatggtaaagcaaaacatggaagccactgcctagagtctccacataacacataaccaccattgactttgtggacctggaaaacaaggattgaaaataccaagtttcctctgctgcctaggaagggcagtaagtgtaagcagcctgatttttctctgcttagagaacaacaaatttattgagcctcatcatcataaggagccagattaattttcctatcctgttgaacttacatacagtttttcttacatacagttctgagactgaaaacaaactagcttccaatccacgggtagaaaaacatgctaagcatgactttatttaaaagaaatatctagcaagtaaatgctttttcctaaattaggggtaatgacttaaataaaccttccatttgcatcattaaagaaatgtatgaagttagctttaaaattcaaacttcaaaatctaaagctagctaagctcactgtgaaaaatcttaaaagcaacaattgaaaaactaatctataatcaggtagtcccataattatcacaaaaagagaagcccttgttaagtataatgcataatctttcacagttttgaaaactgattccaggtgaatttaggccagtgtaatattagatgctatgactgccttgacaggcttagagaaataataacttaccatttagctaaagcattctcttggatagcagcatatgacccaaatcgatgatctttgagaaagttggtgccatgtttctggatgaattcttctatagcccctccccaccaccgagcatgtctatagctgttgcattttaaaataagtgtcctttaaagaaaaagccaaatattgaaaagactggtcactctgttctatctcatgctcttttttatttggtaatataccaaacacaaactgaaaatttgaggcaaagaacatcaagaaagcaggcatttaacattttttggtagtatttctaaaaatatattcaatataacaaaaataaatgttcaggttacttattcattcactcatgcaaacatgcataaaggtacttaccatagacctagagctgtgtgctaggccatgaggaggataaagaaagaggggtaaggtgaggttctatttttaagtattagttagagagctgttggctcccgtacagcagcggtccccaacttttcttttttcttttttttgagatggagtctcgctctgtcgcccaggctggagtgcagtggcgcgatctaggctcactgcaagctccacctcccgggttcacgccattctcctgcctcagcctcgagtagctgggactacaggcacccgccaccacgcccggctaatttttttgtatttttagtagagacggggtttcaccgtgttagccaggatggtctcgatctcctgacctcgtgatccgcccgcctcggcctcccaaagttctgggattacaggcgtggtccccaacttttttggtaccagggacaggcttgtggaaggcaatttttccacggatgatggggagtagtttcgagatgaaaccgttccacctcaggccatcaggaagtgatatgattctcgtgaggagcgcgcagccgagatcccgcgcatgtgcaatccacaatagggttcgagcttctgtgagaatctgatgctgtggctgatctgacagaaggcggaactcaggtggtaatgctccctcgcccactgctcacctcctgctgtgcggcccagttccgaacaggacacggactggtaccccgagggggttggcgacccctgctctagagggcacttccccttgtgctccctagtatccattccctcagcttctggaaatatcatcccaattgtgcttcatgacagccatcccttctcttcaacaaagctaagcaaaatggcatattccatctttctggttccagaaggtggttctggcatgactatattgtgagttttctatttcactaatcataggaaaactgttctttttttttttttttttttgagacggagtttcgctctgtcgcccaggctggagtgcaatggcgctatcttggctcactgcaacctccgcctcccgggttcaagtgattctcctgcctcagcctcccaagtagctgggattacaggcctgcacctccacgcccggctaattttgtatttttagtagagacggggtttctccatgttaggctggtctcgaactctcaacctcaggggatcggcctgcctcggcctcccaaagtgctgggattacaggcatgagccactgtgccagccttttttttttttttttttttttgaaatggagtcttgctttgtcaccaggctggagtgcagtggctcaatctcggctcactccaacttccgcctcctgggttcaagcgattctcctgcctcagcctcctaagtagctgggactacaggcgcgcaccatcatgcctggctaatttttgtatttttagtagcgacagggtttcacaatattggccaggctggtctcaaactcctgaccttgtgatccgcccacctcggcctcccaaagtgctgggattataggcgtgagccaccgcacctggccaggaaaactgttcttttgcaataataatcaattaaacatattgataccagaaaaaaaaggatactcatgtacatttgttcatcgattcctattaacaaatggacatgagtatcctttcaggcattcctaagcaaatgtgaggacttacttgctcaggaatgccaggaagggactctcttgcttccacagaatttggtgtgagtgtgggaggtggccatcttgctaccacaagggaatcagtcatgctcaacatggctgattagttctctttggtataagccagtttgctttagatttttctgtcactcataactaaactatcctaaactcttacagagttataaatgctaaaaaaaaaaaaaaaaaaaaaaaaattcagagtggattacagaaagttttttcttaatgccaagtgtcagaattctgcctactactaagagggaaaaataagttatccaaatttgaagtttgaaggaaaacagagtgttggagccagctgtatccctgccatgtaggcagaaatctaccatcataccaatgtaagaagactatgcgtgaggagggaggttgcttttttgaggaaatgcaatgatcctgatgagacgcagggaagggggctgtgttcacagattctaaaagaattatttataaagattagccatgtccaacctgctttcctcaatatgtcagaggtagatgctggcttttgtctgaaagtcatgaagacagggagaggctgctgctgctgggctgtggagacaggggaggagagacgtggtggagctgagaggagtgaagcatccccatcgcgtgtggtggagacacgggtttctagggatggagacgagagggcacaggaggtgcctgggcttgacctatcctgcaagcactactccaattgagctaaaaagcctcggaaaaacagttatgagaagactttacagaagagatgagtaacaagataagacattatcacaggatgtgagtcagtatcaagggggaaaacaagaactattccaaacatggacataagaaaagcaaagggaaagaggcaagaaaaaaatgctgccttcatagaacctgcaaggcgtattagggaggaatttcaaataaaggcaggaaaataaatgcccttcaaaaataagtgggggaatttggccttatttgataaaatcatgggggggatcttacaccaggaaggaaggtaatgaaacctggatgtgaatggcctcatttggcaatgacatacgggtaagtgagggtgggaaatgcagatgaagtggccaataaagtaagggaccagtgagaactgtggccagacttctgtggctcactgtaaaacaggaatgcaggaggaaggtgtaatggcagcaccattatatttccagtcacaatcttaaatgttccattctcatagaatatcatcaggaaggtcagcatctttttatacacacacacacatacacacacaaacatgtaaatcagtaagggaatatgaagctatgttggtaactatgtgcacagggagaaatgcatatatattcatatacatgatggtgaatgaactatacagagacaaatggatatatatgtataaagacacacatacatggtataactacaatcttccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaactttagtcgggggtggtggcaggcgcctgtagtcccagctactcaggaggctgaagtgggagaatcgcttgaacctgaaagatagagtttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaactattgctctaatctatctgtttagtaaactggcaaattgagtagtaatttctgttaacataggcaaacatctacatatgggattgtttattcagactgttgcacacaggatactctttaaaatatatacaaggaaaaaagtggtttcattactattgattgaggatgagctctaaattacaattttctaacactttttaaactccttttttacttaaggttgagaaaaaaatgtttttaaggcatttttgtagaaatcttttttaaatatttgaaatgtgtaccttgaaagattatcaattcggattccatatttcgtttctgtctccttcttccccaccttaattttgaattctttgtctaccagcaggacgaaggcaatggcaccgctgtctggtttcatatacaataaaaaggaatctttcactattaaccatctgtaagaaggtagtaagtatttttaaaagttgcattgagtaaataaaacgagaagaactaatcattatgacaagtcttaagtaatcactctggcagactgtagacataattacattttctacacaggagatttattttttttaatcgctatgaaacaaacaaaaaaaacccaacaaaacctttctattacgtttttctaagaaacagtgtaccaagtaattcacagtaattcattagctctttaaacactaatggcaaaactggaggaatgtccctaatattggcaggtagcactcacaggatgtacgacaggaagggcaagactgaggagatgggatccatttacagtgaatgcaaatggtaacttcatcaggctgcatataacaacatgtattcctatttgcctgcaattgtagagtgatagactgaatcatttgaaaactgagaagtaacaaagtgggcataatagtgcataccagacaaagtaaagcactctaggcacttccacattatggaatagtaaggttggaacatctgaatataaactaagtaatactgtaaatatagcatgggaactcagtatttaaaatatatctataataaatctttactgaaattgggaattgcattatgttttaatggctttataacttggaatttaatgtagacagacctacattgatttccacatagtttcatttcattaatttttttttaatacataagttatctccttcctaataaaagggcatagagtggatttaggataacttatagcaaagaacatatgtggtatggttcagaaaaggaaaaacgtcaaggtcacagaaagtaaatacctaaaatacctaaccacaaaggtaaatataattacagagatgacacactcatgtgggtgtaagcttcctagtttttcttgtcaaatgaataaattaaagaaataagtggatttcctccaaaactaaattccaaacaaagtttctcatttgggacctaacatgatacaactgaacaacataatgaataatattcccaataacaattttcaaagcaaacacagaaattatacattttataagagttcttataacactcctcaatacgaataccaaggctatgatatcaaagggtaaccccgttttcccagcactgtttactgaagagtgtgcactttccccaaagaatgttcttgatgccctcggaaaaatcagtaggctgtagatacatggattaatatctgagttctctattctgttctactggtcatgtgtctgtttttataccaataccatactgttttggttactatagctttgtaatatattttgaagtcaggtagtgtaatgcctctagctttggtttgttttttgtttttgttttttgctcaggattgctttggctgttcagggtcttttgttgttttatgtgaattttaggattgttttttctatttctgtgaaaatgtcattagtattttgatagggttgcactgaatctgtagattgctttggatagtatggtcattttaacagtattaattcttctgatcctcttcagtttttttttcatctgtgtcttgtagttgttctttttactagtcattagatatcaaggtaatttgatgctgggcttttattgaaagctcttctttattatgccattcataaaaactcctctgatttcttccctttttcttttttgtcaatagatatatttttttcttttaacttttactttgggttcagaggtacacatacaggtttgttacatagggaaacttgtgtcacaggggtttggtgtacagattgctttgtcacccaggtactaagcatagtacctgacaggcatttttttctgatcctttccctcctcccaccccccaccctcaagtaggccctagtatctgttgttgccgtctttgtgtccatgagttctcgttatttagctcccagttataagtgagaacaggtggtattgggtttcctgttcctgtgttagtttgctaaggacaatggcctccagctccatccatgttgctgcaaagtacatgatttcatatgctgtggtgtacatgtactatccagtctactacagatgggtatttaggttgattccatgtctttgctattgtaaattgtgctgcagtgaaaatacacatgcactgagtctttacagtagaatggttatagtcctctgggtatatatccaataatggaattgctgggttaaatggtaatactgttcttagttctttggggaatcatcacactgctttccacaatggctgaactaatttacgctccaaccagcagcatataagcatttccttttctctgaaacctcgtcagcatctgtttatttgtttgtttgttttttaatagccattctggctggtgtgagatgatatctcattgtggttttgatttgcatttctctaatgatcagtgatgttaagcattttttcaaatgtttcttggccatatgtatgtcttcttttgaaaagtgtctgttcatgtcctttgcccactttttaatggaattttttgtttttttgcttgtaaatttgtttaaattccttatagatactggctattaggtctttgtcagaagcacagcttgcaaatattttctcccattctgtaggttgtctgtctactctgttgatagtttcttttgctgtgcagaagctctttagtttaattagattccattcgccaatttttgattttgttgcaattacttttggtgtcttcatcattaaatatttgcccgttccaatgtccagaatggtatttcctaggttgtcttccagggtttttatagttttaggttttacatttaagtttctaaggggtccagtttcaatcttctgcacatggctagccagttatcccagcatcatttattaaggaggaagtccttttcccattgcttgtttttgtcagctttgttgaagatcagatggttgtaggtgtgcagtattatttctgggctctataattctgttccattggtctatgtgtctgttttcgtaccagtactgtactgtattggttactgttgccctgtagtgtagtttggagtcacgtaacatgatgtctccagctttgttctttttgcttggcattgccttggctattcaggctctttgttggttccatttgaattttaaaatagttttttctagttttgtgaagaatgttattggtagtttggtgggaatagcattgaatctgtagattgctttaggcagtatggccattttaatgatattgtttcttcctatccatgaacatggaatattttccatttgtttgtgtcacctctcatttctttgagcagtattttgtaattctcattgtagagatctttcacctccctagtcagctgaattcctaggtattttattctttttgtggaaattgtgaatggggttgcctccctgatttgactggaaagcaattccattcacaattggcttgattgttgttggtgtatagaaatgctagtgatttttctacattgattttgtatcctgaaacattgctgaagatgtatatcagctcaaggagtttttgggcaaagactgtggagttttctagatatagaatcatgtcatctgcaaataggaatagtttgacttcctcttttgctatttggatgccttttatttctttctcttgcctcattgctctggccaggacttccaatactatgttgaataggagtggtgagagagggcatccttgtcttgggccagttttcaaggggaatacttccagctcttgtccagtcagtatgatgttggctgtgggtttgtcatagatggctcttattattttggagtatgttccttcaatgtgtagtttattgagggttgttaaaatgaaggatgttgaattctatcaaaagtctttcctgcatctattgagataatcaggtagtttttatctttagttctgtttatgtgatgaatcacatttatcaatttgcatatgttgaaccatatagagaagattcaaaaccaaacagagaagattcaaataaacacaattagaaatgacaaagaggacattaccattgatcccacagaaatacaagtaactgtcagagactactatgaacaactctatgcacataaactagaaaatctacaagaaacagataaattcccagacacatacatccccctcaagactgaaccaggaagagactgaatccttaagtggaccaataatcagctctgaattagaatcagtaataaatagcctaccaaccaaaatacaaaaacaaagacaaaaagcccaggaccaggcggattcacactcaaattctataagacgtacaaagaagagctagtaccgttcctactgaaactactctaaacaattgaggaggaagaactactacccgactcattctatgaggccagcatcatcctaacaccaaaacctggcagagacacaacaaaaagaggagacttcaggccaatatcctttatgaacatagatgcagagcatctcaacaagattttgctttctttctcaggaatatataaatcaagtaaggcatctatcaaccagccttctaggagtcagcaccatctgcacagggatcaagtgcctgccctgaagtcagcctccctgggctccaattccacctgccactcactgcttgtaagaacttcagtaattgagcatgatgtcaaaatctataacatgaggataacataagacatataacatgaggacctaacagcaacatctagttcataagtattcataaagaattaactgagataactcatgcacatgcttagcacagtgcctggccccaatacatgcgaactattataactaatcttgttctaaaccatgtgagattaccgtctgttttaaaaagatacctcctgcctgtgttactacttgccatggcattcaaatgcagataagcccacttgagccagccctccccttctcagcctcatctactattgtctctcacaatgttagtcaatgttggttcttctttagacttgccagtcttcttctttgggctctatcgttgctgttcctctgcgtaaaaactgtttcttctaggcaattccatggatggtctcttcttgtcaatcaaacctctccttaaaaatccctctacaagcaggctactggattcaaaaaaaagctgttctccaccatccctgcctcatcacccccaactctcctccatcatgttgtcttgatttagcttctttgtagcacatctggaagtatttgtcttcttgtttattgtctgtctcctacagtacagcgtaaggtccctgggaacaggaaatgtggctgtcatgtctactactatctgttcaatgcctagaactatcttctagcagcccagagcaagctttcaggcaaggccaccatctcgcctaaataatggctgcatgaatggattccagagagtaaataaaaccatttagacactatcactgtctaaaaattttaattattggcacagctcatagttcactaaagtaaacactaagtaagaaagtgctaaggaattaaaagtaatggcaaaaaccacaattacttttgtaccaccctaataaatgctaaatttatttgttaacgtctatacatctctttttcttaagacattatttgacataagaaacttaacttacgaccaggtgcagagaagtttctcaataaatgtgctgtttaagcagatgttttagattgtaggatctctgtttgtctttttttaaaactcatctctcagataaggtcattatgagacctaactgaaaattcaatttccttgtttgccttactacaatttgtcaacgtagaataaattaacaagtgatcagaatgtatttttatgggtacaaatgaaaaaaagttatgaaggagtgtcatctttaaaagtaagtctcatttagacattaataaaatagtcgtcttggccaggtgctgtgcctcccgcctgtaatcccagcactttggaaggccaaggtgggcagatcacttgagctcaggagttcaagaccagcctgggcaatatggtaaaaccccatctttacaaaaaatacaaaatttatccaggtgcggtggtatgcacctgtatccctgctatctagggggctgaggtgggaggatcgcttgagctcaggaggtcgaggctgcagtgagccgagatcataccactgcactccagccttggtgacaaggtgagaccctgtctcaaaaaaaaaaaaaaaaaaaaggccgggcgcggtggctcacgcttgtaatcccaacactttgggagccgaggcgggcggatcacgaggttaggagattgagaccacagtgaaaccccgtctctactaaaaatacaaaaaattagccgggcgtcatgccgggcgcctgtagtcccagctactcggagagcctgaggcaggagaacggcatgaatctgggaggcggagcttgcagtgagcggagatcaggccgctgcactccagcctaggcgacagagcaagactccgtctcaaaaaaaaaaaaaagtcttccactgtgagaaactttctaaattatatgttatcatctatatatgctttctggtattttaaatcccaaaaatgtgactcaggaaatatttattaatatggaaccagggctttaatcttcacagaatgatttacacaatttacagtgatgacacatttcattccagggaggatcgtatctttttagattgtcccagttgacttatgatttaatccaaagtttaaaaagagggggcatatttattttgtgtaacaaagcctttccctcacctttcctagctgttgcttctcataagggttaaatccaaacgtcagtttttcagggagcctttccttgactcccagagctaaagtcaccctctgcaatccccagatccctcacaaaccatttttcccctttaaagctctcatcgctacctgaatttatacaatttacattaattgtcggcttagtgcctgcatttcccctctaacagaactccatgagggcagagacttcatcttgttcactactgttttcacaggagtatgccaccatctggcatacattaggcactcgaaaaatgactgaataaaccagaccatggcttccattccttgagtagacgccttaggttgggttgtcccagaagtaaactctgagatacggatatacgtgtataaaagagtttaagacagtggcaccaggaagcaccaattagggaaggatagaaagaaagagcaaggaaggaagccacagagagtgtattttcatgctttttattgtgggcagctgtgctgtaagccagctaaggagttctgggagacagtgtagagactgctgcagagtcaccccaactgaggaggatggggctggactccgatcagttcttggctgatggctgctcctgggagctgttgacacttcccagactgctgtgcacacagacaggtgggttctgacagcctacagaatttttggtcaaagaatcacaaatgcttaaggttacagtctgaaaactgtggttggcatgtagcagctgatttgggcaaagttaacgactagggaggagtggtcagaaggaatccccaagtttctaaaagttagagaagtgtatttgaaggcaaatactttttttagtatattatttcccttcttattttagtaaaacttctctcccagcgacagatcaagactccatctcagaaaaaaaaaaagaaaaaaaacttttttcccttacaaaaattttcagttttctttagtttaatcttctgatcttttccttgtaatttcttctgtcccttcaaatcccagaaagtaaaggcccagcttaatggtatttttttgttggtagtatatcttaaatcggtgtgtgtaaaggtggatgccagtattaattttatatattttgaatatacacatagctcaattccacatttaaacataaacacatttatcattttcaatttgggggaaatattatatacagatataaaatatttataattgatttcttcagtgttttaatagtttttcaaaatcccagtacattgttattgcaacagttactgtctattatgtgccaaacttgggggatacagataagaatcagatgagaatattgttcctcaaggagtttttagttggtaagacgtaagatataaaataatgttttctgtctatattacgcttaccatgataaacatttttcagaaatataagtgtaaaattatcatccctgaagtctgcacaattttacttaagtttttgttaaagtgtacagttcagtttgatttttggtatattcacaaagttgtataaccatcaccactatctagttccaaaatatcttcattggcccaaaaataaaccccataccagtatcaaattagtagaaagcaacctccttcccattccctggaaaccctttatctacttccgtctctacagatttgtctattctgaaaatttcttataaataagaatgataaaacatgtgcctttttgtatctggatgttttcatttatcctgttttcaaggttcatccacattgtagcatgtatcagaacttcatatccttttccatttaatttttagatttttattcagatgtaattcacatatcataaaacgtaccttttaaaagttcacaatgcgatggtttttagcatattgacagagttgtgcaaccggcactaccgtcttatttcagaatattttcatcaccccataaagaaactccatgaccatgaatggtcttcatttctctttttttaatgtatttttaatttctgtgggtacatagtaggtttatatatttatggggtatatgagatactttgatacaagcatataatgtgtaataataacatcaggataaatggggtatccatcacctcaagcattatcctttatgttacaaacaactcatactcttttatagttattgtaaaacatacaattaaattagtattgactatagtcacctgttgtgctatcaaatactagatcttaattatcctatttgtttgtatccattaaccatccccactatccccctccacactgcctttcccagcctctgataaaatctccatgagttcagttgttttaatttttagctcctactagtaactgagaacatgtgaagattgtctttctgtgcctggcttatttaactaaacataatgacctctagatccatccatgttgcaatgacgggatctcattcttttctatggctggatagtaccccatcatgtgtatgtacattttctttatccattcatctgttgatgaacacctgggttgcttccaaatcttggctattgtgaatagtgcttcaacacagatggaagtgcagatatatctttgatatactgatttccttcttttgggtatatacctagacgtggaactgctagatcatatggtagctctattttgagttttttgaggaacctccaaactgttctccgtagtcgtcgtactaatttacattcccatcaacagtgtatgagggttcccttttctccacatcctcaccagtatgttattgcctgtctttttgataaaagccattttaactggggtgagatgatatctcattgtagttttcatttgcatttctctgatgatcaatgatattgagcaccttttcatacacctgtttgccattggtatgttttctttcaagaaacgtatattcagatcttttgtccatttttaaatcagattattagatttttttcctatagagttctttctggttgttaatcccttatcagataggtagtttgtaggtattttctcccattctgtggtttatctcttcactttgttgactgtttcctttgctgtgcagaagctttttaacttgatgtgatttattccttttatggctggataatattccactctataggaataccacattttgtttatccattcatcaattgatgaacattagaattgtttccacttgtaaggctattatccataatactgctattataatactgctatagaaaagttctattgtagacatattttttcagttctcctaggtgaatccctggaattgctgggacatgtggtaactatgtttaacagtttaaagaactgccagactgttttccaaagtggctgcaccattttacatttccattaacaatatctgcggtttctctacagaaaatattctagtttctctacaccctcaccaccatttgttattgtccatctctttgattatagccatccttatgggtgtgaaattgtatctcattgtggatttgacttacatttccataatgactaataacgttgagcatcttttcgtatacttattggccatttgtacgtcttctttggctggccaatttgtgcgttctttgtccttgggttttcatgaatataatctgtacactttgcctacaagttcagctttgggtagaatatttaaatggatgctggaatttggattttaaaatataattaaaaatttgttctgccattgcttttaaaggatttataatttaaaactggtatgtaaaactagcccaaatacccagtgtattaaaacaaacaaatacacaaaactcactaattcctacctttttgaccatctgtagcaggctcttccctgaccacagcaattcaagcctggtattctgtgtcctccagatcttttcattatcataccttctctgaaagagacagaaaattaacccatcaccttcaaatttcccactcccacttagctcgtacagcctcccaacatgggactaaataaaccatctcattctcacatgactttcctccctactctctcctcctcgctctcaactagctcagtgccctgttaggccgggtaccctagaggcgaaccctaaaatacactggtgagatatagccccttcagcattcggggcagtgtgattctgttgtgcactacacaggaccttaagcatcctgtctcctggctctaaatgttgagtgttcccgttaactcgtcattaatgggtgcagcacaccaacatggcacatgtatacatatgtaacaaacccgcacgttgtgcacatgtaccctagaacttaaagtataataaatatatataaatataaaaaaatgttgagtgttccctcctcaacattgtgacactgtgacaaactaaaaaagactccatgcatttccacatgcctgcacagggatggtccacctgctgttgagaccatggtgcatctcacccacagattccaggacatctctgtgtctcttcacacccagttctagcaaactagttgagctagttgagccatgccaaaggaagcagagcacagctactagttttgaaaacagtatatcttaattctgaaaaatttgacaagaaaaagcaataacaaaggctaaactttaaaaaaaactttttttgaaacaactactaacaatgctcttaactagaacttgaaagttaagctctttatgttttcaagctctaatattgtgaaggaaaattataaactttcatctggctataaaacatattttacatagtattattttaaaataatcatcaaaatgagtagtaaacatttaactttataagggattgtaaaaggagatcttatatatttgatttttaatgtattctcctacacatcagacttgctataggtattgaacacttccactgttgggttagaaagaatctgtgctgtaagcacgtgacaaagacagtggagcagttgctaccgttgtttatcacaggagatgctctgatttgtatgaataattccatcagttgctctaactactggggagaagagaagctagcagtaaagccaggaggactccatcaccatggcatgctgctacgttaagtgtgaatgcaaatcaatttttcatacttctcttttaaggtttattgcaacttacatgccctttggtcccaaatcatggatgaaagacagctggcttatatcaagaaactctgtctgaaaagaagcaaaaaatccatctttagcaagcaaaacaattcaaatttatgcattaaaaaacatgtattaggtatagctgtgtgtatatactgtttggtgtgctccacagactacacagatcaataataatggcattgcactaaaagagtgcagattaggagtatataaacaatgaagacacatcctactagatcttctaaatctgaagagagagatgtgtgccttaatacatagagataaaatgctcaagaagcttggagagagagagagagagagtttattctcaatattctttcatgtttgtttttgttgcacgggatggatattgtgtggcacagtgtacactcaaacaataaaagaatgtgagaagcaagtgatattggtgcaggatctggaagatggactggatttgggcccacagtgtgaaatgggagatgaatggggggctagaacagaaggtcaaaaaggttataggatgtacagttgggttacagtgaataagatgaaggaaaagaataaaaaattaaacaggctgaaaagagaatggggagggctttgaacatcaggcataatgaaaagaattatttttaatgagttgaagaggaagagaattttaggcccaccttcactgtattagaaggttaaaaactgtaaatattataacaacaactgtggctgtgtttactgagtgctaactatgagttggtgttatgctaaccatttttcatgcattatctcaaacccctttgaagcaggtgctacttttcccattgtacagaagacgaaactgaggtttagtgtaagggtaagcaaatattttctgcaaagagccagacagtaaatattttgggctttgtgggcatacattccattttgcatctacttcgctctgctgttgtagcacggaaatagccatagacgcatacataaacgaataactgtggctgtgttccaataaaaccttatttatggatataaaatatgaagataatctaattttatgtgtcacaaaatattattcttttgattttttttcaaccacttaaaaatataaaaactattcttagttcacagaacatacaaaaacaggcaatgggcaatgggcaggatttggtccacgggccctagtttgcaggcctctgttttagagaagtcaagtaagttgtccaagatcacatagttaagaagggattaactcagtatggttaactcattatgaagtcagaccaaagtcagcgccctcaaaaccaagctggaagagcaaaatgtcattcaacatttatctaattcaaattgagttccttgcatattctaggtaggtgaaagctagatgtaaatgtggaggcatagaagggaaaaacaaatcaacattacataatgtttagcatatgcagatttgcagatcgttttgaaaagtgaccaacaataagatcagttccttaggccatgtcaatagcagccttgatagaccaacaaagactaaaaagatactctcccagcattaggaagcagacgggagaccagatatggaaaacactaccctcaatgaagttctgtgggatgaaccacactagatacatgtgaaagtagttacagagttatagaatagtggagggcaaccacttcccagctgacatgacatcacagaggcaggggcatttgatctaggtttgtaaatgggattagtaaaacaaaagttttccatgtaagttttatatgtgattggacatatctaacactactcttgtaaaaaaaaattacaaatatctcaaggcgtccatccttgtaaggttcatttaaatgcttgcatttttctcttttcttggggttatttgcagaaaataggtctttaaaattcaaaaggacttaaatatctttttaaaatcctaagtcaaaggtatcttcatacagcattttttaaattgagaatttaaaaagtcaaggtctcagtcaggcatagtggctcacgcctgtaatcccagcattttggaaggctgaggtgggtggatcacttgaggtcaagagttcaagaccagcctggccaacatggcaaaaccccatctctactaaaaatacaaaaattagccaggtgtggtggtgcatgcccgtaatcccagctactcaggaggcagaggctgaggcaggagaatcacttgaacccgggaggcagaggttgcagtgagcggagatcgtgcccctgcactccagcctgggcaacacagcaggactgtctcaaaaacaaacaaacaaacaaaaaacacctcaaggtctttacatttcatttcttatataaaacagtgattcagtatcatgcatttttatctggtttgtgaaaatgcttcttaattggaaaaggtaatcctatgggttattggaaatgattcacagattgccagccataaaatccaaaatattttaaaatcctgagtcataacttttatctctggagagcagacaaataatgtcagtcctagtttacatttgaagactatagtctactacagaggcataactaacttatgcaaagtcccagaacaaccgaagggaagaataggaaatgaaaacaaaaatcaaggaagccactaatctaatgcctggatattttcttatttacatagctgttatcatcaaatagttgacaacagaaatattctctgaaatcattcagaaatcataacttttggagtatatcataacaaaattgctaagcgtaaagaatctcagctaagtagacacattaataatgtagaaaattgaaagttacacattaatatgaaatttaatttatcctaatggcttagtaaagtttgactggagagagatttccagaaggaaccaggcctattatacagaaaaaaaaatctggcaataaacgtttttctaatacagagttatcaaattgaaagtaaatgtgtcagggtcaactgagaggcaaacctaactaataaaaattgaaatttaacaaagatgatgttgtccaaacttcttagtacatcttcagtgataagaattccattatccatttgggcaagtgattctcaggaataagaatttaaagatcaatttagcctaacggcatttcgcagggcttattccattgatcttttgagtaatgtataatcaatacctttttgtctttgtttttttggcaaaggaatttgtaaaatatgaatacaattgaaataatgttgcaatgcaataatgttcttggcactaggtggaaagtggtctcaagtaaaaaattccaacatgatctaccaattggatactaaaaacgttagagaaacagagaagcaaaaatatttccatgccaagagacaagcaacaagccctaggggtaacaaaaaatcctgaaaattacttggcaatcacgtacacactgccccttccacccatccttgtattgtaagagaagggtgactttcagaggctccttttatttaccaggtagcaaaaactcaagtaaatggccaggtgggaaattatcagatacaaggaaggtaagagcattgagttgggcaatgtccttgtagactcaggtactccaggaaaggcagggaacaaagaggacatctaatctatgaaggaaactgggaggctgggcaaaggcctaaagtccttctcaacgctaagactcaatcataagaaagaaaatatttcccttaatttgaagatgcagctgttcaaattagtatagcttttccctgttggaatgaaaacactgtgtgcacgtttattctttacctactcttcccctcaagttaaagttcattctacaaaacaagggagaggtgaactcagtattattgatctgtgggatgttttacccaaggatttcaagctaatcaccttcttggggataagaaatctgagtcacataagttaaatgatttacttcaaggtagagatacgatcctatcaccttagggcccttctcttggaaattgtacaatttgttccatttctagattttaatctcaggtatgaaaaaggtacatttattgctccttattcctctgattttaattccctggaagataagcattttccagttactaattaaaatgcctagctagtgagttctctactacagccagcactaatacaatttcagaatacaaaaggaattcttgtttgagatttttttgtatgttattacacaactcagatattgctatttttttacatatttatgcttagggtaaagaggaaatacatttgtccccattttacaaatgagcaaagaaaactgaacaaatcaccaatggtctctgaggcaactgtctgatcatgactacactaaaacactaggatgctctcctttgcagaaccacaagaaggaaaaaaaaaaaaagaattaaaagcagaggaagtcttcataatcatgggagagaaggtctgagcacaaacccaaccaatggctgtataaaagtgagaggaaagaactgtccatgtctaatttcagaggctacttaagaaaaataatgtcagtgcttagaaccctaaaccaaattcctttggggaaaatcctattatacaaacacctttataataaatctatctccacttttttttttttggcagagtcttcctctataacccaggctggagtgcagtggcgcaactgtggctcgctgcaacctccgcctcccgggttcaagcgattcttctgtctcagcctcccaagtagctgggattaaaggcgcccaccaccacgcctagctaatgtttgtatttttagtagagatgaggtttcaccatgttgtccaggctggtctcgaactcctgacctcaggttatccacctgccttggcctcccaaaatgctgggattgcaggcatgagccactgcgcccagccctgtctccactttttaaagtggtctaactttaccaagacatttctaagctgatcatagcattttagtttagttctcaaactcctgatgataagaatcacttgagctatttgttaaacacacttattccaaatacagatctggatggccctatagagattaagaacatatcctattcagtcccttgacctatgatccatgattctatctgcttatggacctgaattaacttaaaataggtttgttttatacttataaaagtataaatttattatatacatgttaaaataacttttaatatgctttttacagacagtaaagcattttttaacagatacttttttagtatttctcacaattattgaagaaaacatgtaaattccaatctcatttcacaaatatgaggcagaggtctacagatctagtctttaggccagactacatttaaagaaaaagaatgttagagaattaatgtatatcaaattgtatcctatgcttgaatcatattgaacaattcagctgttggagagaataatctcagtaaccatcgaaaatgagagggaggctgggcacggtggctcacgcctgtaatctcagcactttgggaggcagaggcgggcggatcacaaggtcaagggatcgaaatcatcctggccaacatggtgaaacctcgtctctactaaaaatacaaaaatttgctgtaatcccacctgtagtcccagctacttgggaggctgaggcaggggaatcacttgaacccgggaggcggcggttgcagtgagccgagatcatgccactgcactccagcctgggaaacagagcaagactccatcccaaaaaagaaaaaaaaaagaaaatgagaggagaatctattcacagtcagttgctaatgaggctttcccttccaaaggaaatgtttacaggtcactctgggatttctaaatacaacatggcctaactttgaaaatatttttatgactggaaaagtcattaaaaagaacactttttaaatctaaacattctttagtcaacagtagaatcccaaatgtagaaaagtacatgaaaagagaagaatgaactcaccaagaatggttacagccaaaagaaatagtaaaagtaaagtcacaggcaggcagaaaagtaaaagaaatggaaaattattgcatatggatactaatacacatttaaatagttgtctgttaaagaaaatagcatgtcggatttcagacaacacaacaggaggtatcatttttattaacaatagtagtagtatccttattcattgttatttcaacaatacaagttcctgagtcctagaagaaaagaaacccctgcctcccatcatccttctcttgagatcctctggtgcaacccaaattcctgttttcctgagaaaacccttctccaggtttatgaagacatagaagctccctcaagtccattgaatgccccagtgcaagctgctgctggaggcaggtagtgacctggatccaggtcacctgtgtgtaatgggacagctggatgtatatttggaccagactccaaaccatgtgctgcaaggcagcaggaaggcagctcctgtcatgagaaactcgcagagccaaatgctcttgcatcctctccaaaatacactaaagtctttactgtttcagtttatgtgtttatgtgatgccattctctaaactagcggacaaatcacaattgcaccaactctagagttctgcacatatataatatagatgcatacagcccccataaccatacaattcatacaaatgcatacatacatacgataaaccatgcattctcagttatccaggcctctgaataattgaaggctaaacctttaaaaacaccccacctttaatagtgcagagctacttgtttgctgacactagaaaacccactccctccctgcttgccagctgcataccccaagcttaatctctgtggctgcatctaagccccatcgcctcttctttctttacttggattcctcaagggttttttctttcctagcttttctcatgcttctcactttcacatgaaaagacatgcctttaacaggcatgacaaaccaatcagatggcaatcgccctacgcaccacaaaatcttcaggcattcaactccactcaactgttttcatcacttactactcaacagttactctttgtagctaaaaaatgctttttggcattatcctggaaacctgagaagagaagaaggttgatttctagataatctagcctatagcaggatttcaagttcatttaaatctattgttatagacatattaagttctactcaactttttaaaacagcgtcacaccactgtaaactggatccttgctgtaaaatcaactttgtattcacttaatttattttaatgcaaggacgaatgtaggtgtggatacaatcacttgtgttattaaaatgatccaaaatttagctgacaatttactatagtgaaaattactccaaacttaaatcactgactagtacttactgtggcatgatagtttctatacatgggcatttttagtatctttgtcaagtaatcttccagttgtttctgtaatgcaaatattttagataagtgttaacatggtcatatttatttttaaaaattaaacagtagtgacaatgatgagatcatcattttcatcttaacttctacaagttattcaattatttattaatataatcatggagcaaggaatcctgaatagcattaaggtgttatttccatatttctcttgaactattatttaaatatcttcttactgtttaactttccatatgcttaggtcttctataaactgctgacaagccctattatatgtatatagctattatagcaggacttgctataagttgttttaaagcatttgttgatattaccaaaaactttcatttttttttcaattctaacactgaacttactgaaagatacactacaaattttaaacagcttttcaggaaacaaaggtggagaaaggttaaaagactttctagtagaatgtactgattttaaatatgctaaactgtgtgtggaggcagcaggggagtagagggatataggcttggggcactggagcaacatatgtcaatcatattgaccatgatgtaaaatccagcatgcttttgctgaatcactaagtgtcattttcagttgaattcatacatgtgcacacagtaaaccaaaactatataattttatatgtctaggtatcttggaaaatatttggtccagatgcctacaaagattttaaacaagatgacaactacaaaggagaaatcaaacattccctctggaacataaacatttcagattacaaaacagaactgacagaaattaacaaacacttgttcattttctagtaaaaaaaattaattgtccacactctgcagcacccatcttggaagcagagcaggcagaagtgcccctcctctggagttttctgtcccagtgctgtgcctgtctgtactccgtcagactcttctcaggccctaactgctccatctatagtttaggaatgagattttacatatatttaagatgggctattacaaacacggaaacttatgtatggaaaatattattttaaaagagtagatctcaaaacccacaacaatgagttcaatctttgactcacaataagcccaaggagattctagcagggagaacagcttcttcataatgtcaaggcctaaccaagaacgctcttcctcttctgagaaaatgcactgtatggcttggggaaagaagggactgcctaactagttccagaaaagctaaaccagcctggggatcaatgagtggatgagaggagttgtagccaggcctacttcacccctcagtagatgctgtgtttctacagcactgcaaaattaggtttaaaaccacagaatagtgaagaaacttactcttctaccaaggaattgttcttctcttatcatgttttcagatgaacggggcaaactgggcatctctcgaggctcctctctgacgttttgcctcctaaacgtgtgtctaaaacacaaacacacagaatgcaaacacctactagattattctgtgactatgactttagtatgtctttcatgagacggcatatttttaagagactatttaattgaaaatatctaccaacaatagactagttagccgatattgtgaattaaatacactttttatttatttattttaaagattggatgtactctgtcacccaggatggagtgcagtggtacaatcatgctcactgcagttttaaactcttgggctcaagcaatcctcctgttgtagcctcctgagtaggtagaactactaactatcaccacgtgccaccacgtccagctaaatttttaatttttttatagggaggaggtcttgctacgttacacaggctagtctcaaactcatgacctcaactgatcctcctgcctcagcctcccaaagtggtgagattacaggtgtgagctaccacacccagacaaaatacactttccattcaacttgtatactggcataattaattccaaaatggttaccttctagtgggaatggggatgcggataaaggctttgtacttgagcagctctctgtgaaattcttgaaaatgcttgaatttcctcttaacttgccatttaaattccccatgtgttaattcaatagtgtaaagattaatacttggtacctacagtgatacataaaaatgtttgatattttagataacaacaaaaattccaaaagctttcagtgaacaatatttaactagtaacagagaagtatacttaagtccagcctacttattttgtgtaagtacttaagtaaatttgtttcaaaagcagccaattgcagaaataatattctctaaatgttcacttgatgaattacataagacaaactttcaatcacacgagacgattcctacaaacgctgttcctccaacatatgtgcgtgtatgcatccacgcacacacacacctgaaatgaagaactaggtggaggagacaatgagaaaggccctaattagccttcaggggtccagtccacaaatataagccgtgcaccaggcaattggcaggggtgagacgtattgtatactaacagcaccatcttggctgtttttgttcttcagaaatggcacgacatgccttctctccttctcttgtgaaacacattccaaggtccagccttgtctataccacccacccaccctaaggaaccaccagtgttaaggaggggtgggtggaaaaagtgactgcagtaatgagtatacagtgtatacttgtataatataatacatatgtattattattactaaatctttgtaataaacctataatgtaagcactgttataccctttattcagaagaggaaacaggaacagagaggttaagtcactcattcaagatcacaaggcaaagatgaattaaaccatgcagtctgcctctagagtctgtcatttacccccacatgttattatctttcaatctaaatgctggcaggtgaaataagaaaacaaagctcatcttagagacatttctgagggagttgtgctcagtggtgtatcagggagacatggacccgagtcacagggaaagcctaaaccagaggctgacaccaaaatgagtgtaagctgggagtcagtacatgtgcaggtaggctgggacacagcaccaggcaaaaccacccagaaagcaatgcagcgcatgccacctccaaaagacaaggaggaagggaaggcaaagcatgccctgacagctggttattaatctgtgcttcccctgaggcaggaggcagtggtggccttactctgccatggctagatcttagcctgaagggacaaaggtcaccaccctgcagcaattgtcctcccccggagacttaacaactgcaaaatccagccaggaacagagaaaagtagctaccctaacagcttcttctagtccaatccatttcaaagggcataactttgattgttgaagacattttactccaaagccttttcagcgttcagtgaaatatcacgtgaatgaggactaaaggatggttttctaggaaccaatcagagaggcagagtatggctgcagaattctctcaacagtattttgaggtaatggcactggccgatccagtatcccggctttttttcttaagagccaggtagcaccaacattttcatgctaaataaacattaggaaagctaaaattcttgttgacttatacctgccatgcaaggtggaataaatatgcatcaagagtccaaatgaaacagaaaactggggagagaagaagattaagagaggcactttgcaatttattaaactgttaatttgccttacatgcctttttaaaagaaagagctttggctcaaatgaagaaagaggaatataagaatgaagattaaatgggaaggaggcaaaaacttgacaggtgaaaatgacttggaaatgatagatacataaaaacaaacaaacaaaaacctacaaacatgatcatagctaagagggaggaaaatgaaaggctatgtactaattcacatatattgacaaaagaaaaaagggtgagtccataaacgctctgacccttgttgtagatgtgaagcgttccacttccagaacttgtgcttttattggacagccggagagatacgtctgtatattaggctccttaaatccttgagtgttataaatagcagagaaagggatatacactaaaaaaaaaagtaaataaagttaatgcaatatatgattagcataacttgtcttttacaggcattcttttaagaatcacgtgttaaaacaagtaagcctcttataaaatgatctgagcccggtgttacatctgcaaggaaaatcaatcatttgctggttacttcaaatttgtggtcttccgaccaaccgagataaactcttttcttccccgctcagatcatccgtctttaccttcttgtatcttgggatcgctgggagacacgtcgtagtctacctcctctccctcaaagtggagttcccgcgtgtccagattttctatgatattactcatgtcagcagcaattttctgcagtgcagaggtatttacccgtggctcgtttttcagtgacatgttaactttggacagagtaaaagcaaaggggctaggaaagaagaaaacggttacaaagacttagcattttgataacataaaatgctattccacaatttgaatccagacttagatacagcatatggaaacaattcagcctgctctgtgtgagcctcagttatccaaaacaaccttttagtttacgttcctgtttaacatttaaaggattcctaacttgtaaattaaaacagagtgcttaattgaaaacaagagaaaaaaaaaagaaaaaaaaaagcaacaccacattgaatgccaacatttctctcatccaactttattaacttggataagtaattcaagggagattggtttgggaaagcttattcagagaaagaaatagattatttgctgtaataaatacagctgaagaaagaatatcatgaaaaataagcaactctaaatatttcctaaagaaaatttagagtatttcacatattgaaatatatagatttagaaatatttttatgatagcataatatttctacattttctctgtaggtgatatcccaagcaaagtgtatattacctcttcaagaaaggagattttggccatgactttacgtgaggtataatgacgtatgtgtcttgaaaggaaattgattaatatacctattccgaaagacatctgaggtgctagaattatacttccctcctttctttttctttaaagaaaaccagttctatttcattctgacatttaataacacaagtcgttgcacatcagtacccagggcagaagagttcacatggatattatttttcatgtaaaatattgagattcaagctttgcacactgtcatcagagttggatgaaacatctgttttgcctgatgtagaaataatctgttaaaaccaggccctagaatggaaggacgctcataccagtaactctttggcacatgttcctttcttactgcaaatcacaaacactgagcatccaccacatgtgagatgagatgaatgaaaacgtgaaggtgaataaggcaggcccctgtgattaaggagcacctgatatgggtgaggaaaatgaggcatctaacccaaagttcacccctggcctcctccaaggtcttaggcttcttgagaatgaaatttgcccaggggaagacacttagctgggtctctcctgcaggtgctatcaaaaagctaagtggctatatgggaaatgctaagaaagtctcaggcaaacttacacagcccttattataactcaatgagtctcgaaaacctatacttttatgtctgggagaaagagactgtgtttggaaattcaaaaatgggagcgaaggagggaggttctggtttggccagacatataaaattcatatatctaagttccctggaactatgtaatcaatcatgtttctttctctatgttgcctgtaagaaagcttggagccaaatttgtggcctactatatagccaagtataggactatctcttcccttcaactttccctcccacttctaatttatatcataatagttaatagttactaatgtttagaatgcacctcgctggtgataattgtttacatacattgtctcatttgtcattaataataaatctgtgagggcttgttttttctattttgagcatgacaggagtttgccatcccctctttatagataaggaaactgaggcaaagaaagactaagtaacttgaccaatattttaaacaatctgtcaaggtcacacagctggtaagtggtgaagaagggactggaattcaggtttctctaacccaaaagttgatattctcaaccacgacctttatcttgctctctattctttgtagatatgtaagtgctttggaatagatggaacagttaatataaataagtaccctggggcaagtccatgtaagagcaaaccctaacaggaagaattggaaataatctcctgcaactcggttaccacaggatgaagccatttaaattcccagggtctttgtttcctctctataaattgaggaggttgagccatttcatctctagagttcttttaacacgaaaaccctaactgtagataagagatgccataaaagtattcagcctcccttataatttaattactttaacccttttcctatcccaagagattaatcagagtagttttgcatttgggtaagagaagcaggtagcagaatgttttctaacctggataacttaattaagatctattcagcctccattgaggagccattgcccttggtcaaaatcaaaatatgtatgtcctttcctcttcattcaacaaacacttaacaatgtgtcagattttactttatttaaaatacaaggtaatgaaaaatttagaggaaaagagacaaggaaaaacagataagaaattacatcatatcattgcagcttgttaatttttaaagacttcagatattttttattgattaaacagacttattaactttgccaactttcttaacatagtgaagaaaaacaaaggttactccaaataaccttccttttgaactatgtgctgatcttaaaaatgcctgttaattttaagaaatacaaagactacagtaatctacacagtgttacagagccaatgcaccaagctgaaataaatatctgacttcagatagagaaaaaagaagcatattcacttatgaaaaacttgaagagtgagacatgaaacaaagaaaacatcttatcatttatcaagtgtttattacatgctaaacacaattttagcacagttatgttatttaatactcacaatgaccctacctggtaggtatgattattctgagagattgagttaaacaatcgtccaaggtcactcaacttgtgtcagtgttgagtttataaagcagattttgtctggctctaaaatcttatggagttggttacagaggcccataattacttttattttatgggcttgaatgtctataaatctaaattcatcttttatatgaagtttaagtcctgtgacaagacatgtcctctactttagtcaccataccttggaagggatcatactaatcccacagtcacctcaattatgaaaacaacatatctcaacagcttcctgagtttcttcttagccttttacttttatggtttataatattttataagatcatgtggaacttcaatggacccaatgcatttgcagacttgttcatgcttttgtaaagactttactatttaataatagacaatgaaagaagtgatttgtctatctctacctttacttatgtccatgggcattgtgtgctgacttttcatccaaccattgtattgttggtttcattcttgaatatcaagctgcaaaactatctacgctcctatgttgtcaaatcttcatttatcagtcaatgttttctttcatctaaaataatctataatagggggtgagcagctgccacaggcacagcctatattagccagcaatgggataagggcttcagtgtttacacttgagataatgcaattgattttgttacctccttataaaattatactgcaagatcattatctctttcagtaccaagaagagatggtgcccatggagagataagagcagctgtgttttatttctgtttgcatttgtatctggaaagcaaataagggtttttttattctcgttttgaattatagaactgaaaatctttgcagggaagatttaatgacctccagttattcagtgatgaaatcagataattttctattcttgattttcaacaagattgggaagtagaacatcaaagagaagcagatactttccttttcagataacaaatagataaacattgccttagccaaaatacaataataatatcaactataattattgatattaacataaatatgaacattagccagtatttgctaaatatgtactacatgccaggttttgtacaaagtgattaatatcatgatctcatttaatcttcacaataactttaggagctgggtcccattgttactagcatttttaatgagtagcttagagaaggtagaaacttggcagggccacacagctgggaagtgatgaagctggtgatcaatttgatctgacctcaaagcccagctacttgccaatccagaggtgggactggggtgggaggaaagatgggcactgggagacttttacaattttcttcatatactcttaaaacttttttttaaagtcagggtcttgctctcttgcccaggctgcagtacagtggtatgatcatagctcaatgccgccttgaactcctgagctcaagtgacctgcctgcctcagcctccagagtaactaagactgtaggcatgtgccactacgcatggctaaaaagtaaaacaatttttaaaataaaaacaacccacattcactctatgaacatagttacgatttacttattgctccctttctaacataatatgcaaaaattcatttttttctagctgctattgtacttaactgagataaataaatgcaatggattcctaagccaaaaattatatcataatgtatgaacgtaaaaaaaaattatgattagatagtttaaacccaaactgagttatggggatatcttgttttcccattttttcatgatgatgaaataaattaaaggatccataatatataacctatgaaaacacatcatacagcaactctatatctggaactgacttgatgctctctgagatataaaaattataaatgtggattcaagtactaaactcaatctttagtaatataatacgacttggataaatattttttgagtttagctgactttgaataaagtaaatgatattaacatattttacattccagactatatattttgagaaaatacattttaaatatcctctgatgtttacttggatctttgactttttttttaaaaggaacattgcttctgcaaatattaatggaaggtgattatgtaccttggacagaaaatgagatgtcaatggtataagggaaagatcaaatgacctagaattgttctatccttactatgagtgtaacctgggcaactaccagccccagggttgcagtgtccctctgtgaaatgttccactcatgcttcctcccttgggaagctgtgaggagcaaatgtgatcatggatactcatctacaggcaaaaatcatcttggttgctagtgtcatctttaattctattaaaagctgacccctgaaaaaataatcttaggagagtttatcctgcttttcatctcttatttagctcccaaaactaacataccatcttgcaactgtctttctggctgggctactctaagaatgggtctctgtcattcaaccagtcctgaaatttctggactgtactacactaagtataagagaaaccagtaagccttcctctgcaaaaacaatcatggaaggcattagccagtcagacccagctaatgcttccttttccctgcatgtcttcctggcctcatccaacctgctctccctggctggttatgcaatccttccttggcatccccatagcgctctccacttttctcacaacagtggctcctgctccctttgaggtccggcatcctttgcaactttgatgaaatctatgaacccacaaccccagaaaaaaatgagcacgggctcacacacagcattttgcatatattttcataggttcatggttgcactctcaagacctttaagtgaagaagcacgtccactgagccgcaatcatgtgctgatgcactgacacatctgtcttcccactagacagggacactctttggggaggagggttagagtcatgggcattcaccacagacacccagccgagcacccactcaatacgtttgttgattaagtgacataatcaatgagctgtccatagagaaagctgtcagctccaggttattcagtaaatgacacaaagagatattattttccctcgcataccacagacacactcagatgtagaagccttctggttgaaaagcccctgagaggcgtgtaacatgttagaaacagattggctgccaacgcaatcacagctaacacagcaaactgctagtgaagcttcctgtgtgccaggcttttgctgagggcttttcatgcatcatgtcaaatgatcctcacagcaacttcatgaggagtactgtcatcattcccactttgcagacagtctgacagaggtgaagagtcagaaagtcagtaagtcagctctcagcctggctctggctgacccaaaagccatgcacctgctcctcttctgccttccacctgtgcccgtgccaagaaaaggagattccaagacatggaatcacccagccgcctttcctgcccataacctgtgagtccagcttgctattatgtctatggttctaagagtcagaagtctgactcccaaacacagcccttccactgagctccacatctagtctgatctcagggagcccagagcccagcaatcttccacttacttatccttctctcctggttttatatcacaccctccacgtggcctaatgctgacgctgcttttatccctgagatatacagactggtgctaaatactttggactcactgtgcccacagaatagaagttgaactcacgttctctttttttcccctagctaaaaacaaagaaacaaacaaaaacacatctataatgacataaagcaaaatggttacatagctcttaaaatttccacaatttctgccattagctaatctcaactagtaagtatgtcattaggatacttctgataatgatctatcccagccatttttaataataacccaagaaaaccaaggcagctttatgccatggaggcaataagaaatcccataagacatcatggtttccagaaaggacaaccttgtagacagctgtttcactatccaatactgaattaggatataactcacacgttttggggcattaaaagcatttcttgattctcatgacttttcctaaattctttgacctctttggacgaccttttaaaaacatcctcggcatttgttctctggcatgagctttctaatttcctttaatatatcctagagttaaatatttccctctttgcagtggtgtcagcttctagctcatctcagtcatatctttgaattcaaactttgcttccagagtcaaatacaaatgttaaaggaaattgacatctatttcaaatgttgatggttaagaaaatatgatctgtcatttcctgagtgcctgtactgaaaggcacgttacaggtattacttccaatcctcacaacaatctcactggggccatgggagcttactgaggctgcacagttgtgagtggtgggactggtccctgtatgcaggcctccagatgggctgggtccatctgcatccctggcctctgctcagtaaagatccccagtcacaactgctctcacttcttctcctaatgccaccaacaatctcagcctccttctgggcaagagcagggctttggcacagcctccatggcatgcagcacagcacgtgggctccactgacctccaaccagaccctcagaggcactggcacatccagatgtttttggattcagttgaagtgctgcaccagggacgtgttctcttgcttcctcaggagttgtacatcaggggggtaagaggagtacagggaagcaagtcacacagcgtgtgatactgagaggtgacaacgtgctagcagtcctcactcgctcttggcacctcctcaggccatggcgtccacgctggctgcgcttgaggagcccttcagcccaccgctgcactgtgggagcccctctctgggctggcggaggccagagccaactccttctgcttgcagggaggtgtggagggagagacgccagtgggaaccaggctgcctgctgcactcacaggccagcgcgagttctgggtgggcgtgggctcggcaagtcccgcactcagagcggctggcgccaccggccccgggcagtgaggggcttagcaccgggcaagcagttgcggagggtacgccgggtcccccagcactgccggcccgccccactgcgcttgaattctcactgggcctcagccgcctccccgcggggcagagcttgggacctgcagcctgccatgcccgagcccctcccctccgcgggctcccgcacagccggagcctccacgggcaccaccccctgctccacagcacctggtaccattgactgcccaagagctgaggagtgcaggctcgcagcgcgggactggcgggcagctcagcctgcagcctgggcacgggatccactaggcaaagccagctgggctcctaagttgggtggtgacttggagaacatttatgtctagctggaggatcctatatgcaccaatcagcactctgtgtctagctaaaggtttgtaaacgcaccaatcagtgctctgtgtccagctaatctggtggggacttggagaacttttatgtccagctggaggattgtaaatacaacaatcagcactctgtgtctagctcaaggtctgtaaacacaccaatcagcaccctgtgtctagctcaaggtttgtaaatacaccagtcagtgctctgtgtctagctaatctagtggggacttggagaacctttatgtctagctaaaggattgaaaatacaccaatcagcactctgtgtctagctcaaggtttgtaaatgcaccaatcagcaccctgtcaaaatggaccaatcagttctctgtaaaatggaccaatcagctctctgtaaaatggacgaatcagcagaatgtgggtgggcccagataaggcaataaaagcaggctgcccaagacagcactggcaaccagctggggcccccttcaatacggtggaaggtttgttcttttgctctttgcaataaatcttgctgctgctgtttaggctttgggtctgcactgcttttattagctgtaacactcatggcaaaggtctgcagttttacttctcaggccagcaagaccacgaacccacccggagaaatgaacaactccagacgcgccactttaagagctgtggcactcaaggagcaggtctgcagcttcactcctgaggccagcgagaccacgaacccaccagaaggaagaaactccaagcacatcagaaggaacaaactccggacacaccatctttaagaactgtaacacttaccacaagggtctgcggcttcattcgtgaagtcagtgcagaccaagaacccaccaatttcagacacaatactagggcaggttaagttgctggcagatgcatgcctctcccctctccttttggccttggctgtgctgagcacactgatacaaaacagtcgatctggatgatgttctatgtgatggagcaactggctgctttttgtgggaagctatggccagccaggaaatgactgctttgccttcttccctgcctctcttctcttcctctcttttttttttttttctcctctagaattataactactcccattcaaccctactatgcaaccttagaggctctatacaggaaacttgagctaggatagtgttagaaccaggattccaaagcccatgttttgttcattgtttttttctgaaccatcctggctcctgcagaaattcatttatgctgaatttaacagtaatttttaaaaagcagacttgcatcatgtttactatgtaccaggcagtgatccaggtggtttgcatgcattaactcaatctgtccttacaacagacctatgaagtaactgctgttcttagccccttttaagcaaggaaactgaaggcacagacaggtaagtgactgtaagggtcacccaacaatctgatctaatttgctattatttctgccttgattaacttgggcaaagtaactttaggtggtgctcaacttcctcacctaaaaactgaaaattaaaatatctgttttacatgaatatgaagttgtctgtgtttaggactttacaatagatagattaaaattttaaaaactcctctctcaacattactaaatgttagaaaaacaacatattctaagtgacatcacccagaagacaaaaactagcccaaatgccaagggcatttagatgaggattccgagtcaacgtctaagaagatttattcctgcccctgtaaatgacaaggcacattataaagatttgtatttgaagagaaaatatgggaggattactcctgacttcaaagcctgttaataagtttattacgtgtaagtcagactttgtacaaccgctggattgacttaagtcaaagggaaaattcttctttataaaagaaaggtagttaatattgctaaaaactgtggtcagacttctaaaattaacatccttggatgttaaatgaatactcagtttcttcatggccaagaacggaatattcatgcattcctttctttcacttcccttcaaagcaacagggaagcaacctctgttggtgtgagttttggcagtacagagagtgttttcaatgataacccatgaatttcacgtatgagaagaatggatctggcaaactcacattgtaatctcctccaaacactctccagtgctgattagcttttgaattctgtcacaactgctagtagacatagcacaatttcaattttttggccatctatgtaattactaaaaatgtttgttgaggcagtacagtaccatggtagatatgtgattttgagtgaagtaacttgaaatatgactctccttatggtgaaacaagttatttctgtctttctgtgtctcagattcctaatgtgtaaaatggaagtaatattgcgtggcttagagcttgggctatactagatgctaaaataatgttagttgttcctatgcccctagttattctaagagctatcagtaagacccctgcccaaagtccatatattcctacctgaatcatgtcccccctaagcacaggaactagcagcaacagttggatttgggaatggtctgatgttgtccactatagaaaacactgctacaaacttctggaaacaaaatgaatcaagctaatacatatgctccatttctactgaaaacacagaattgttaggtaaattgtaattgttttaagaaaagatttattcaaggttaacagcagtggcagcagcaacaaaaacaataatgaagaaaaaacctacagtgtctaagaatgaagaaactaaagtctgatgggcacactggaactgaagctgtagggcccaaagggttctggatctcagataagcatctgagattacagttctgttgcctcacataaattttaggagataagatctcagaatcatgggaggcagcagcctggaagtgacactcttacaaaaaaacccagagcttcagcgagctacactgcctatttaaaagggactaaataaccacacccagcatccctgggaagaaactacatggaactgtggttaactacaaaatgaaaaactgtacataaaaattatccaagatcacaatgtctagctttcagtaattgaggtagtgcttttattagatttaccatcccacagataattacatattctggaatatatatatgaaactgcaaggaaacctacatttggaagaaagaaacagcattgtttttgtataagggctggtcccagaccatgtcaacttgagtgactaaaactcggatagaaagtccatagatttccagcttgaagaaacaaagaacaaacttcacagcaatcacagcagctgaaaagtgaggccagaaatcctagaaaggagagagccacagagagggagacagccccaaattttgcataggctgacgcttgaactacataggcatgggatacattccaatgcaactcagctagtactaaaatgactttaacagatatttctgctactgcccaccacaggacagatggggtttggtgtttgagtccaagcaagttaaatgactggaaaacaaaactaaactcaacaaaaaatcccaactctggaaagaagtataaaggaattcagagtctctacaacatgtcagtcacaatgtcacctaaaactactacacatagaagaaacggaaagatgtgctccattgtgaagagtagagaccaatcctgacatgttgaaattagctgagaaggattatttaaagtgactattataataatgctcaaggatgtaaaggaaaatatggttttagtgaacgaataagtagaaaatctcaccagagaaaagaaaaaatttgcaggatgggcttaacagcagaatagcaatgacagaagaaagggtcaataaacctgaagacaacaatagaaattatccaatctgaaggacagacagaggggaaaaaagatttttaaagaaatgaacagagccttagtattgtatgtgataatactttaaaaatctaacaagcatataatttgaatcccagaaagatagggtaaagagaaaatggggcagaaaaaaaaatgtgtaaagaaataatgataaaaaattcattaaatttggtgaaagaaataaatttacaggttgaagaagttcagcggatcccaaacaggaataaatgcaaagaaaattacaccgaggtacattaaagtcaagctgctgtcatgtaaagaaaaaagacaattttgaaagcagccagagaaaaatagcttgtgttcaggagaaccacactaatgacgataaacttctcattagaaataaatggaggctataagattgaaacaacatcctaaagcttaattaatgtggttgaattagtaaacaaaggttgcttttcctcaaaggaaatctactgattcaaattcctaagaatttcttacagaacctgacaatatgatcctggaatctgtaacagagaaattataataggtagataagacttgccctatcaggtagatcaataattattacgaacctgaaagaaataaaattttacattattggcacagaaatagatgaactgaaccaagtagggaccccccccaaaacaaacctattcaaatatgagttcttggcatatgacaaaagtgaaatgaaaaaaataatggagaaaaataaactgtttaataaacaatgctgagactattggcaattcagagaaatataaaataaaattagttctctacctcaaagctccaataagaatagtttccatattatagtcccaaatatgaacaacaaatatttttaggattaaagagctaaacatgaactacaaacatgtaaacatttgaaatatagaagaatgttcttaagaccttagagtcagaaaggaataaaaagcacaaaccataaaggaaaagctataaattcaactactctaaagtttaaaacgttcattgaacaaatgggaaaattacacacacacacacaaaatttgtaagaacaccagattgggagaagacataagtagaatgtataaagaactcctataaaaacataagaaaaatgtaaaaaatacaaagaacaagggccaggggcatatacaggtaacccataggagatcaattctaaattgtcaataaaactttaaacatgctcaacctttccagtaatcagggaagtcgtattgaaacaatgagatactattttacattcattggatcggaaaatttttccaagtataaaattacaatgtattggtgaggaaatggaactctcatgcactgctgtgaattaaaataaccttttagaaagtaatttcatggccaagcgcggtggctcacgcctgtaatcccagcactttggaaagccaagacaggcggatcacgaggtcaggagatcgagaccatcctggctaacacggtgaaaccccatctctactaaaactacaaaaaattagccgggcatggtgatgggcgcctgtagtgctagctactctttgggaagctggggcaggagaatggtatgaacctgggaggtggagcttgcagtgagccgagatcgcgccactgtactccagcctgggcgacagagcgagactccgtctcaaaaaaaaaaaaaaagaaagaaagaaaattagacaactgaaaatatccatctatcagagaataggtaaatgaatgttttaaatggaatgctatacagcagagaaaataagtgcattagaactacatgtatcaacatgaataaatgtcaatacaaagtttggtgggaaaaatccagcttacagtttttgtttaggatttaaaaacatagaacaatcctgttaggttgtctatggataaatatatatggaagtatgacataaaaactaattgaggaaatgatacacaataactttagaagagtggtaacctttagcaagagaggtgggaggagaacgcagttagcaaggagtccaaaagggactcagtgaatttttatttctgtggtctctatcatacaaatctgacattttttctggctaaaccgaagttatctatttgcagctctttccctcttgctgagctgtaagctctttgagaactcagaatgacaataaatgaaacttgtggccagacttcccagttacatctccatggcaaacattaatctgtgatcacagcctactttctctgagcctgcacagacctcctagttcttcttaccccacacttcagaggctttaatatcttgccatctctgaaagaaatcaaatctgatctctctcatatctttagtatttgttgagaagaaatgaattaaatgagggaaatgaattacataaccagtgggcagtattttactatatgtgtgtatgtgtcttagaaagaatagaaattaatgcaactcaattcaattcaaaacctgtatggtgcacatatttggtggcagacactgagtaagaactgagcatacaacttttagactgaagaaaccaatgaatacaaaacctggtctgtaatgcctggcacacatgatgatctaggcattcatttggtccaacctcttcaatgcactgagaagacagaggctcagaagcatacagacaaaggattgatgagactagaactcacacctctgttgcactctgcttgcccatacaagcctgtttcaggggtggattatttctttataatgcagctttgaaccatgtctgaaatgtgtaagaaagacaaccagatgggctggataaactgcttttgtctgagctgcagccagactctgctcagtgggtgtggacaggctgccagcctcactgagaaagaactagtttggtctttgttcaaccgctgctcctatgcatagtactaaggaacagagatattctcaggacacctgaatcctgtgacgacattcccaagggtcagaagcacatgggttgcatcaatactaacaagaaatggcaagttaaaaggcaggctgccaaactttgacgaactggaaagagagtcggtgtgcaccagccagactgataagccaccttgctttccagtgcagccgctttgcagggcttcttaagcagcttctcaggatgacagtagttcactcaatggatatttattgaacaccttctatgtgctgagcaccatgctaggcactgagaatataaaataacctcatgcatttcactttaccatgacaagggaggctttaagggcagaatctctcaatgtccctcaccttatttgtgattttgactcctttcccaccaaaacattggaagaagacccctcctctgcctctcctgtctcccacctttgcttgtttccaaccgtcctctcattatttcatcagtcaactccctcatcaacttctcctgatcctgtgactttcccctattaccacttaaaacattctcaagtatctcaattacacatatgttcccttctaccgcttctctctccctgtgattcatagttgaggtttttgtattacgtttccctgctcagctggactgaaccaaacatgctccatgctctccaaactcagcctttcaataggctgctccgtctgcagctttgcgttcctccaaccccatctttgcctgattgattcctatcatccattgggactcatatcaggtgtcacctcttccagaaagcctcccctgacagcccaggctggtttaggtgccttttctctcagtgtttctatggcatccaagtgagttcattgagtacactcctttccacttggtctctgactcctctggaagactgagttttctgaagggagaggctgtctctaaatcctgagtcactggtgtctattgggttctcagtcactgtttctgaatgaatcaaatgggaatgaatgaatatgaataagacttagaactgctcacagtttgggcagcacaaggaacatgtgtgtaatgctttctgggttacaaagcattctgtacacatatctcttaattttcctaataatcctacaggggaaactattatttttaaccttcttttcattgaagaagtaataactcaaagtgattaaggtcatactgtgaaactgttggtctgagactcagtcctgacccctcaacttcatgttccctgctttttccatctcctgtaagttactgccttcatattcagatgtatacaattctccataaactatcctcatcaaaatctcatatctggaaaccagtcttctcaccttgtgtctaaccaaactacttattagaattgaagataagtcaattctggctaattttaacaaaagaagtaaagctagaaaaggaaataatacaaccagaacaatagagataacacttccatttttctccagtgtgatggatgaacataaatattagtgatattacatccttcttccaagtggcaaaacatctcaaatgtagggcttatgacaaaatgaccagagatttgccctgtgactcgctccttattaaaaccaggaaatctccatcctatctggtgagacagctgtgcaggcaacttttatccaaggtcacccttgagactcagctactactatatctccaacaaggtgttaactcgccaccagctccttctagacctcacaccctgttcatccaactgagagcatgcagtccatctctgactcttcatttgcccaaaaatctctgcttgtatgtccttcttttgcagtcatctggagaaattcaatcctgggccacacgaactatctgccttcttggcacttaccccaaggcttctaaacaggggctgcagaaacagcactcaactacatagactggtatttatggggctttccagctatgtctctcacccccttttcaaagtcaacttcctaagaaagttgtctacttcctccttctagttcatccctcctccttctttaacttgctgccactggcctccatttgtacactccaccaaacagctctctccaaagttcataaccacctgcatattccagaatacgaaggacacttccccattcttatctcacttaatctttctgttgcacaacccttgactgcatccttcttgagggtctctttcctcagcttacatgttctcacactcctctagttttcctcctccctctctgccaactgagatgaagtcttctttgatgctgttcttcttgtgctcaaaatttacatgctaatattattcagggtcccaggattattctttctcactcttctcagggtgatctcatccactctaatggttaaaatacatgctgatgtttcctttactcagggataccactagtgaatacattcctttcctcttggcttctgtctcccctaaaagactgggagctccctgaagagagaggccatctctgtattgcccatcactagcatctactgggctctcagtaactgtttccaactgcgatccttgtcctgatcttcagacctatctatccagctgcctaggaacttccccactgggtgatcccatagagcatctcaatatgctcaaaacagaattcatcatcttctaaccacaaaacactccctcttcctatgttttcttcttgaagaaaattggaaacatcatctacccagctgcataaaccagaatcctggaactcatccttagcaattctctttcctaactctctatatccaatcaattaataaatccagccaaattctaaatatctctcccatctgaccactgtattttaactccataaccatgatatgtttgaagaaatgaaaaaggtgcagtgtacctggacatagagtacaaggcaggtgatgttaaggcatttagactttacctttccacccccttctgccagagtggtcttgatgctgtggtcctagagctaaaaagtcttcagtaaaaataagtttgggctgccccaaatatgattttgtaggataagtaacatcacttttacttggttatttttaattacccagctaaactatggtattctatcacaaatttatattctgctaaacagaaaaccagctctctataaagttgctacagggaacaatgatttccagatgagtttcagctgtgtaaagtaatgccttaatgggaccaccagaattctgtctgtcacatttaagaagcaatgcaatatttaaggtaaacaagctaaactggatgtgtgtcgacggtgaggttcggggggaagaaaggatggaaggggtaatgaagaacatgccaggcttaagaatgcataggcatagttgacagattattgattcaccattaaaatggcattaatataaagtgaataaaaacatacgatgtaatcaggatgtgccttaagttagtagctgttaaaaagtcattgttatggtacttacatctgcccaaaactataaatagtggcaaaattcattaaagaaatgttaatacagaggaactaaagcatacacagtagaaagagaagggaacaacgtgctagcaaaaatctgcaaagacaactccgtcaatacactaaaaatcttgaattgttcactttcagtgggtgaatttcatggtttataaattatatcccaataaagatttttttaaaatcagcaatggcataggaataatgacctgagttgtaaaaatcaatcaatattcaaagaaagggcaggtaattttccttgatcccatggcagaaaaaccagaggcaaaaaccatttttacatttcttataacaaaaatagacaaattgcctatactaaaaagaaaaggggaaaagacattgtcaaaacacttaaagaaagcaatctaccgacgtctacattgaatattactttaattccactgttttcttctgaagactctgctcagtgagataattatgttttcacaaacacagaaatcatactgggaactattatcgtctttaaaaaactacaaaagtatgtgtcacaaagaaaactattgtaagttcagagaaagtatggaaggctcaataactagaaaaaacaatcagataaagaaaagagaaattctgggtcagtgatcatttcctttttaagacagggttccaaaaaaatgtagaaaagatggacacaaagcaggaatacccagctcctcaaaggcacacacacactcatgctgggcaattgttggaaaagacacgggatgcaaaatttttagtctctattagagaaacaagttagctcatgtgaaaacagagtccttttgaaatcactttccggatttcactttcagaaagatagatgccaaaagtggaaggcatgtatatgctcagaatttgatctgccagaataaaaattgattatacctgcctttgatatcattcagttctagttacccaagaaaaagtttcagctgataaagaaacgaaacaaaacaaaatgaaaacctgccctttgatttccatcttcagagatacctcgctcaaacacaggaactaaatgtaaatcacttggtcttaaaagtcagaacatgttcaattcactgattcagcacatggcttttacttaattaaagctggtctgaaaccagctttgtttccttatagctacccaatataagaaatagccaatgagcatgtggacagaaagggcactggccctggagtcaaaagttttagatcttagctcaactctggggactctcaaataaaccaattaaatctcctctgaaattaaagagctggcttttaatctttccatctctaccttaacatgccaggcatgtggtagatgttcaataaatgcttcctggattattactactaatagctaatagttagcaaacccttattaagtatgtacattatattaatcatcacaataaccctatagtgtaaattttcatattatttgcatgtcataacttcagaaactgaggtttagagggattggtcatgtgctcacgtgactcagctggtgggtggcagaaagatgaccgcagggcccaatttcttaatcaatgtgcactgccccctatctgaacttaactggacactggccaaagtaatcatagtgatcaatgaacaaatgttgctcctccatttaatctctgttttattgctcacctttccccaccatctgtctctctgggactgtcgacaattaaaacctagagatccttgctactgagagtgtggtccatggactagcctcgtaggcatcatccaggagcttgttggaaatgcaaaaccttggccacactctggaaacagaatctgcattttaacaaaacatccaagtgagccatatgcatatcagcttccgagacactggtttagactagatccaaagtaaaacacttccttcatgataggaggaaagaatgtccaagaaggaaaatatgacagaagcgttgtgcccagagagaacaaaaccagctggctttggctgtatcaggaccttccttctcctggatagtgacatatggatatttgtaagtcaggacctatgaagatccccagagaactggtgacagaagcaataactgaatctatagggagtgtatctatcattctacttctctctgaaatttccaaacctgtctttagaagcatgtatcatgtagcaaataaaaatacattaagtctttggcaaatacagaatcactcatcaggcaaagtagagctgccctgtggattgataaaactcaacatgtgtatgatattaccaccttccttcacaatccagcagttgcttcttgtcaaggccactttttccttttaaatattaacacaattttttttttagcacatatacaacactaaggctaacaaacgagcttaaactggatttaaatgagtttttttcagtaaggtttatggttttctttttaagcggtatgccttattcaggcagaaggtcctgcatttttggctgagaggtgcaggacagtagctgtcctctcacaagagagttcattttgctcaataactccacctataaaagtcatgcaaataatggaatgaagttatattttgatgatatccagatactgaagatactaattactgaagatactaatttttttccttttcattcaagaaagataattttacacttattctttgaaagagaaattctatggaattttcttcttctaatttaattccagaatacattctctcaaccctatgccctcatactagtaacttgatggttagcgggtaagtaggtagtagtagaagaacagaaagggaaatttggggagcagaaaagggagaaaaagaagaaaagggaaccttctagtttcctaatagaaaagctagagaattccattcctgaaaattaaagatattttacacgtttgtgtatgtacgtggctttgtgtttatacacataccgttttgtttcatgtagcataatcaaatctattgctaattgtttagttaatatttacttattcaaacatctttttaacatcttgcccaatattcaatttacattttacttagcaattagcttgtctggccacttgctgttttacttcttttcttaacaaaaacccaacactgatgttctaacagaacagtcttactgtcctttcggttattgtcatttctcttgcttccccaagggcagaagctctgctattttgcttgcaaaagcaagactgatatttcattgttgctacaaaagggtcaagatagagttatcgaaccctaataactccacctataatagtcatgcaaataatgaaaggaggttttagtagaagccaagaagtatatttgacttttttatttattcccgttttaaaaataaattacatttattttttaaaattacatttttacagatctacacttcctagaactaagagaatgacacagtatacaggtagaaattctttcttttattgagttttatcctttttgtgatttaaaatctagcaggtggtttcttttccttaatgccttcaattacacattcttcacactttctgctatcactttccctgccttcatctagtgataactagaataattagaatggatttcttgctaatcaatcatctaggtattatcttctagaaagtttgcaagacatccctccttcaaccaccgtggttctataaaaagaattgcttttaattctcaacactcttattctgttactgtcatgagacatcctctagtttcagagaatttctataaactgcctaaaataacctaggattttacaatgatggaaaaggaagaaagtgagcatgctcaaagtcagaggatgagagggaagcacagcaaagtctggggcagtgcaatccaaggtgtctggctcaaggcggagtccagaggccactgcaacctggagacacatgttaattaccaagggagcacctggcagggtaactcaccagcctgagtcagcctaggatgggagcttaagggggacctgaggaactccaagagagaatcacatgcatgagttttccacaagggacccaagttcccagcccaaatgagacaagcaatggatcgtattaaaagctagtaacaattgtgctgaagcaacctcttgctggtggcattgttaatggagacaccattctcaggcaaactttagtaggatatttgaagagcaacaaaagcatttatactttttgatcgggtaatcacactgtaaaaatatggggaaagggacatacacagagttgttccttgctaaataaaagagacaaaatttaataagataaatgtatacatcttcatttaagtttaaacacacgtatacatgtataggctggcagttgcctggactagcagctattcttgtgagaaagccctgggaattttggatcagccaacatcacagcagggctacttgggagggagcagagcaagtggtaggaacacactttatagtcaggcaaagaagggtctggatatccccttctacagaccatggcaagtcactcactttctaatacatccagccatccaacagttaaaaggcctttgaaaatgcagagcttcctaaaaaaggagatgcttcatcagcccctgagtttcctagagccagcactctccaggagagcctccttggtctcagaaaacacacgctggcatctacctcaacttcagaattgcacacctgactcttcctcctccagacctaggcaagacctccaccagagcaaaaccagcaaaaagcaaggagaagaaggtggttttaccggggtgtctggtgctgtaactatgcacaagggaggcagactcaacttggatggagaagcctggaaaattcaaactcaggtgtcaagaagcagtgtttcctaggatttacagagtgggaaagtattaagtctagtgctcagagtaggcacgtggtaagtcctgagactcccagataaaatgaccagcacctgggctcattctgtgaagaatgttccagttgggcctataattaatccatttaagatgtggaccagtttttatgaatcacaacaaacccttggtaagatccactttctttcctttagatgcaggccagcctctttgtttcccccgttaacacacattttcttaaattaaccctctatccacacattaagaaaaaatatctatacatactccatgaaaactgcaaaggtctcagattaatacagaaacgtaactttggactctatcttcttatcagcattcatttgaacactggtattaagtttactgtgaactttatcattcaaccatatgtaaaatgttacaatcattttatttacatttctctgagcaaaggtggtgggtatcaaccttgtccaacagacgagcaccttacttacatcaggatattagcagacaccaagtgaaaatgaatgatgcagtaaccaagtgcaagggcttcacagtcttattccccagatgatgctacttttggtctaggagaagccataggctttttggtcatcttcttcagccctcagttaatcaaggtttgtctacacattttatatccaaaaacatctcttatagttgcaaactctctaaaatcagatatagttaaatatccacatgaagtaagatcaagttccctcttccactgtattgagaagctactaagtgtcaggggctgggatggggtttaggaacacaagctaaacagagctctctctcaggggctcacaagccaggggaggacacagtgaattctcaagagtgtgaacagaagtgtagcggggacccagaggaggagctgctcaacatctgggcattggggaaggttgccgctgataaagcaccttggacaggaatcttgaagaccaattaggagctcacgtgagtggaaagcccgttccaggagagaggaaggggtatggtgggtcggactgtgcaatctaaggaacaatatatgcatctctggatgtctgagcaagaaagtgagttaggtgaggataatgataattgttttcagatatctgaaggactagcagattaggcatttggttctccatgtagaagatattactagacttgggagggtaagggggcagctataagagtgtaaatttcagtttaacatgtgtgagaacattctataaaacagaactattaacaagaaaactagttgccttaagtaagcaattttacttcctgattacatagttttggagtcattttggattctaattctaacttagctcatagtaagtgcttatgatacatataaatagtagctattcatattgtgagatggtgaactcactctcacactctgagttccagcaccataccacagcaaattgtcttctatggcaaagtctcatgccccagtgtgagtgtggaccagaaaccatcgaaggtccttcccagcctgggactctcatttggttgtctctgctcatttatgatttggcattattccctcaactcacatggaaagacactgaaagaaaggtttattaaaaacatgctatagaccaggcatggtggctcacacttgtagtcctagctactcgagaggctgaggtaggaggattagcttgagcccaggaggtcaaggctgcggtgaagtttgatgacaccactgcactccagcctgggcaaaagagcaagactctggctctaaaacagagaagaaaagaagagaaagaggaggggaggggaggggaggggaggggaggggaggaggggaggggaggggggaggggaggaggggaagggagcggaggggaggagaggggaggggaggggaggggagagacaagacgaggagaaaaaaggagaaaagaaaagagaacctgctgtatacatgttggctatcattactactgttattatttcctctgatattatctttctattaacacaattattcctgatccctgattttaatgttttattcttgggtgtatgtatgtgtatatgtttaatgttatgcaaatattcttgtaagccaattcaaatccttggtatagcataaagtcataaaaatagaataaaataacattatacagcttattttctttctttcttttttttttttttttttttttgagatagagtcttgctctgtctccatgccgatgaagttgataggtcttcctaggaagcagtaatcagcctaccacctctttctcagacatcattaggtaaatgctgaatggcattagcgtttagtttttaccaacctaggagaaatggaaatataatttcatacatcattactaaaatgggtgatcaaagctcactgtagcgttgaactcctggcctcaagcaatcctcccacctcagcctcccaaatacctgggaccatagtcacatgccaccacgtccagctaattttatttatgtttttagtagagatggagtttctctatgttgcccagagtgatctgaaactcctgggctcaagtgatcctcttgcctagactcccaaagggctgaggttacaggcatgagccactgcgcctggtctacagtttatttttgatgacacataagaatcactaatattcatttaacacttataatgtatggggcattatgataagctttttatatacattatttcatttaattcttacaagaaccctctaaggtaagtacaattattatccccattttataaggcaacgaagttgagtcttagagaagtcatgtaatttgctcaaggtcacaactaataagcaatgatctaacccagtaattttgcaacatggcctacaacacactcacattaatgagtatgtacttttctttaactttgaaaagttaaagagttagacactccagaggccaaaaacaagtcatttaatccaataaaacagttggcagcactgacagagttcatttggtcttaatctcacactcaggacactgttgggaagatggggcctgcagagtaaccaggtcatgtttgtctacacggtctttgaaaatcaaatcaaaattttcaggattctcacatattgcatgattccattcatatgagatgttcaaaatgggcaaatcaagaaagaaagaaagagaaagaaagaaagaaagaaagaaagaaagaaagaaagaaagaaagaaagaaagaaagaaagaaagaaaggaaggaaggaaggaaggaaagaaagaaaggaaagaaaggaaagaaagaaagaaagaaagaaagaaagaaagaaagaaagaaagaaagaaagaaagaaagaaagaaagaaagagaaaaagaaaaagaaaaagaaagaaagctgcctagagctaggggaggaaaagagagaggtagggaggatgggtacaaagtctccttttggagtgatgaaaatgtttaaaaaatggactatagttatggtcacacaactctgtagatattcaaaaaaccaatgaattgtatactttaaagggcttaacttgatgatctgtaaattatacaatatcaataaagctgttaaaaaacgatttccagagctcagtatcaagtgttctctagtcactccatgaggctgccgtcttccagaacaaacatagtaaccagatgtgtgtaaagtaagcttgtacccaagaacaaaatgttccaacaacaatgatgagagtaatgagcatgctggtgaagttggtaggtcttcctaggaagcagttatcagcctaccgcctctttttcaaacatcattaggtaagttctgaatggtgttagctttgagtttttaccaacctaggagaaatggaaataaaatttcattcatcattactaaagtgtgtgaaaacgagcagaatattataaagagcagcagagggggaatcaaaggaccccaaaagcttccattcgaatctactacgaccttgtagacttgaggactcaatcattttgggcttcagtgacttgatctgtaaaatgaggaaggggaagtatgaagtcagctactctaaggttttcttctgtcttcagcattccagtcaaatcgtcccttctaaggattgtcttggtatgctgacttgtccctttcatcacatcatcaactgcgtttagaccaaagaattgttatccagacatctggacatattgaaaatctctcaaagaatctttcctggactgatgtttcaggtatttacatgaacttcctccgtatcctttattaaatacactatctaccttatagtttaattagctataaaaacctaactgaaattttaagcttgacacagaaaagtcaaaaaggtgtttcctaacatgatgtataagggcagcaatataattgttctccaaagtaaaatgattctgtcctttataaaaattcattttacctcaactctaacctgtcacttctaatcaattttaatttttattataaaaatgataaattctcatctaagaaaaccttaaatatatacaaatttgaggaaattaaaatcagttttagagccaataccttaaatagattaagagtaatgttagtctactatttctactattatatgttggtatagtctcacttttttctccatgaatagtttttcccttttttaaaatgaatataaagtaatcatgtttaaaataccaatatgtagaaaagtataagaagaaaatataaatcatcagaaatcccaccttcaaaataacccctaaatccctattaacttaaggtgatcatccgttctattgtctctgtaagcataacacacacatagagaggtatattttaaacacattcagatgtgtgatggagagatagtttaatatccattatttttacttaaatatctatcatcaccatttcctcctattacaattttccataaataaaattgtgatggtccgtcatgcaattttcttctgctactttatgtttttattatttgcaacttttcatggtaataaataatgcttcaattaacatttttatacttaaagcgtctacactcctacctagaaaatttaaatctattgactttttccttttgtgatttcctctattgattttgggaagagaaagtgcttacccattcaaagatcagaatttttattttttcgtttcttttctttcttttaagttagctccttaatctgtctgggttatcttgttctatattgttaaaggttctaaacttatttgtaacacgtttaaattttagccaaattgggtagaagttatttgcccaatatttttcaaatgcacatttatgtcttttaaaaaaatatatgtctcataatcttggttatccactaaacttaaggaaaccttcaagactgccaaataaccagagctttgattactagcaggaagtcatactgggcagaaataaagaggacactcctactggccaaattaaaactaaacaatcagaaaagtccaagttcctagctttagtggctttattattttagccttaaaaagtctctaaaatcccaaaagtagcttaagtgtttaaaagacagtattcaatgcagtgggctattctccatacggcctggccactactggtctcatttacgggccatgggcaacctctatatcctgccattggtcaccaggttcttgccactggtcacgagcagagtaggtgagaaagtggagcacaagcttaccaacccaagtagagaaaggacaccaatggcttgccttgctggttgacagtaagtcaacagagcatcttctaaatgaagagcagcacagatgtcagtatctacatggttgtttctcaataataagtactgggttatattggacataatacaatccaaaatgtattaggttgtatttttttcttatatttttctaatattggattctattttcagttcttccccctccacagcaccttctgatgcacaacactgtcatagctgcctactagttgctctgacttaggtcaatctaactttcttgaatagtttcctcaactgtaaaatggagataataaagaaaatcaacaacttaaggttgttgtgaggattaaggaaaaggcttagaacaggccgggcatgtttacaaggctcatgcctataatcccagcattttgtttacatggctcatgcctgtaatcccagcattttgggaagccaaggtgggaggctgacttaagaccaagagtttgaggttgcagtgagcagtgatcgtgccactgcactccagcctgggcaacagagtgagactctgcctcaaaaaaaaagagaggggggctggggcttagaacagtgactgcacttaggaaatgacttttatgtgttcattattattattattattattattattaccactattctaccacttctgctatgactattactactaactggggtagtactactaccccagaaatgctgggtcaaacttaaattgggttcttcagaatgaaacaggcaactggggagctctgtggtcagatcagctccaggagtatactctatcctcaacttttgcaatccctctgggaagttaagtatttactgacattactaaaatagtgaatttccagggtggatggcatcacaatctcccacattttctggtacgtaaccataagacctatgtgcacacaagcacctggttcttgaggggggcaagaaccaggaggttaggcatggaaaaggcagatgtggcacagttcattttagtcaatacatgaagctgacaaggctataaactgcagatgaaaagcctgcacctcccaaaccgtacgctgcaaagatcaagactatgtgtgatcacacaggaacaaggagtgatctgggctgtgaagaacggaactggtccatcaggtgaaaatctaccaaggttcgacggtcagaaaattcatctctaataccactactactcctagttcttcaattctttcctcagagtcctgatcttctactgccatgcaacttcctcaacgtttggggcgtagccaattcaagttaaaaaagtttgcctaagaatttctctccagctttgaaactcagattcattttataagaaaattggcatcacgcccttctgggtcacagcgaggtccataaaccatctgagatgtgtgagacatctaagtcactttgactatcaacaagaaagcatgttggataaaaattaattagcacaaaactcaacttaaaattagatggtatgttatgagacaaatgctcatctcttattagccaaaagacccagatataacaaaattaagccagtccagcagaatgagagcaagaatgcaatgtgtgttccaaacctagaatcaggaataatctaaggtttgcttagacactttaccccaaatttacagattttgaactctctactgtacagtccttttttttctcccacgtttggaggaaacattttaacgtgtatattctctgggaaaaccctaaaatctggtttttagggagtttccctcttatctaatcctttgccacattatttttgtttcgaatctgtggtctttgctttgttaccatctctagatgaaaagctatgaagcacttgggaacacagaaactgagatccacaagatacaaatgagtttcatgtaagcttttaaagacctttatctgtacccatcaagcacaaacaagtaatcaacgactaaaatgtcttaatatttctctctaaaatcatcaggcagctacaatcaggtggacaagtcgttccttaaaatttaatatcatttaataattaataattgcacaatagcatatatgcgtagtaatagcatatatatggcatgtatataaaacatagcaaagtcatagcaatctttgcacttttgggaaagctaaaatgatgtaataaacttactgttaaagaaaatatctacagaggcaggggcaataacacagctgtacaattgtgccttagggggtataaaatacagtccactttgtaatcccgaaatggcatgcagccataacattgtaacttcaacttagcactgatggggaaagggatccttaaagtttagcatatcacctcagagatcttttttaagtacctatttctgtctcccttccccctcaattttttttaagcagagaagaacatgaaagaacagaccctttctaatacactgtatttcgcagtggggaaaaaaggagaataaaatggcaataacagaagcatattagcatatttaaaacactagtacattaccctgaactaaagcatccttaaagtaacatgaaagcaagagaaactatatttcataaagtgttgcaaactttaaaacaccaaattgaactactcctatagaacaatttcatgccagattgctttggtggcaaattaataaaggcagaattgctctttagatctttaaattaacgagattaaggaagacaatgtctttctctgtgcttaattatattgacttaatttcttaattactattaactatacttttatgttttacaagtcacactccatttttacagctgttctttaatcctcgggtaatctcgtattctgaagaatcacttgagaataaaaacagcaaaactgaagacaaaattcaattgggcttaatccacctgtacattctgcctgaatcaattcttatgccagtattttgaggcattccagaaaagtgccagacttttcaaagagaaaaattaaaatgatattctggttcactgaaactccaaggagtaggcctgaagaaaaaccgtgcatcagacaagcacgcaccagtggggtgagggaggacaaccccaactggggcccaacactccactacttaacgtttcaaaaaataaaatcaactgtgtataaaatcatatttatacctagaaggtctagtgcgacgacacaaagaaagcaattataagaaaggaactaggctaggcaaggtggctcacgcctgtaatcccagcactttgggaggacaaggcaggcaaatcgcttgagccctggggttggagaccagcctgggcaacatggcaaaacctggtctctataaaaaagtataaaaaaaaaaattagctgggtgcggtggcatgcacctgtaatcccagctattcaggaggttgaggtgggaggatcgcttgagcccaagaggttgagactacagtgagccatgatcattcaactgcactccagccttggtgacagagcaaaaccctatctcaaaaaaaaaaaaaaaaaaaaaaagggggcgggggcagggctgatatttactaacaagacctctggactgcaaatccaacacagatactaatatgtcatttccacttggcttccagttgtatttaatatggtcaaaaaatgcatatattataaggagaaacataaccccctaaacctctgcaggataaacgaactcacattattttctaaaagaacgcagcaacccagtctgtcctatcatcacaccgtgagctcagaaagaaaatctgacacacgcagcagaaagtgcaaaatgttatttactaacctggtgcccctgtgaaagcagttgctccatatcaccttaaagaaagaatccttactatgaaaccaatctccaaggcagctgatagccaagaggtggcaaaatcgactaccctgagaatccaaataaacgggcaaagccttcctgttcccaagcccagttttggctgactccctcaaggcaacttaagtcatagccaagcccacaaagcactttagcctataagctttagtaatgaacttgaaaccactccccatatgttaaagagacaccggactgctgtgagaaataaaacccacatacagaatgagctacagcttcaggctgcacttttgtacttgctgcccaagaaaaccataacacaaacttaaacaaagagaactctcactcccttctctcccctcagacactgcaataaagtgaatgattaattttaagcaaggggatacagtctgccctccattagggccatgaaatgacttttatattgttcaagttgtgtggcagttatggaacagatagcactgtaatttcacattgcataagagggacatatgaagttatcatttctgagaatcaaatgtagatagtattactattttcagataacattgaataagcttaaaaacctcatcaaatccaacgattaacataagttcaataggaaattttgtcaaagaaccttctaacttctgattctgacttagtgtctataaatcttaaaaacattcttataattcagtttcaccacctacatttagaatggatgtataagctaagacacgtcttttaacatggatctttaagctgccttttaaaatggaacttaataccactcactaagatttcaaaataagaaatttatgtttcattctagaaaaatgtagtcaatcaattccttaaagcagttagatcttaaaacagagtcagtaatgttctagcatattgttagaacatcagctttttaacacaatgtgttcacagtatacttattttcccctagttttcaactccaagaacagttttaattctaatggcttgttgccatgatttgtattttgtttaaatgagacttatttcaacacaataaccaaggtttttgaactttaattattgtttctcctaaaccataagattggaccaaatatgcaggcaaagcttgattcacctgttgccaaactgatttacatgaattactggtaaaattcaagttactcaaaacctgtgaaatataagccattagctcaacaaattcacccatgaaaatcctggagactattttagatctaatacacaccttgcccacccctctacccactcccaggtcagggctcaagaggatctcatggggtcaccatagaatgagggggcaagataatttcttttctcagggaaaaaagaaaacgagcctcaagacctgtggctgatgactttaaaaggagctagtaccccacctgctggcaaaaccaagcgaaagctggatgagctgaacaaacctcaggggaaatgttattactttgatgttggaagaaaaacagagaaggagcagctatgcgagcacattaatgtcacattcagtatgtcgttaaatattattaaatttttccccacaatagtgatatatttctagaggatataaaaatgctcatgcaaaaaaagtagattcaaaaccatctattttacatggatctggtttgcaaacatatatgatgatttgcatgcccaaggaaatcctctgataaataatattgatctctcctctgcagaaagagcttcaaaaaatactcctgggagaccaacacaatctttgaaatggaagaaatatgaataaatccccaactcagctagataaactactggtggggctgtgtctccatcagtctgtatgtctgtattcccagaatttctcttatctttcagcaaaaatttatttccttttgccacatataaattaattcttctaaaatgaatatctgatattaaccttaatgaagatgaagaaaagttaagtggtgggcaccaaattacactacattctttaataaaaccccgcaataataagagtatagcaggatatgacttttaaatgagcccaagctgtactactaaaactaaaatgaggccaggtgcagtggctcatgcctgtaagcccagcacgttgggaggccgaggcgggtggatcacgagtcaggagctccagatcagcctgaccaacatggtgaaaccccatctaaaccccgtctctactaaaaatacaaaaattagccgggcgtggagtagtgcacctataatcccagctactcaggaggctgaggcaggagaatcgcttgaacccgggaggcggaggttgcagtgagccgacttcgtgccattgcactccagcctgggcaacagagcgagactccgtctcaaaaaacaaaacaaaacaaacaaactaactaaaatgaataaggatagctattatataagctcttccgatgagccaagcttggttctaaagtgctttataagtaccaactcatttaaacattaccactctattattataccagtttgtttgtttgtttgtttgtttgagacggagtctcgctctgtcacccaggcgggactgcagtggcgctgtctcggctcactgcaacctccgcctcctgggttcacgccattcttctgcctcagcctcccgagtagctgggactacaggcgcccgccaccgcacccagctaattttttgtacttttagtagagacggggtttcaccgtgttagccaggatggtctcgatctcctgacctcatgatccgcccgcctcggcctcccaaagtgctgggattacaggcgtgagccaccgcgcccggctattataccagttttacagatgataaaactgaggcgtccaaaggctagtaagtacactgccaagatcacacagttagagacagagctgggattagaacccaggtcggtgctcctagccatgtactttaaaaactctttcttcctgagtgcgtaccacttaaaccctgccaggccctggtcaaatgcaagggcgggggagacagtggataaggcctgcactgtgaacagtcctcataaaggctttccagagaagtggccacagaactgagacctggaggtgacatggaagggaaagggtccccagggagagggcactcactcagtctgccaaggcaaagggtaaacggggtgggggacattggagggactgcctgcagggaccttagtaaggctgagggaccagcagaagaaaatgctgtgaggaaggcagagtcctcttatgtcacatcatggagcaaagaggcatcaccaacggatgctaaaccggaaagtgtccagatatgcatgttgaaaaggtaagtaggaggaatgaggcctttttgggtgagtaggaatttagacattccaggtaaaggcaagcacaggccagtgctgtaagacatacaagtttatactttcataaactgtatcaaggaggcttgtgccgtaaaccccgcagcagcatgcgcactggctcccttgtcaagccagctcggggctggagccacgtggtggttactaatgccattcacagagttagggacaaggaggaagggcagggtggtgggaggagggtggggagatgctcaagccaaggagttcactgagggaggctgggtttgaggtcctctgagctgttcagggaggatatccagcaggccccaggagatgcaggccaggtgctacagtcctttgcctagacagcagaggtgcacatttaggagtcactgacactgaaggagcagctgcagctgggggacagtgggacacagagtttgtccctggaaaatgtacagcatgagaagaaagagtgaaatttaaggcaaggctaagggtgtcagacagaattcaggctgttgataaaaaattttatttttatttttactaacttctaactaaaattatcatttccttctgtaacttgtcatcaaagatattttctttgacgtcaaagatattttcttagacatcaaggatttttcatatcacattagttattgcaatatctcaaagtatcatttccactcatcactatttcaaaattacagtagttattagacctgccactagatactggtaagtaatgcattttaataaaggacatgtattacaatatgacatatttacttctttgcatattgataactttatgtcagtataattggtttcctttgtaatcctatgcattttaattttatgtgtttaattttacagaataaatattctgtagagtggttcattagcttaattagaatgtcaaagaggtccccatggcacaagtaaaagtaaagaacatctgatttaaagagggaaagagcccagcgcagtggctcacgtctgtgatcccagcactttgggaggctgagaggggcggatcacctgaggtcaggggttcaagaccagcctggccgacatggtgaaaccccgtctctactaaaaatacaaaaattagccgggcgtggtggcacacatctgtaatcccagctattcaggaggctgaggcaggacaattgcttgaacccaggaggcagaggttgcagtgagcagagactatgccactgcactccagcctggatgacagagggacactctgtctcaaaataagtaaacaaaaaaaattaattaattaattaaaataaaaggggaaagaaaaagccacaggaaaacacttaaaaatagctctgcgaaaagggggaccctagtatgagatggagacagctttcaaagctaggatgcaaacgcaggacttctgactttgtgttctttctaccacgtgactccacaccctaaaataataaaaacagtaaccccttcatttgcgtaaacaaagggctttcacatgtattagcctgttagttcatcacatctattcagagtaggaaaaggcaggaacccaaacgtgccttgaagctgccatctaagaagacactccttcctgggcctcagcactgcgccagtgctgcagcggacggtggtacctgtcaccccactctatggagctgtagtcatgggcacagaagagtaagatgaagagcccctccctcataccacactagctagaacctgatcgcaagaggtgggcacagtgggtgcccacccaaatgatgagttgcacttctctccaggcttctatttacaggtaaggctaagaatttgtttccttgctcaaagctcttttatttagttctgattggtgatccagagtgaattacaagatttgcaatatttcagctctttaatttgccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgactttggccccttctcatataatacatgacttccttttacacaataatgagaatgtgggtttatatgactaatctgacacaatacagtaacttctgcttaaaaaaaaaagctgaacatttcttaatatgcagttacaatgtaaattactatgttcatggatggatctttaatttccaagtttctctattattttctttcttttttaaataaggagccagagtgaaaattgtcacttgccttgtaatcagtcacctaaaaactagagtgaaaattgttgtgtgtgaaaagagttcaaaattggtttctatgtcccaggaaccggagagctggtcttcctactgctgtctgtctcaggacacagcacacccatccgctgtaggaaaggcagaggtttcgcttagagctgcttgcgtgtaagggaagagggaactcaacctggcaggaacaagcccttgatgatttaccttctttcctaattgcccagaggcatttccttccttgcttacccaatctaaggaagggtttcctactgccctagcagttcctttaacctgaagccattttctctagttcctaccctgttttttgtgttgctctcaatctgctttctcacaagacctcactttccagccaaattggtttattctgtttttcaaattacctagttcttccttccttttgagtttgtgccactgtcccaactgtggcaatgcccttccccctcctcgacagtaaaggagtcaaatcctccccagcatttcaaggggcggcccaaacccatgtcctctacaaagcattttcaggtcaccctgctttaaaaaaaaacaaaattgctcaacaactacagcaatcatcatcagcagccgcaaatccattaggcaacaaattatgccttgcgactttctattttatctggatgggttatttaaatagtgatggcatttaacttttcatgcatttataactacttcctccaacttagtaatcagtaactacatattacaagttatacctctgaaatcaaccattgtaaaaagcatatagcaaaaattctaccttacattgcattcatatatgtatttgttgcttacaagatatttaaattatttatgttacttaatgataattacaaaataatagccaacactattgccataatatcttactagactcaatatcttatttgacattcacatctgccatatgaattagatacaattattttcctcatttttcaggtgatgaaaatggggccagaaagcttaaatttcccaaggtcaggcattcaacacgtacttagtgagcacctactatgcgacaggcattgttttcagcattagtgatgaaagcagaaaacttctatcttcagggagtttatattctattagggaagacagactatcaaaaattaaaacaaatatatataaagccagataatactaagtgttgttaagaaaactaaagcagagtaagggactggagagagatggcatctggagagagatggcataagtggcgaggtagcacactccttagataagatggtcagaagaggcctctctggggagatgacacttgagcagagacctgaacgaagtgaggtgacaggctctgtaatcatctgggaaaagggcccaggcagaagaaacggaaactgcaaaggcccagaggccaatacaaacttggcgtgttcaagaacaacaaaaaggccagtgtagtcagtgctgtgaaagaaagggcaacagtagagggtgtagtgagagaagaaactagggagtccagttatgtatggctttgtaaaccattgcatagtttcatttacgtttttccttaaatataatgaaaaggccctgaaaggttttaatcaagaaagtgaaacactgtgccatttgaaaagattacacaagttgggtaggtaaagaaaagactaaaaggggctgggcatggtgctgtaatcccagcactttgggaggccgaggtgggtggatcacttgaggtcaggagttcaagaccagcctggccaacatggtgaaacccccttctctacttaaaatacaaaacttagctgggtatggtggcgggcgcctgtaatcccagctactcaggaggctgaggcaggagaatcgcttgaacccaggaggcagaagttgcagtgagccgagatcgtgctgagatcgtgccactgcactccagcctgggggacagggcaagactctgtctcaatgaaaaataaaaataaaaaaagaatagactgagagaaggcagactacttaggagaatattgcagtagtccaggtgggagatgaagagaagtagtcagatctaggatctactgtgaagatagggccaagaagattatctgatgtgggtcgtgatgcagagtgtaaaaaaaagagaggtgtcaaggaagactctaagactcatatgagtaacagggagaaaagtctaattattcagctgaggaacattgtaggtgatggggtctggggagaagcagtaagtttttggggcaaatcagcagtgccattttgggtaggttaagtttgagagaccttttagatatccaaacgaagagaagtaggacgttggatacctaagtttgaggcttggatacataagtccaagattcagtcctggggtttggatatgtaagtctgagattcaggcctggggtttggatatgtaagtctgagattcaggcctggggtttggatacataagtctgagattaggactggagtttggatacataagtctaacattcaggactggggtttggatatgtaagtctggagattcaggactggaatttgtatacataagtctgagattcaggactgagatttggatacataagtctgagattaggactggagtttggatacataagtctaacattcaggactggggtttgtatacgtaagtctgagattcaggactggggtttggagacgtaagtctgagattcaggactggggttaggatatgtaagtctgagattcaggcctggggttaggatatgtaagtctgagattcaggacgggggtttatatacataagtctgagattcaggactggggtttatatacataagtctgagattcaggactggggtttatatacataagtctgagattcaggaatggggtttggatatgtaagtctgagattcaggactggggtttagatattaatctgaggactggggcttgcatacataagtctgagattcagaactggggtttggatatataagtctgagattcaggaatggggtttggatatgtaagtctgaggactgggatttggatccataagtctaacattcaggactgggatttggatacttaagtctgagattcaggactggggtttggatacataagtctgagattcaggacttggaattcaggtggctttaaacgtggtagttagctttaagcaacatattttcaccacagactgactgagggtgaataaaggagggatgtctgaggactgacactcaggactctccaacatttaaataccaggaagaagagatgggtccagtaaagggggccaaaaaaaaaaatgccagtggggtagtaggaaacccaggagagtgtggtgagaaagacagaagccaggtgaaaagagtgcgtcaatgatagagagatcaattatgtcaaaggagctgagagatgaagaaagaggaagattgagaactgaccactggatacagaaacatggaggtcactgatgtcctaaagagtgggctcaagagaaatttatgcaaaagcctaaaaagtgggctcaaatgagaatgtgactacagggcattgctgagagaaattaaagacctaaataagtggatataccgtgttcacggattaaaagaccaaatattgttaaattttctgttctccacaaactgatctatagatccaacacaataccaattataaactcatcaagcttttttgtacaaattaataatctcattcttaaatgtgtatagaaattcaaaggatttagaatatccagagcaaccataaaaaaaataaaactaaagttggaggacttaacactacctgacttcaagacatcgtagtaagtctatagtaaccaggacagtgtggtactagtacaggatcaacaaatagatcaatacaacaggatagagagctcagaaatagatgcacacttacatggtcactcgattttcatgaaggtaagagaaaaatccaatagagaaaaaaaatgacttattaacaaatgatggtaaaaaaaaaaaactaaatatctatatagcaaaaataaataaatctcaaccatgacctcacaccacactcaaaaattgagatggatcatagacataaatgtaaaaactaaaattataaagcttttagatatggcttagaaagcaatcaacataaaaagaaaaaaaaacagacttagccaaagttcaaaatttctgttcatctaaagtcatcattgaaaaaataaataagaaagccacagcctgggataaaatatgtgcaaatcatatatctgacaaagaactaatattttataatacataatgaatgcctacaattcgataaaagtgagcaaaagatttgactggacatccacaaaggaagacagactcgtgatcactaagcatatgaaaaagtgctccatgttaatattcaccagggaaatttaagaaaaacgcaatgaggtactgctacatccccaccagaacgagtaaacattaaaaagaccgtcaaacccaaatgctggcaaggatacagagacagcacaactctcattcaccatgggtcacagtgtaaaactacaaccagcttagaaaaaagtctagccgttgtttataaaactaaatatgcacctatcctatgacccagttatttcattccaaagtatttatccaagagaaaagaaaacacagccacaaaaaaagactccattcaccatagtcaaaatctggaagcaactcaggcatccacccgtagaaaaatgaataaacaacctgttgtatcatcaaacaatggaatgatactcagcagctcagaaaggaatggattcactcagaaaggaatgaatgactgatacacatgatatgaatacatctcagaaacattacgctgagtgaaagaagccttacataaaagagtacatacattgtatgattcaattttgttaatcttctagaaaggcaaaaataacatattgtgggaaaaaaatcaaaacagtggttgcctctggcagagcataagagggtggtctggggactaactgggaagcaacatgagggaactttctgtggcgatggtcatgttctgtaccttgaaaagggtttggattgcagaggtggtacatgcatttttcagaactctgaatggtacactaaagatttgagcatttcagtgtatataaattttacttcaaaagagaactataaacaaatagggaaggaaattaatcatatgtaccctgaaatgtttaggagtgagtgtactgatgcctgcaacttactttaaaatgtatccaaaacataaattgaattgatgaaaggataaagggatagatgggtgacaagacgtatgttcaagcaataaagcaaactattgattgtagaatctaggtggtggcttatgggtgttcaccttaacattctttcaactttcctgcatgtttgaaatgtttacaagatgttgttagaagagaatgtggggtaaggaattggagacagtgagaactgacaacttatcagagttttgctttaaagaggaacaaagatatgaggcaaatctggagggagatgaagaattaagaggaggtatttgtaaagaaggaagacattatggaatgtttgaataagaatgatcctgtaaaaagaggaactttaatgaagctagtgggcagaaactatggaagcagagttctgaacaggcaagagcaacagatggggtccactggggtgcaatggatgtcaaccaggaggatgcacgtttgtccatggtaaagagcaggggatgggggacagatgatggatggatgcaagagaatatgggagctgggaaactgcttctagtttcccagtgatataagcagtaagatccatggctgaaagagagagtctgggaagggatgttaggggtttgaggaaagaaacaaaggtgtgaaatagtcacctgggagagtgagtttactagggaagtagggttgccagagagggctgagtatcagtggaggcaggggtggagggtggcgtgattaatttaatgtcatcagagtgttgtgtgtgtgttttccaggaatgctccgtggtttggaagaaagtgtagagttatgcctgagtaactgtgattttaaccagggttgtgttttgcaggagactaggatagaaagaggagagaggcaagtagagtaaccacaacagtggaccaagcagataaggtgagtaaagtggaaagttagactacacagggcattaatggaaagtaaaaaggtggcagagtcaaaggagtggacgtaaaagtgttgatctgaggatattacaagacagagcataaaagttggcagatggtagagctgggatttaaatctaaatgtttgactcctgttttttttattttattttattgattgagatagggtttgtttgtttgtttgcctgtttatttgtttgtttattgagacagggtcttgctctgtcaccaaggctggagtacagtagtacaatcacggttcactacaacctctgcctctcaggctctagtgattttcccacctcatcctcccgagtagctgggactacaggcacgcaccatcacactcgactaatttttgtagtgatgtttttgtagagatgcagtctccctatgttgcccaggctggtttcaaattcctggctcaagtgatctgcctgccttaggctaccaaagtgctgggattacaggtgtgagccactgcgcccagcccaccctcttaactgtaacactctccagcattttcaggactcttgtcttatactctctgtgtctggatagtatgtgtacccatttggtcttttcaagacccaggggtattatttgacttcatattcttaaaaataacttctacggaagtgattttctttcatagaatgggaaatataagacacataaagagctggtgtaatttttgaacccttcaacaaattggctatcagagaaaaatgtatcctcctgtctcagctcaactctttgtgtcttatagttctcactcctaaaaagcacatgttgctgcttggaacaaaacaaataccacatttggaggatttgaagaaactagtctcaaagtaattatttcaagagaatttattttaaaaacatgtaagcactaagtcacctcattctcagaaggaaaaaaaaaaaaaagacagtagcacgtgttcaggcattcagaattttagagggaccgctaattgtgtatttaagaaaccatttgaataacatttaagtacccaggaaaaaaagtccagattccctagcctgaccttccactattaaagtccagtctcttatcattcccctgcacacatgccatgtcccaggcaaatgaattagccccattcttcccaaagaatgtctcatctctgagcttttcctcttgctgttccctcccctggatcaccaccactgcaacctgcccaatctttccatagacatcctatttttcttcaagctccagctcaaacacaggctccaagccagacagtgaccacactcctctagaaccaccaaagctttttacctgccacacataaggcatctatcactttgtatctggtatcatagctacctatagatagcaaatatctatagaaactccccccttagagagaatcatctaatatttgaatctggatctccatatttaccattgtagtggacacctcacacagtgcctggcatattatagtcaattaacagctaataacatacaaatacatattttagacggaatcataaggaaaagttaaatacagtgttaggtgcacctattttaagctcggcattctgtctctgaagtacagacagagtactacaggaatactacagtaagtcctgtacagatccagattttattgttgtgggatactgccaaagtatcctttgaaatgtttactccaatttaaatgcttgtcataaggttggaagagagcctagatctcaacaatttatgtttatgtcttacctctattctgttctctattccgaccgaatacggtatgagttacaaaagtgagccacatatataattttaaattttctagtagccacatcaaaagtacaatgaaataggtgaaaataatttaatgagtttatttaacctaatttaccaaaatactgtgtcatgtcaaaatgtgatccacacaaaaattattaatgagatattttacatttcttgtgtactaggaaatccagtgtctatttttttttttttttttagatggagtcttgctccgatgcccaggctggagtgcactggcatgatctcagctcatggcaatctccgactccctggttcaagcgattctcctccctcagcctcccgagtagctcgcattacaggcacgtgccaccacggcaagctaatttttgtatttttagtagagacggggtttcaccatgttgttcaagctggtcttgaactcctgacctcatgatctgcccgccttggcctcccaaagtgctgggattataggcgtgagccaccacgcccagcctccagtgtctattttacacttagagcacatttcaacttggactggccacatttcaattctcaaataaccacgtgtggctaggggacaatatactggacagtacaggtctagaacatccctgtgggcagaggctgcttctttcagccctgtactctctacagtgatttacccattcaatgggattaaatgcaacaagcatgtaaaaaccaaagtgttaaagcactaaacagtgcttaccacacaggaggggttcaataactgccagcttcctttccttcacatgcagtaggccctcaataaatgtttcttgggttgactttccaaactggaaacagtattataggattaaggccatcaggctccctttattctgctcagcagaataaagcaatcttgtcaccttaatgtaggttcgtggcacattttcctggcagaagaataattacccaccaataaacttttccaactatttggaaatagcaatttctcagaataaataaactattatcctgctcttcatcaatcccagtgaatctgattttaagcaaacctgtaggattcatttatccctggctgaactaataaaagtgaatttctgagtccaggaagataaagaaaagatccagtaagattgtctttctaaaccaaggagcagccaccctcaagtccatctggaaatggctggtaagactgattctgcattatagaatcctgtctgcccagagtcagagagaaatgcagcaatcgagctgtctaagcagatacttggatatccaaagtattagaattattctaatctcaaagaattagacagaataaagaattaggagcactagaatatttttatcataattgaatactgtttgaggactcaaacagcatttcagaatttcttttgctcaaagcaacattactgttcgggatggcaccataaaatttgtaatttaaacttccatgtcagttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaatattcatggtatggtgtggtatgtgtatgtgtgttgggggcatggtacaaacaaggaaggttgatacaagttaaagaacagccaccttctatggagcagcaagcatattatcactgaattctcatttaggaaaagaaaatattttttccctggtaatttaatgaaatttagatattattagaaccaacttggttttttttaagaaaaaaaaaactagaaaaatattttgtaagaaaaaaaaaattgtatgattgtcagcctcaagaaaaaaattcagccgggtgcagcagtggctcatgcctatactcccagcactttgggaggctgaggctggtggatcacctgggatcaggagtttgagaccagcctggccaacatggtgaaaccccatttctactaaaaatacaaaaattagctgggcatggtggtacacgcctgtaatcccagctgctccagagaatcacttgagcccgggaggttgaggttgctgtgagctgagatcgcgtcattgcactccagccttgtgacaagagcaaaaatccatctcaaaaaaaaaaaaataataataaattaacttttgtgtttgtgagtgcatctgcacttctttttttttttttttttttttgtaaagactgaaaggagtatttctgggctggtaaactgatgagatgaatgacagagtgagaaacaggcttatcagtttaccaactgctgaaaaaaccaagccaggttcacaaggtaacaacaatacagaggtgatagaaataaatttttccttaatgcatgggattcctggattactcgtatacctgcattcattcagttagtgcttcaataaaccaagcagtttgcctctggttttctaatatcccgtctctctattagcttcccaaataaaaactcaagccaagagacaatataacaacaaataaaacaaggtaacaaacttttattacacatttgttgaattgtttaaaaacttttcatgtttcctgaacactcatccaggaaagtactgtcaagatgatgacgaaactcagtttattcctggacaaaagagctttgacacatctgcttgtggttatctacgttcataaaaacacatcactgtcatcaaaggcttaagacaaagaaaagcatttattaagttctgtctatatatagtacttcaactgccaactctggtaatttgtttgagcttagattctctgcgtcatgagaggagttggtttgcatctgttaatgagactgtttttttgaactgtattcctttactccaatatgtattgcataactaccctgtgctatgcactctgctaggcactgagaattcgaggatgaataaaacagacattgtcctcaaaaagctggcaaactcatggaggaggcagtctacatggcccagccaaaagtctactgtgcacaaacaaagctgtgcaaacacagaggggaacagaagtaattcagcatgctaagaaaatggtggtcagggccaactcaccaatgcacaggatttttctatctacaggcagacaagggaggaagggcatcctattcaaagagctccaaaggagaaaagcacatggcacgttctggaaccaaaaagccctgcagagggcgtgggacagagatggatgtatgtacattgcaaggctggaaataaagttgaaaaaaatgcatggcagccacatacagaagggtcttgaatgacactctaaggcgtttcagatccactcttgggtgatgggaagttcatggagggatttaagctgtagaataatgtaatctaatttatgcttcagaaagatggctctgtaaaactaggtacacgaagtcagcagtattcctcagataagagcccctttgggcagtggccagagtgggaatatctgtatacaaaagacaaaaaaaaggtacaaatgagaaaaaaatatttgtgctattgaaaacttggacatctttccattcattttaaaagcaaattttaagtgctactaactttgatgagttcacaatggctgatgaccctcaaattcttcacttactcttcactgtctatgacagaggagaataaagcagaaaacaaaacaaaacaaaatgcattaataccagttcctgattttagccgataatggtagcatcactcacttgctgccagatatcagaatgaagaaatactaactgctgtttttacctatgtctctctcttcatgactactaaataatagtatgtgatgtggctgggctgaaccacattgcccagaattccccttcttgtaggcttccacgtagggtcaaaggatattctctcctaagaggtggggaaaagaaaggagacagcaacattttgcagcatgcatgtacacacatgcctttacctagttattcaatcaagtactaatctactgctgctgtgaagggattttgcagatgtaaggtatgtaatcagttgattttagttagtcaaaagggagattatcctgagtagaactgaggtaatcagctgaaagtcctttaaaagagggcttaggccctccctggattcagagactccaagcttcagctccactcacagggatccagcctgctcatggtctacctgcctgactggttgccctgtggatttcaagcttgtttagccagtcccacaattgaggaagccaattccttgtaataaatcccttaatgcatgtaacctactaagtctgcatctctggtaaaccctgactgattcatgatgttacggttattactgttgtgaggacacagaggaagacctcttggcgtggaatcacccagaaagacactaaagaatctcactcttgtactagctctctcccaatctcttgcaataatggccaggagaagagaagattgtgagttaatttttcaaaaaatgagatttatgataatttagagatgcacagtgaggtgtggctatgttactaagctctggccaatgagatgtaattgggagtactggaattatgagacagggcctgcaaaggaagctggcatgctcctcttcctctattctctgtctgtaatgtaaatatgatgttgagagccccagcagccatctcagacaagggccacatcctggaggtggcagattggagagctctagagactgatgacttctagagccgtcatgccagctcccaacggactacttctggactgtttatacatgagaaataaagccactacctgggggctctgatacttgtagtgaaacacaattcctaactgatataagaattgttttctttagtcttcctattcccttagcagtagacttttacatctaagttgctacgttatcaggaatagctgtatttaatttcactgctatgtacataggacacattaagtgtttaagaggattagaggagacagccacagtaaaagctttttcgtatttctccatgtttctgtgttttggcaaaagaatatgagaacttttcatagtctgcaacaaatgccttcacaaagccacaaactttaattcccatggaatagaatttcatatggcaagcctgtggttacatccaaatccacttattcaacagatttgtgctgtaaaaaaacctcacactagcctatctctttagataggctctgtcttttcatgttggagtcatctaattttccccaaaccaacaacccttgcacatgtctggggtatatttttttgccgaatgcaaaccacatggtcatttcaaagcctataattcagttcaggagcactgggctttctggatgctcgtgaacataaccatcaagagtgacacacatttctggcagtcaccttgccagctccagctctattgtgtctctatatcacggtgaaaaactgcctgacacactaggcagctgacatgtgtagggaaaaaaatatcaggcctgtgaccaaggggaaaatgaagtgattaatatggaaaacacaacaagaaacatcaaacaggaaaaagctgacacttcctattcctttagcttcaagtaaatgtgttttctcctcacactgactgtaaaaggctggatcgaagtattgacatgatataaacgtgtcagatgtcttcctcacctggggccattcataatactgaagagtctttcactcctttttttttgttttgttttagagggagggagggaggtgaggttaacgtaatcataaccctgaaaagataaacttgggaaactataagcataaacacaatgggccgaagtgttcccagtgtgagtcaccactgttgtgccccagctcctttgttcctgccatttccttcctttcagagttccggaacattcctctctggctggcctggctccctttcccaacaccatcccttaaacactggtgttcttcaggcttctgaactcgacctagtctacctgtagactgtgtctcctcattctatgtcctcacagggaggtgagtctcatagatactcattcatacccacagctttactactcccaatgccaccattcctttcttctctttctcctgaaggcccagtgcctagtgaactgtcctaccagtatctatttcatcaagtcccaaactgaacatagtcatgcttttctaccttgcatctcaattccatcctctttccctgtctcacagcccagccacatatgcaccctgtacctccgttattggccccatcatgcacccaggggccagttccatcctcttatctattccaccttatttcatatactaagagtagtgggggctgggtggccccaaatgagattcttatattctgggaatgcagatggatcaggggcccctggccatccatcaggcattcagtaccacaccagctgatctgcaaggtgagaagggggccctcagacacgaaggtctcgctgagcaaaccaggggacaaaccaggagaaggaagagggcctgtttccctgcccagccccagactggctgaggctgatggagcaagtagctgcaggaagaagtggagaggattgtctttccccctgcctctgtgagtcacagagaaacacagtaaatttaggctcctggtgacaaaaggagtcaaggacatttctgcagggcacataccaggttccagcatctttctagagccccaccctccccccagatttgcaaacttgaaaaaaacaagtcctggcatgtgactccttttggcataaatcctcttcaggaggacaccagctatggctgaggtggagcctcacacacaaagccctttggcccacggtcatcaacaaggaagccaaagcggaagactccccaaggaagtggggctctcaaaacacatgtgagacaatgccaagataccaccaggaatacctgaaggagacttgcattgaaggtcctacggatccacgtgggaacacaaaccagtgaaatttgcgtgatctccactgactagacatcatttgaaccctcatgctggcagggtctgaagacatttcgtaatctgtctccacttttgatccctactgtagctcccctacaaaacatttctacagattgctaccaaggtaatcttctaaaattataactccagtggtattctgggctggctcatataggctcctgagagcagactgggaaattttcatcaagattgggaaattttcagcaattttgtgagtcagttgttaaacacataaatcattaaaaattaaaatattaaaaattgaagttactaaaaattaaattatataaacttacaataaattatattaaagcaaaagttctccatttatcacttctttattacttttctatattttaataatgtctattgtcttgaggttacttatgcctattttatgtgtagtgcagtccccccttatctgtggtttcatgtaactaaaatttcagttacctgcagtcaaccatggtccaaaaatattatatcgctacttttgcactttgtagccattattaagtaaaatacagttacttgaacataagccctatgatactgataaaaccactgttaatctgatcacagagatggccaccgagtgactggcaatgctggcaggatggaatggaggagtgcaagatttcatcacactactcagaatggtgcacaatttataacatgaattgtttatttctggcgttttccacttatgtcacactgcctaggttattcgcctcacttcatcttcacacaggcattttatcatctcacatcatcacaagaaggggctgggagtggtggctcacgcctataatcgcagcattttcggaggccgaggcgcatggataacctgagatcatgagtttgagaccagcctggccaacatggcaaaaccccgtctctactaaaaatataaaaattagccgggcgtggtggcacacgcctataatcccagctactcgggaggctgaggaaggagaatcgcttgaacctgggaggtggaggttgcggtgagccgagatcgtgccactgcactccagcctacacgaggggagcaagaatccatctcaaaaaaaaaaaaagaaaagtactgtacaataagatattttgagagagagagaaaaagagagatcacattcacataatttttattatagtataccattataactcttctattttgttattagttattgttaatctcttactgtacctaatttatatattacattttatcataggtatgtatgtatagggaaaaaaatcatagcgtgtatagggttcagtactgtttgagatgtcaggcatccattgggggtcttggggcatatcccccttggatgaggggagactactggatgtgaaaagactacataatgttgtgttgtgcttctaccgtgcatcttttcccaattcaccataacttgatactggccatgatgagggtagtttcatactgaaattgacaaacactataatcacatcgtttctgttttgctaattgtctaggccttaggaggtgatagagaaaatgttaataaaatgcctggtgcttgtagtagttacatcgtgaataaaacaaaaaactgaggaaatattcctctagtattaaaaaaaaaaagtactggacaattcataaagaagatgttccctgaacaagtaaagttttgggatacacctttgctgcttcactttcaaattatacaataatataaaaagaaaatatcaatatgttctttcatcaattgtaaccatgactaggctatggatacaagagttcaaaaaaaaccaacagaaatctgtctaaatcaattagctatatagatttaatgataaagagtattttattactacttgtaattgtgtgcaacacatcttttgtatcagtacaatttataatagacatatgcgcatgcacattttctggagagctggttgttaaacacttacaagcacaccattatatcattctgattaggtgttcctttgtttaaaatctctcaatagctcccttcattggcctccttttacggactacttcaaatcctctcaaacttgcttcttattcctgcattgccatcgcaaccagttccatgaagaatttaaccagcttcacacaagtgcaaactgacaggcccactcacccctagactcctctgttgctgtttcatgtgtcgcccatgggaacctggcagtcatacatgtgcaatccagaagtggggccgcctttattcaatgggagacaagaaacatggataaaagcttctccctttttttctctacataaactgtgctgagtgcatttcataaaacttctcagataatctcttggaataaagcaaccagctgcctatagcaatgatgctccaatattggttccttgtattaccattgcctccttccctagatgactgtctctggtctttcacccctgctccctggatgccattcccaattaaaccacctggcacaaatctctgcacaagacaccacctatcatcatagggtgggtccaggctccttatcttaggagaaatggccctctgaaacaaggcctccacctgccattcctgcttaatttcctagcacatcacacccagtcacaaagaacacacatactcttacccatttcttgtgttttactcatgctattccctctgcttagaattcttcccaaaagggtgttcagagagttctaaaactttgtaatttagtacaacctcaatattacaaaggagaaaattgaggcccagaatggaaaggtctggcccaaggttttcaatagttaatttagatagagctaaacactgtgctactttttatgggcttctgcttctagtccctaaagtgtccatgaatatctctattctagttttgagagtctactgaattaaatgtgtttcctctttctacttcctaggatatatggacttccatttccctttaaactattgctctttattgtctgagacattggtctctcccaaaagaacagatagtaatttactcttacccaatgattcaatccagttccccaaacatttgctgtccactttttgtaagtatttacgatgagtgcagtgaagaagacgaaaatgagtaagatatgtcccttacccaaaaggagtttatgatccagtgggaaagacagagttgtgtataaatatctccatatatggtgtgattattatgatgtaagaaatagccaaagagatgtttaaattacctgctgtacttgtttaaaatatatacatagagcacatatcaaaaaaaggttgatattcatagtttataaaatgggaggaagagtaagtcaacatactaagaaaaccatagcaaaatgaagagctgagaaagaagactatttgcagatgtaactatttcagagctaatgattgtcatggatcaactaatcaacaaatatacgaatgcctgttatacataagccattaactttttgtactactgtgttctatcatatttcagacaaccaaaaaccctcaaacccttaattacaattacaaagaaacctttaagagtatctagtccactcctctcctgaagaaaccaaggcccaggaggttctttttcttatccattatttcttctgagagatccagccattaccaacactcttcaccaacaattcagactttgaatcctcactctcccttgactcttccctctctctcattttcaggaaccaatcaactaccaaatctgtggcttctgctacagatgcatcacatgactgtatccctcccatcttcatgctcttcttcagcctatccttgcttctggatggggctgcctcaataattcctgattctcccaaaatcactctttctcttcctgcaccatccgtcgcaatgccagagctgcccttcttaagcatagctctgatcatgcttttcctttgctgccaaactccaaaaaccaagaacatgttagtttaactttccagctctctcattcttaattccacctgttcatggttgttcctcccctcacatcacccttactctccacctgtgctaggctatactcccactcccatatacattctgcactctccctcccaacagtagagtgtcatctccaaaatgccctacctgccaaggcttcgaaatcctgcttaacctttctgcttccatatggcttctccgatctgtagttgttcactcatctattgccccacctctccacaccctgtttcccattgcatgttacttgtacttatttcacagcatttaatctttgaattgtgtttactgatgtgtcagctaaaccattagatcagtgactctcaaattgtagtccccaaaccagcagcatcagcattatctcggagcttgttagaattgcaaattctctgcccagcccagacctactgaatcagaaactctagggtgaggcccagccctctgtgttctcctgagccctccagggattctggtgcacagtagagtgtgagaaccactgcactagaccatgaatccccagagggcagttgctcccaggataatttcagaggcaaacttagaaggttgtctttaaaaaaaaaatactatagcatattatggacatttttcttctgaatacatatttttaagtaagcagcttttgaccaaaatatatgcaaatatcctaataatatgaaaaaagctggcatgtattaatgtgaatgaagttttcaaatttctcacttgtttattttgggcctcttatttaaaactgactgaagttggctaaattctttgagggttaatttttttttccctcaatctttagaattttttagagacttattactccctaagtgccatttttccttgtaagtttcacgatggctgtcctgtgaggataattttcaaactcattttccatttttctatgactcatctgtgaaacaatagataacagttaagtgtcactgacccttaaaatgtgaaacctaaagaaacattaaagggaaggaaaaaattctcaggccactgaatccaggtaacaccgctacttaagtaagattgtcctattatataaccagcaatggcaggaaagtgagtcggacaggatcaaagtagactgattaaaatgctgtgggatacagaactaaatgataagggagtgctcagtgaattacaatcacttacacattctctactaaaggaattctaaaccatttttgcatcacagagcaaagggtctagagacctttctaggctggggctatgatacctcccttgcttcacatcaactctcctactcatcgaacatatgaccaattttaaattatggtcaaattttacagactccttgagtccttggccctaggaaatcaggcgtaaggaaactgttgctgtacagaagtcatcatattaagtgctatgacttagagaatatcaagtaaattgagaaataaattctaggtgaaatcaggtgacagtgtcaataatggtcactagcatgagaaagagagaaagactgagaattgaatttttgttttgaatttttggatcttgctttggttgtgttaaaataattctaatcaattatgtgaagtgcttattatgtatgcttaacttgtgcttaattacaacaatgtcttctcaacatgttccaaattaatattgttatcctttatttgattgcaacagaaaactcttcaggtctgtctagccaggtcccaaggcccagctctggacatattacctgaccgtcctgagagctaagccacacacaggcccaaaagaacttggccattagagagtcagccatgctgggatgggcctcacactcttttttaggaggactgtgtcctcagtcaggcatcggagcacaaaggtttcatgggtagcctaccgcacactaagccactaaccaacacctgatttgggggcatcattctggtcccttcgaccagattatctggtctctgagcataattgtctgcccacaactttcatttaaaaagagggactcaggccaggcgcggtggctcatgcctgtaatcccagcacttcgggaggccgaggcaggtggatcacaaggtcaggagttcaagaccagcctgaccaacacggtgaaaccctgtctctactaaaaatacaaaaattagccgggggtggtggtgcgagcctgtaatcgcagctactcaggaggctaaggcaggagaattgcttgaacccaggcggtggaggttgcagtgagccaagatcacaccactgcactccagcctgggcaacagaacgagactccgtctaaaaaaaaaaaaaaaaaaaaaaaaagaggaaaaaaaaaaaagaaggacttgcctgcaactaaaactactttctaaagtgtttctgtgtttgtgaactagcacagaagtgaaacaaggccacctaagtgtactacttttctattttagaccaaaattaatgacatacaaaagaaaatctataacattaaaggaagtaaagggaatgaaatccttttaggacatttccccctctctaggaggtacagcataactcccaaaagtatgggttgtgcacagtgacttctttccaaagagtacagtgtggagagggaggaaaaaagtaactttacaatggaaaacattacacacacaacttcagtgaggtgatcaaagtggacatcaccagtgataagtcatgctgatagtatgtacccttgatacgatgtaataaatatggtattttacctctgtcctctccctccccaaacccatcatcccaatctaatcctgagaaaaacatcataaaaatcccaactgagggacattctacagaatacctaaccagtacccctcaaaactatcaaggtcatcaaaaacaaggaaagtctgagcaaccatgataaccaagggagcccaaggagacacaactatgaaatgcagcatggtatcctgggcaagatactggaatagaaaaaggacatgggagaacatctaaataaatacaggttttacttaataatgcatctatatttgttcattaattataacaaatgtatcatatacctatgtgagatgttaataatagaggaaactgtgtactcctttgaaactcgctataatagcatcacaacttttctgcaaatctaaaacaaacataatttttacttctttattttttatttttattttttagatggagtctcgctttgttgcccaggctggagtgaagtggcgtgatctcggctcactgcaacctccgtctccctggttcaagcaattgtcctgcctcagcctcccaagtagctgtgattacaggtgtgcaccaccacacctggctaattgttgtatttttagtagagatgcggtttcaccatgttggccaggctggtctcaaactcctaatctcaagtgatccacccaccttggcctcccaaagtgctgagattacagtcatgaaccaccgtgcctggcccaaacataatttttaaaaggcaaatatacaatagtatgttttctaaatgagatgctctgattaaatgtggtatttagagatgctccagaagtctgctgtctacatccctggacccaatctctactccaatgccagccacctgtcttagtccactcaggctactgtaacaaaataccatagactaggtggcttataaacaacagaaacttacttctcacagttctgggggctaggaagtccaagatcaaggtgcttgcagatttggtgtctggtgaaggcctgcttccccagaggctgccttttcactaacccgtcacttagtgaagagagtcagaggtccctctctggcctcttttataaaggcactaatctcattgataagggcagagccaccatggcctaatcatctcctaaaggcctcacctcctaataccatcaccccttggggtgaggatttcaacatatgaatttgaggaagacaaatattcataccactgtactgccctgaaacaaagcagtttgaaaatcactatcaaggaaaattggaacatacaatcattataaaagccagcccatttcaggaggcctggcaggattctgctgcacaattcagtcctgcctttggatgactgcattagactataagctgtggggctggaaccacattttagactcactagcctaggcctagtactgtgttagcaccaaaaagactctgtgcttgataaattcttcaacaccatcctgaagaggggctattgcaaatacaggatgaaagctttcactgccaactttattggccttccaggcaatggatctgcaaaaattacttcactgtcagtcaaacctaccccgtgtatctggtgagatcagacaggacgaacatatccaacatgcgtttctggcatgcctttctttttgtttcttgtttttgttttgagacggagtctcgctctgtcacccaggctggagtgctatggcacgatctcagctcactgtaacctccacctcctaggttcaagcaattctcctgcctcagcctcccaagtagctaggattacaggcactcaccaccacacgcagctaatttttgtatttttagtagagatgaggtttcaccgtgttggtcaggctggtcttgaactcctgtcctcaagtgatctacctgcctcagccttccaaagtgccgggataacaggcatgagccactgtgcccagcctatggcctgcctttcttacaaagtgatacacatttccctagtccccatgacactaccaaaaaccaccccggtagaactcaaaaaaggtaggaaacaggagtttccccaaatcagtctcatttatgttacgatactttcatgtttaatcgatccattctatcacagattatacacccacatgacagatgcaactgaaacaagtttttgcaagctctctgaaaacgacaggaggcattcacatagaaagctacagattttatttctcatcagttgagagcagcactttgttccaaattgcagtaatatctcagcaatgaatcattgtcataaaaacagcaacatctgtgaggtcagaaaagaacaattaggaaaacaaatgaatcccttgggaaccagggttcacactaacatcatatatttatataacaacttggaaaggtagtcattcaacaagtagttagtgagcacctactacatgtcaggaaagtccctactctcataaagcttaagttcttgtgtagaaaacccagtaagcaagaaaaagagaaaagaaaaagaatttcagatagtggtgaatcctagcatgaaaataaccctaggtgaaaggctggaacaggatcaggtagcaagcaatgcaatgtggactgtgaagtgaggcagctttcaatggtcagggaaaaaacctttccaaggagataacatttgaccattttgtcattgatccaaatgacaaaaaagaaggaagccatgcaaagacttaggagaagtgtgctccaggcagagggaatagcatgattaaaaggccctaagatggaacaaagcttgatgtgttctaaaaacaaccttcctaacaaactctggagataggcaactgtagttcagaaaggtgagaaacaagttgatcaaggttacacagacgctaaagtagaaatgaaacttagcacacctgactcctctgatagtctccctgcaacacgctagctgccttcctagttagaaacccaggctccaatgaatgagcatgagaaatcaggccaatggggcaaagagtggcccctgattaccaagtttcacaggatcagaatttgagttcaaacataaaaatcgaggctaccatacaatgtggccagggtccagcagcccagatgacctgattctaagcaaggtacacaggtgccagggctggagagcaagagcccacaagaggggcccagaaggcacatggggtgatcatcaaactcccaagggaacttacaaaatactattttgagtcccattcctcaagaatctaaatttattacatatgtgatagaacctggaaatttgtattttaagaagttcccaggtgattttgtttagccagactttggaactactgtgatggagaaggagggaaggccagctcttcaggaggttgcagggagaattctatctctacaaaaggaagaatcaagggttaaattgaatgcagttgagacttgtaccagaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaagcataagatgcgatttgtatgattctctttgtaatcagaaatgtcacaggcttatgggaaagttaggtttacatgtttctcattttaaccctgcaacaacttttagccacaccctagcaaatacattttattttgtggtgctaagacttaaaggattgtaaacacaaaaccagaccttgcagagctacagcttttcttgtgaacacaatgactcagcctaactacaagtttaaagagacatatcttatgtgttgggtcccctagtatcaatctttagtaaacatctgggatggacaggaaattgctacacactgcttttagttactaaaaaggcaacactacctgagctcaagcatagtttagataggtactatttgcactgctatagaggacaacactgacaattgttatttttctgatagatactcaggagaggaaatgatcaataacaataattcccttacgtgttccttcctcttgacagctaaaccccacaatacccttagacacaagtttaaatacatcacaagcttatcctcaaacagtaatgtattaggtctttcctgctgtagataagatttgttaaacagtctggctatggctttttaccttttctcttttaaaagtgcatttctcagctgggtatggtagctcatgcctgtaatccagcactttgggaagccgaagtaggaggattgcgggagcccagctgttcaagaccagccctagcaacacagtgagacgccatctttataaaaatacaaacaaaactggccaaggatggtgatgcgcacctctagttccagctactcagaaactgagatgggagtatcacttgagcctaggaggtcaaggctgttgtgccactacactccaacctgggcaacagagtgagaccctgtctcaaaaaaaaaagtttaaaaggtgcatttctctaaagctacgagaaggaactcaaaccttgcttagtgataaaactaaagcctgcaacacaaccattatcattaaaatgttattaaaaccctgtaagaaagatgaagagtcttgtggatggatggtggtgacggtagcacaacgatgtgaatgtatttaatgccactacatgtacacttaaaaatggctacaatggtaaattttatgttgtacatattttaccacaacaaaagtgaaattataagagaaaaaaaattttttaaaaaaacatcctgtaagagaacatttatacactgtcggttggaacgtaaattagttcagtcactgtggaaagcagttgcagatttctcaaagaactcaaaacggaactaccattcaacccagcagccccattactgggtatatatccaaaagaaaataagttgttctaccaaaaacacacacaaattcatatgttcaccacagcactagtcacaatagcaaagacatggagtcagcctagatgcccatcaactatggaccggataagagaaaatgtggtccatatgcatcatagaataccatgcagccataaaaagtaacacaatcgtgtcctttgtagaaacatggatgcggatggaggtcattatcctaagcaaattaatgcaggaacagaaaatcaaacattgcatgttttcactaataagtggaaggtaaacattgggtacttatggatatagagacggcaacaatagacactgggaactactagacgtgggagggaggaaggagagcaaaagttaaaaaattatcaggtactatgctcaccacctgggtgacgggaccagttgtacccccaacctcagctgcatgctgtatgtccatgtaacaaacctgcacatgtaccccctgtatctaaaataaaatttcaaattattaaaaaaaaaaaatagggtcgggtgcagtggctcacgcctgtaatcccagcactttgggaggccgaggcgggcggatcacgaggtcaggaaatcgagaccatcctggctaacacggtgaaaccccgtctctactaaaaatacaaaaaatcaaccgggcgtggcagcaggcgcctgttttcccagctactcaggaggctgaggcaggagaatggcgtgaacccgggaggtggagcttgcagtgagccgagatcgcgccactgcactccagcctgggcgacagagcgagactccgtctcaaaaaataataataataataataatgacagtcctacttttcctttgtaacaaaaataaaagttacctataagagttaaaggtaaataaaatttgtaattttaattaagaaacactaagtaaacatacaacttccaagaagccgggttccccactacctggttataagtaagtctacaaacctaaatgagcattgtacagcgcttactatagttcataattattctgtcatcagggacaaacattgtaaagacactttttcctcaaagccttagcattcaatttttttttttttttttttttttttttgagacagattcttgccctgtcgcccaggctggcgtgcaatggctccatctcggctcactgcaacctccgcctcccgggttcaagcgattctcctgcctcagcctcccgagtggctgggattacaggcgtgtgccaccacgcctggctaatttttgtatttttagtagaggcggggtttcaccatgttggccaggctggtctcaaactcctgacctcaggtgatctgcccgcctcagcctcccaaagtgctgggattacaggcgtgagtcaccgcgcccaggcagcactccaactttttatatggattgttaactgtactggttcttgagaagccagactgagcgcttatacaattagtccaaagatccccaaacaacatttaaaggctgtctacaaattcaagctaaaagactgtgtacaaattcatttgtgtgtcacaaaacatttaatactgaaagagattcttattcaaataggcagtgtgtaaatgtggggtctgttaacagttcaaattgcagattcctttccttctttaagttttcattgcaccaccacgaactaaaccatttaacatacctcagaggtctctgggtacctagtctctcagaggcctttggaggcccacgaaggcttatcttaactaaaattggcagggctggctgataaagttaacggaactccccattttggaggcagacttagtaatggtcaaacgaagaaactgttgtggtctgttcttaaaaagctactagtatttagtgcttcacagaggaagtaaagaaagcaataatccgagatgaggaggagcaaatacaggcgtggcggtagttcaggactgagtctacaagggcggttctcaagggcgtcacaaaatcctatggaaggcttggaggacggcactcctggatctgagccctacgtcccaaacaccttcaatcgtattgtgaggaagaagaccttttacacactccctgctgctggcccccggccccctcgccccacctccgagtggtcacatcacacggcgggagccgcggtcagcagctgtgatcacacccccaggaccgtgctctgcgggctgggctcgaagccttgggacgcggcacttcctggttggtacgggatgccggtcccatcgcccccaccagcccagtcatgccaccgcgcacccgaaccaagggcgcccggatgacctggggacaccacacacactgcacccgaagccctgtggcggcgaggcggtgcatcctgcagaggacgcctgggcttcagcctgagcctgcgcggctctgcgctccaggcagccgcccgcgcggcaaaagtgcgtgccagagttgtcagctttcaccctgcaggaattccacccgaaggcgtgcgagggaggcccttggggatcgctagggagtccgccgccgactcactcgctgaaatcccgtccaagttgggcggggagcggccagctgcccaggttgggcggaggagggacggagggcgagggcagtggaaacccggctcccacgggcgcccggtgatccgggtctcggcgcggctcctacctgcagggcgaaggggccgctagcacctgcgcgttggcggcggactctcagggctcgggtgcctctggcacagctggagctcagcgggagggaggg

SEQ ID NO: 969 - DNA, 210090 bp, Homo sapiens; identical to SEQ ID NO: 968

SEQ ID NO: 970 - DNA, 206612 bp, Homo sapiens
cacaatttaaaataaggtcttgcgattgctttaaagaaagctttatttactacatacatcctaagaatgtactgtaaatggagcaagatctaaataaaagcttttcaaatataaagcagctaaagttaactaaaccactagcaatgtttgaaaacagaactctaaaactttttttttacatttatatagtttgttcttaacactaaaaaaaaaaaaagttcacatttcaagttataaacttacctcagtagtgtacatgaaatggttttgaaacaataggaacagataagtcccagataggaggctcactgatacttaattggccatgtcaccaatgtttgtttttaagggagtttggtggttgccatgttatcatttttttttattctttctttctttttctttctttctttctttctttctttctttctttctttctttctttctttctttctttcttttctttcttttctttcttcctcttcttcttcttttttgcaaataatttacaggcatatgtaaaatacagtaagaatactgggtcatagtttcatccagtgaaactctgtgacaatccttcactagaaggagagtacttttttcacacagtcaggggatgaggatctgatccgaattacattttgtcgagtcactcattcccacagatttgagtttgaatgcagcttgtggggtacatcatcaggaacattgcacaattattttatgtcatttaaaagaatgatggaaaggaatgttagcggtgcttaaaggcctcagtaggcactcaataattttatagaatagttaaataaatattgcttacacataaaaactcatctcatttcaagatgagggggaaaaaggcatttgggaatctcttaatttaaaacaaaacaaaagtacttgctaagggcatgatcctcttatgaatccacaagaattcagccatcaacaaaaatcccgtgagtggaaaattgtatggatctctaacatgacataaaaacgcaactgcgttttacttgctaccttattgcacacctcacttccttgattgagcctttaaaaaacaattccaagttgatatttttttttaaaaagtagatgacaatcttaacattttactgtattttacattcactctgctaaacaaaagcctttaaacaggcacaaaacactgcaacaatacattaacttcctaataaaacaaacctttttaataacattgaaataaaatggtttcattttgcattaaactacataccatgaacttctccaacataaaaggactaaaaacaagcattagaagatatttacaaactatctttaaacttctacaggtctctcctcctcctcctggatgtgcacaccccaatccagttcacccatcaagtgcacagcaaaggaagagaggcccatttaataaacataatgtttccaacacccttgaggaccatggacagttttgcaagaaacatggtaaggcaactagaagcataactttctgctgaaaagagtctctgggggtcttgtctacgataacatacattctttgtccctacaaactcatacttcaaaaatgaataaaagcattagaaatggcattaaagttttacattgggcaattaaatagctatgcaaaggtgtcttatgcaactcgattaaaaccttgtgcttactctgctactgaaaatagcacacgtagaagacaatacttccccaaccaaacaaaaaaaaaaacaaaaaacaacgaaacaacaaaccccaacaaaaacccaggaagaagtataaaagccaccagctcctctatcagagctacttatcagtcctaggcttgccaaacattgcggtgggattgggaatctggggaggaggggacagggtgagagatgtgggagtgggggcatgtttaaggctaaggcacatggagaatgagccccggctaacggtggcaaaggagagctttccagtgtttggactcagaagtgcggcaagtcttttcaatgttggcttaaggagagatccagtgtttaatttcttttaaaaaatagtaccgccatgatgatacatggtaacaccatcaacccttaatgccagcagaaatacagaggttttactcattttaaaattgcactttccagtataacctttaaaataatgctttatgtagtatttttaagcactactgtttgtatctttaaatattgtatatatttttcaaaatagttccctagctcctcaagtgtgcttttttaatatatagttgatatattattgaaggtactacaaaatagaaatctctggagtgcagaagttaagaaaataaccttcatactgaaaatatatccttaaaaaaacaacaacaaaaacctctatacaaatgtagtacagcatacaaatttttaaaagatggaatgaaggcacgaaccattgcaagtcttttggaaatgtatgaacgtaggcatgctaagttgaaaatagtcttaaaaaactagtgaaaacttcatgtatataaaataattcagaaataaatctgctaacattcttcactttcaggttgcatgtgtgaatccaacatgttccttcttcataaatagtcaagcgttccttcagtggtgtttgtgtggtctgtcttcgtgctggtcaccagcctcagtatgtctggtagacgtcggggatggggacctgaatggcagcagcagggaaggcctgaggtatgtagcctgcgtatcctccatacatggcggccgcggctgccgcgttcttctgtagtgtggcgatcgtggctgtagctggagcagcaaatggcacgtaactggccccgtagatcccggcagtaggaattctctgaacgtttggagccaccgtgtatactggagttattgggcggccctgaggagaagagacaaaaaggagccttcctgaacacgtgtatgtacctatcatccattcattcaacaagcctctcccagaagacgggaatacaaagacacaaaagcaagggagagaaaggcagaggggcgggcaaacagcaattattgtaagcaagtgggagaagagccactgaagaggtaaggtggagctgcatcctcaaactcagtgatgccaccttgtgaaagtgagaggcctggaaggctgagggaaaggtgaaatacagttgcccctcagtatcctcacaggtgattggctctaggacctccgtggataccaaaatcctcagatgctcgagtccctgagagaaaatggcgtatttgcatttaacctatgcacatcctcctgtatactgtaaaaaaattttttttcatagagacaaggtctcactatgttgcccagggctggtcttgaactcctggcctcaagcaatcctcctgtctcagcctcccaaagtcttgggacccatacactttaaaaataatctctagatcacttataatacctaatatgatgcaaatgttatgtaaatagttgttatatcgtattttgacatttgtatttttttattgttgtattgttattttttattgtctttattcaagccacggttggttgaatccagatgcagaaactgcggataaggaggaccttctctgtactgtattccggaatcttctacttaccattccactcaatcagtctatgccccagagtgagctagagaaggcagcggagaatctaccatccacacaattgatttcacagtaattaaaaatcagtgtttttccttaaacatggcctctagatacatgccagctgcctcaactcatacttaactgatggaatatgatctgtctcagagacagagagaggaacagactgtgtcaacttagagaaaccaaatatactgatctccaaagggacagcttcttaagctgtgaccttaaaaaattgtgaccatacacaattttcagccaatgtgatggtttccatcacctcccacctaagagatgacaccattaatgtatacaaattgttgtagaagcttagagaaagaaccaactaatggggaagttggagaaaatgtctcagcagcggggatattcgagctgagttttgaaggataaagagcagtttccaaatgaggaagaagtgggcaaggacaagctaagtaaagttgcctgaactgttgacggccaccactggctctagaaaagcccctgctacttccttctgtctacttgaaagtgcaacataagatgttttcagaacaaacaggagtatgaatgggaagactgtggttcagtatttcccaaagtgtttgccatggaactagttctgtgagatgcttcattgaaaagagattctgaataaaataaaacattcatttaacaaaatatttggtgcacctcatgagccatagaatgcctggtagtaaatgctggtatggtctccctatatgttaatacatcttcaaaataaacaattcagcatatgtgaaatggtgaattaaaataattatttcttcctggatttttataaaggaattagctctaatttctgttacaaaatttgcaaatcagagttccaaaattgtgctcaaaggaacttaggaacttctagcctaagattactttttaaaactataatcaaatagtaattataatttataataattttaatttataattataatgataattataacaattaataactcagaggctgggtgaggtggctcatgcctgtaatcctagcactttgggaggttgaggtaggaggatggcttgaggccaggagttcgagaccagcctgggcaacatggcgaaaccttgtctctgcaaaagatacaaaacttagccagccatggcggtgcgtactcctgtagttccagctactcaagaggctgaggtgcaaggatcacctgagcctgggaattcaaagctgcagtgagctgggatcataccactgcactccagcctgggcaatggaagtgagaccttgtctcaaacaaaacaaaacaaaacaaaacaaaacaaaacaaaacaaacccccaaactcaggcactattctaagtgccttatttgtatgacagtattgaatcatcacagccaccagtagagttggtactatgattatatggagttgtgtggaagtgttaaatgacctgcacaaagtgacacagcttttaagcaatgcaatgtgtgactctggagcctgcacttttagccttacgttaacttgcttcttacaaccctaaacaatgagtgtctcatcagtgacattttacaaccagggagaggagctccagaactggaaagactgtggttcacagcaagacacaagtcaccttttccacatgtgtggacgtaggtttaataaccagtgcaaaaagggagaggaaatggcagggaaggcaacatgtgagagagacctttccatgtgctacaggacggcccaacacctgggttcaggctgcccactccaacaccaagttttgcacatagacatgcactggcttacggcctggaatcaagagtaggtccccaaacccatggcttctcttttcattcatgtgatgtcccttttatgatagcattcaccacactataaggacaaagcatgcagagatcaggcatctgatctcccaatcccaattctactcccggccagcaattctgtctccttgctgggccttaattttcttatctgtaaaatgagaatatatggggaagcacttggttttgctttccatggtttcagttacccgcggtcaactgaagtctgaaaatattaaactgaaaatttcagaaatgaataactcataagttttaaattgtgcacccttctgagtagctccatgaaatctcatgtcatccctctccatcctgcccgggacaccaatcatccctttgtccaggaaaacgacactgtctgtgctccatgcccatgtcacttaatagccatctgggttatcagattgaccgtcaaggaacccttattttacttaatatcagccccaaagtgcaagagtagtaatgctggcaatttggatatgccaacgaggagcactaaaggccttcctgtaaatgaaaaggggaaagttctctacttaataaggaaagaaaaaaaatcctatgctgaggttgctaagaactacagtaagaaagaaattttctatctgtgaaattgtgaagaaggaaaaaaaaattcgttcatagtatattattagtttggtaatatctgtgtttcaggcatccactgggggtcttggaatgtatcccccaaggataaggggggaccagtatacaattgcattaatacagcatcatcaaagagcaggaataaagaaaaatgcaatgatggtagtgggagaaacatttacccatccctaaaaagtgcctctagcaggagaatcgcttgaaccctggaagcggaagttgcagtgagctgagatcccgccactgcactccagcttgggtgacaaagtgagactccatctcaaaaaaaaaaaaaaaaaaaaaaaaaaaaagtgcctctaattcaggtgaagagtccctgcagtcttccctcctgtcaaggaggagcagttatccttgctctaactataccaagaggtgttgttaaattggctaaataggaacacccctgagcgcctacaaggtaggggaggatgatcgaaggtaggggaggataagcaaagactgcaaataagaaccctgatggtggccgggcgcggtggctcacgcctgtaatcccagcactttgggaggctgaggagggcggatcatgaagtcaggagatcaagaccatcctggctaacaggtgaaaccccgtctccactaaaaaaatacaaaaaattagccaggcatggtggcacgtgcctgtagtcctagctactcaggaggctgaggccggagaatcgcctgaacctgggaggcggaggttgcagtaagccgagatcacgccactacactccagcctgggcgacagagcgagacaccgtcgcaaaaaacaaacaaacaaacaaacaaacaaacaaacaaaaaaagacaaaaacaaacaaaaaaaaaaccctgatggcaacagccagtgcggactgataggagacagaaatagtcaggacatgattatggtgcctggaatttggacctgaccagaactcacagtgcacatgaaagacaagtgttcatgaatttcttactaaaggagaattagaaattattatcagaattccactaagtactgctgctacgctatagtaaatatttaccgtcagtccacaagtattataactatacttagttgttattctacagtgtcatttacaaccaattcctctttttgtctttcagagatcccaagttaaagaatacttaatgacatactgaaagataaataagcttcaattagtctgccctttctgaataatgcagtcaagactagtgttcagagtgggcaaaagcaagtaaacagcatcctactgtggagggtcacaggcctggctctgtttcagaatcattgaggagctgtgcaaaatatcaattctaggactccagcccagtttgaccgaattggaatcttcagggattagagtctaagaatctctgttttttaaaaaatgtaggcaacggctcatgcctgtaatcccagcacttggggagcttgaggtgggaggatcgcttgagcccaggagttcaataccagcttgggcaacatagcaagactttgtccctacaaataaaaaagttagccgggcatggtggtgcgtgtttgtggtcccaactacttgggaggctgaggtgggaggattgcttgaaccagggaggttgaggttgcagtgagccatgcactccagcctgggtgacagagtgagactgtctcaaaaaaatcaaaaatcaaaaatcaaaaaaagtggcctggataattctttttcaattggataagggatcctgggcctgagtacttgtgatcggtattcatgattcactgcctcacagaaaacagctttaacaagattttcttctgttaaatggatgtcctccctatgtcctataaggtgaagatacaaagaaacaggacacagtctttggtctgtaggagcttcattttccttgggagatagaacacactggcagccataggccaagtaatgatgtagtaatcaggagtacaagagagaaaatttcatggccgggcgcggtggctcacgcctgtaatcccagcactttgggaggccaaggtgggcggatcacgaggtcaggagattgagactatcctggctgacacggtgaaaccccgtctctactaaaaatacaaaaaattagccgggcatggtggcgtgcgcctgtagtcccagctactcgggaggctgaggcaggagaatggcgtgaacctgggaggcggagcttgcagtgagccgagatggcgccactgcgctccagcctgggcgacagagcgagactccgtctaaaaaaaaaaaaaaaagagagagaaaatttatctaggaggtggatgggaaagattctatggaagagatgagaataaagaaaccaggatacactatgaaaaaggtggggaaggaggccaacatggtaagatgagtttgggaagagataggggaacagtgggagatatggttggaagagaggattatgggcatattttgtaaatttatttttgagacagggtctcactctgttgcccaggctggagtgcagtagtgcaatcacagatcactgcagccttgacctcaaggctggtcaagtggtcctcctgcctcagcctccccagtagctgggactacaggcatatgccaccatgccaggctaatttaaaaaaaaaaaattgtagagacagtgtctcaccatgttgcccaggctggtcctgaactcctggcctcaagtgatcctcccatcttggcctccctatgtgctgggattacaggcatgagccactgtacccagcacaaaattttacgtatctatacagatgttctttctctctctctctctctttacacacacacacacacacacacacacacacacacacacacgggggttaacatttttttaaaaaatcttcattgagctgcagtttgaaatgtgaaaatgtgaaatcactccctggactttgtgtgtcagctctttaacaatatgagctaaaaattatccagtgctattttaaaaaaatatatgcacaatattatgacactgtgaaaaattacacataatttttgcatattgattaccacccttaatacaatgatattattagggtagtacaattaattaaaaatttttttttctgtcatgcttcaaattcaaaatgctttgtgtcacccaaccatagctgtaacagagagccaggcacacagtaaattctcagtgctgaatactaaatgaatccatgttaaagagaggcttcacacacaaatgacaatgcctgcaataagaactctacctggaaaggtggtggcgtcgacacagtgggaatgacagcggctgcggcggctgcggccgcggctgcggcggcagcagcactggctgggtctggctgcacagcaatggggctgatcatgtgctccactgtgtggattttgccatcttcaatcattttaggggctggagctgctggaaacatggaatactgagccccaatggcagggatggctactgcaagagaagcaagaaggaaaaacaggtcaatcactttcagtcgctgagtggggtccagcacttgctctaagatattttttatttttatttttttaaaaacttttcttttttttgagacagggtctcactctgtggcccaggctggaatgcagtggtgcgatcaaggctcactgcagcctcaatctcttggcctcaagagatcctcccacctcagcctcctgagtagctgggactacaggtacaggccaccttgcccagctttttgtttttgctgttgtagagacagggtttcgccacgttgcccaggctggtcttgaactcctgagctcaagcgatccaactgccttggcctcccaaagtgctgggattacaggtgtgagccaccgcgcccagcctaagatattttttaaaaccacgtttagaggtcctgggcctctccatgctcactattgttctctcagtacaagccatgtacccagatgcctgctccctagaggaagggatgggtggtggcaggtaactccccctgcctgttgtggaagagacccctagagtaaggcttttgcaccaatattttctactatttctacagaaaaatcacagtttgaatgttattcttgatgtcctactgagcaagaaagggcctctgactatgggaaaacaggcttagacgaagaagtgagatcagaggcttgaagcctactgcctgtgagagttgggcctgcctgttccttcctactcacctcactcattaccagccgcactgcctttttttcactttcaccactatttaagaaacaggtgctgttgagggtttcattctgagaactcagacctgtgtacatcctccccaccctgtatttcagatttcaacattaccgattcaaggaaaaacacatggtaaaaaaaaatagcacattccccagtttcctcatgcccacgcaaagtagtgaagatgtggagtgattggcttttagtgggacctcccaattcaaagaatttctgcaagtaaagtccaaaattatgatttcaaccagagattcaaacagcagctattgaatgtcaaggtacagtaagaagagatcaaaaggaaaagatatcagcccttttgtgtgagtgtgtgtgtgtggggcgggggtgtgtgtgtgtgtgtgtgtgtgtgtgtgtgtgtgtgttgaaaggacaaacaaaaatatgaaatgtgtacacaaagaatctttctatttctggttttctccaactgtaggtacatttattctaaataggacagactcaatcaaaggtaaagagacaaatgattgtaagctaaacaatggtacagccattcgataaaatatacctaaaaccttaatcaaatcttttacctgcctttccaaccatatcttccactggtcttgtgcccagatacttcaccaccaccctggtgcctctcctaaaatacaatgttctcattttctggatgatcagaaatagacgccaatcgatggggcccagagagggttgtgagtttaagctacaaggggttgtatgaagtaaatgaattgttctggctatcagcccacaggaatttctacctcaggctccaggacacaactttacatagttaaagattatttaacagttcttttctcttgttaaaccttaagctaccgtaacttgccaaagggagttcccttctcaacaagtagaagcgacgactcccatatccaggctctattttattaagttacagagctgtgggatcagttttactttgcccacagtgccaatgacatttaaaaggcaatctagtctaaggagtcacttaactgcagaaattgcagaatttttacacaggcaaaaaaaaaaaaaaaaaaaaaaaaatcattactagaatcatcaaaagaaagttcaattggggaaatgctttttaactctatgaggccaatgtgtacctatgtcccaaatgcacagattccttgactctattttagctagggagagaagtgtacaatctcaaccagaagaaaatcagagtagctgggctccaaacagttcttcaacttcctcctgctgaagccaggaggggtctggaggagggtcgtgccaattacccacggactgagctttccatgtgtttggatgcttctgcagggtgctacgtgagtttgtgatagactcacacaatggagttaatgttttttgcaggttcggatcagaagaccggcctcacattagatggtcatgggcactaatgacattaataaacaggtttgtagggcctggaggtgaaggctaagttcagggtccctggcttgaaatacttgagcatccctactcccaatctactgatccaactagaggaggaaatgagtgctggaaatgagaaaccagggaattagctgcaaaaattttcagcaaaggccaggtgcagtggctcatgcctgtaatcccagcactttgggaggctcaggcgggtggctcacttgaggtcaggagttcgagaacagcctgggcaatgtggtgaaaccccatctctactaaatatacaaaaattagccaggcatggtggtgcgcgcctgtagttccagctactcgggaggttgaggcaggagaatcgcttaacccgggaggtggaggttgcagtgtgccgagatcatgccactgcactccagcccgggtgacacagcaagactccatctcaaacaacaacaaaactttcaccactgccttgtcctcaagcattcttatttgctcagaccatgacaagggacaaaaggtgctgcttactcctgaaggggaattttctgcccttccaaacaactctcagaatggggcaataagctctaccctccgacttcagatggtcggggcagaaataggcctgagtaaggaaaagacaggttttacctgatagaagatacagagagcctcatgttcttcctttcttccccctacaactctccttacttagccacagactgagacaaaacctaacaatgggtgacagccctttgaaaaccttactgcatggccaggcgcagtggctcactcctctaatcccagcactttgggaggccgagacgggtggatcataaggtcaggagatcgagaccatcctggctaacacggtgaaaccccatctctactaaaaatacaaaaaaaaaaaaaaaaaaaattagccgggcatggtggtgggcacctgtagtcccagctattctggaggctgagataggagaatggtgtgcacccaggaggcagagcttgcagtgagccaagatcatgccactgcactccagcctgggcgacagagcgagactctgtctcaaaaaaaaaaaaaaacaaacaaacaaacaaacaaaaaaaaaccttactcaggcaagtttgatttgaacatagtcaaagctacaccatcccctgaagttctagataaggaggtccagggggtcactttatttttgccttgtctctagctgcctaggagaagaggaacccctgtgcagatgtgagagcctgaaaaacgcttggattcacttcaaacagaagggctggggtttatgctgaatgggagcattctcaatctgcttcatactgacctgtaccaggtttaatggcaactgggttgacggtagggatttccaaattcggcaccagttcatatcctttttcttgctgctttcctttcccttcatgatatcggctatatataccacgaccagcagaatatcccccgaggtaggaacccctaggccctggggctctgttgccagctgcacctcgccctcggcctcttatgctgcctgcttgtaataacaacacaaaagatgatcagcaaccaacagtgacggtgctggaggcagacctcagccctcggttctcggcatttaactgccccagtcttaattgcaggtggctacacctttgctctttaataggctggtaaagatgcttccaacattctatttcagcctagatttgcatcctaagcatgtcttcttagtacaagaggcaaacttgcagggtgagtttctaggattgtatctgcaatttcagtaaagaaaaacattcatagactacccaccaccccctcccccccgccaaaaaaaaaactgtggccaggtgtggtgtcttatgcctgtaatcccagcactttgggaggctgaggcgagaggatggcttgagcccaggggttcaagaccagcctggggagcatggtgagaccctgtctcaaaaaaaaaaaaaaaaaatatatatatatatatatataaaatacatatatatatatataaaatacatatatatatataaaatacatatatatatatataatacatatatatatactattaaataattttttttaaagttagctttggaaggggatttgctggtccaccttcctcatttcatgcttgagaaaacaggccaggggagattaaagtgactaactaaagtcacagacccagttaatcagagaacaggacccagaacctatgtatcttattttccaggttatgctgggtgtcattatatcctaatcagtgataacaaaaaacaaaattaaaaatcacggactccaccaacatcttaagatttaatatcacaagcaggttttaacgtaagcaccaagagaatggtggactagcccctaacccggtggacctcggcaaggaagaattccagcacttgcatattcctgtgattttaccgctcaccccagaacgatctgtatttctatcagtgctgcataagtgacggccttcggtgccaggaaagaattagacccagaatgcaaacccaaaacgggggtgggagggccttcagcacctaccagctcagcaaatgccagccacggtatccctggtgccccctgcctaggaggcaacgttcttgggggccccacccaggagaagagcccccactaacctttcacaaagtagtccctgttgggcccaatgagcgcgttgtaggggtagccgtagtaggccagtgtgtaggggtcgcaggagtacacgtagctgggctgctgcgctgcctcagccgcgccgccgcccctggctgccttctggtagcgcgagtactgctccttgtccacgggcttggccagcgtgacctccaggcacgagccctccagctcagtgccgttgaggttgttcatggcatgcacggcatcctcgcggctggtgaagtgcacgaaggcgtagtcgcggatcttcttgacgcgctccacgcagccggggttgaactggccgaagctcttcttgatggtgtcctcggtggtctcgatcatgaggttgcgcacgtagaggatcttcacggtctccatcacgtcctcgtccacgtcgatctcaggttcggcccagtccacggcgatctggtggccccacagctggatgcggccaggcatgagcttgcggcgagccatggcagccgcgcggtggctctcgtactccacgaaggcgaagccgcggttcttcatcttgtcggccgcgctggcgtagacgatcacgtccagcacgccctcggtgaccttggcaatctcctccaggatttcctcgcgcttcttcatcttggggatcccgccgatgaagaggcggcagttgtccacgctgcagcacacgccgagcaggcggcccgggcggatctcgtagttgttgagctcacgcactgcgcgcttggcctcgtgcttgtggcagtacatgacgaaggcgtagccgcggttcttgccgtcaaagtccatcatgaggcgcagctcgtagatgcggcccacggcctcgaacacgggcaccagctcgtcctcgtacacgtcgcgcgggatcttgcccacgaagacctcgcagccacgctgcgggtgcgggccctcccagccgggcggtgggccgccgtacttgcgctgcccgttctcttgcaccatgctgtagcccgtgcgctccatcagcgccagcagtgctgcctcgttgggcgcgcccgccacgccctcgggcaccttggcggaggacccggcggccgagtcactgctcatggctgcggtggaatcctctgcggtcataatgtcaaaggcatccacagctggcggaaacctggggaagcagaaagaagcgtgagtggggaaccgctggatcttgcctcttttgggttgtgtttcgcagccttgcaagtatgcattaataggccacggggaaggggaggtggtttaaatgagaaataggatggaggcgttctggaaatgcagcagccctacatttgtctaaaatagtcaagttgtcttgcagcaaaaaccagaagtgagttaggagagaaaaaaaaaaatcagaatgagcaagtacttccatttcatcagtaccccgacagctttgaagttttgcgaagctgctctcatttttggtaaaaacctcacgttcttttgcttcattcctgcaccgttaactccacctgatttccttgttatatggaatttgacaaactccatgtatttctttggtgaacacagctttcttcttttcttttttaagggagtctttttaattgtaggaatggaaatacagtgaagattttaaattattaaagaaaacttttaggagctgtcattgtatagagagagctgtgtattaaagctttttacaaggaagaaatgaaatgtgcacattgccacgggcttggtccaggaactgtaataagagctaatctgattttgatggtggcattcaggtaaaattcttggtgtgaagcattcaaagatttggaatcagtccttgaagagctagactgacttcaagctgggggactgggaagcagcatctacctggtaaaccacactattgttttcagagaactgtcacctgcattctcttaattttcttaacctctgtatatggtacatggtattatcctcagtcccaatttggtcatggggaaataggcttaggttgagtaaactgccccatttcacacagcaagtgtcagcttgtaggcagacttgattccaagttttctggctccagattccctgttttttcttccaaaccaatgctgggcaatcgaattttctatgatgctagaaaagctgtcacttgccacatgtggctactgagcacttggaatggggctagtgtgactgaggagctggattttaaattttaattaaacagccacgtatcacagtgcaggtctgaactgtgccgccttcacttatatggccaagggctctgtggaagtgattctaaattatgcaataagattattacgatgagctgcagactatacttctgtaatgaaaggctccaattcgccttttaaaaaatgaaatctatttcattttttggactataaaagtattcagttaaatttatagaaagttaagaaaagtacataagaaattattcctaattttcctacccaatgatagcacaatgaaactttctcatctgttttctagatgttttcttgaggaggtgggagggggaagcctggcttccgcctaatttacatggtgctactttatgttataagcattcctctgtattcttaaaaatctttgtaaaaacatcatttttaatggccatataaggtttcatcaattaattagaacccggagtatcattcattttttaaaatttaggactaggagatgtatacaagaatattaagggaaatttcaaggataataaaaatgaatttgatcattgaaggaaaaaataaaactataatgaaacaaaataaatctgagctatttatttgccagatggccaaaatagtccttttgtggttaatttgctctaatatcaagcggcagtacagtttagcaggtaagtatgtggcttctggagccagactgcatatgtttgtttgtgaatctcagctctaatacttgctagtgttagctgctccatgcctcacctcagtttccctacctataaaatcagaatgataataatagtattaacctcattaagtttagaggagtgagttaatacatacacagcattttgaatggtgcctagaatattataaatgctcaagaaatgtcagttattaatttcatccaaacttttgagtaaaatcttagaccaattctttcaattttagagtaattcttaagataaacatcttcagttctttaaaaatatctgttacacgtggcttctattcttattatttttttcctcttcaagtgcttggaagctggtttgacgtctccagttatcatgaaatttttttgtagtatacttggaaaattagtttctgtagtttcaagttgaaaaacatttttttttctttttttaaaaatagagatggagggccaggcagagtggcttgtgcctgtaatcccagctcttagggaggcagaggtgggaggattacttgagcccaggagtttgaaacctgcctgggcaatatagaaagacctcgttctccacaaaaaaaggaaccaaaaaaaaaaagatcccaattaaaatagagatagagtctcactatgttaccccagctagtctcaaactcctgggctcaagtaatcctcctgcctcagcctcccaaagtgctaggattacaggcatgagccaccacacccaaccaagaaatttcaacattaaatctgaacatgaagacctttcccttcttccaaatggaagataaggatatatttttaagaggactatttgcataaacacccatgtagttacaatctgtgacctaggcaggaaatgccaggtacatatataaatacataggagacaattcaagatcttacctgttgtactgtatacaacattaactgactaaagtccaagggaatagaacttatctctctgctgagataggtggagttgccttcctgtcaccctaactgtgctttgaaactactattctacctacaaaaacagtcttacagtagtcaggctacggagtcattgccaattccaaccccaataatataagaaaaaatcctgtttgctttcagtctgaaatctgctggtgtcagtaacacaattatctctacatattttaaaatagcgatagcttatttcttacatcaatgagccaagaaaagcctttcttcacctatgctatcatcttctgtaataaacaaaccatgttagcgaccctgtttttatttttactttggcctctaggaagttcacgattgatttttttcactccaattttagtaactgtaggggacattacaacacactttcatgttcatctaatttgggttatagtttcattttttagttttcttctattttttcagttttcccagtgacatgaattgagctgtttgtattatttatcttattgttcacatgttcttataaaccatgttgtaattttggaggagacgaatcaatgcatacatacatgcatatatatctaattacagccagacattgattaatgcaatatccaaatttgctgtgtctcttacaccaactacaagtattgcataccaacaagtgagaaccacaatgagatactacttcacactcattaggatagttattataaaaacaacaaaaaacaggaaataagcattggcaaggacgtggagaaattgaaaccctcatgcagtgctggtaggaatataaaatggtacagccgctgtaaaaaacagtatggtggttcctcaaaaaattaaacatagaattaccatttgatccagcaattccacttctaggtatatacccaaaagactcaaatagatacttgtataatgatgttcacagcaacagtatttacagttgccaaaagatggaagcaacccaaatgttgatcaatggattatgataaacagaacgtggtatacatatacaatgcagtattattcagccttttttcttttgctttttttttagacagagtctcactctgtcacccaggctggcgtgcagtggtgcagtctctgctcactgcaacctccacctctcaggttcaaacaattcacctcagcctcccaagtaactgggactacaggcgcacaccaccacgcccagctaatttttgtatttttagtacaggtggggtttcaccatgttggccaggctggtcttgaactcctgacctcaggtgctctgcccgcctcggtctcccaaaatactgggattacacgtgtgagccaccgtgcccggcttattcagccttgaataaaattctgatacgtgctacaatatggaagaaccttgaagacattatgctaatagtgaaataagccagacacaaagggataaatattatatgattccacttatataaggtacctagagtagtcaaattcatagacagaaagtagactagtggttaccatgggctggagaaagggaggagtggggaattagtgcttcatgggtgtgggtgtcttaattagggataataaaggtctggagatggatggtggtgatggcagcacaacagtgtgaatatacttcctgccaatgaaccatacacttaaaaatggtaaaatgttatgtataatataccacagtaaaaacaaaatcctttaaaaaaaagaaaaggttcagagatgcaaaaaagacaaaaattagagttgataaaactaggatttcattagaggccattaaaaaatgatacactgggctgggcacagtggcttacacctgtaatcccagcactttgggaggctaaggtgggcggatcacctgaggttgggagttcgagaccagcctgaccaacatggagaaaccccatctctaataaaaatacaaaattagctgggcgtggtggcacatgcctgtaatctcagctactcaggatgctaaggcaggagaatcccttgaacctgggaggcggaagttgtggtgtgctgagatggcgccattgcactctagcctgggcaacaagagtgaaactccttctcaaaaaaaaaaaaaaaaaaaaaaaaaaaaaaaaaaaggtacactgactcaggttaacacattcaagaaaatcttatggcctacaagttttattctccttatcatcatgtttaatataccatattaaataaattatatggtgtgctactctactcaatgaattcagatgccaaacacttagatatattaaaagataaatgaggctgggctcagtggctcacgcctgtaattctggcactttgggcggctgaggcaggtagattgcttaagctcaggagcacgagaccagcctgggcaacatggcaaaaccccatctctacaaaaagtacaaaaattagccgggcatggtggtgtgtgcctgtagtcccagctatttgggaggctgaggtggaaggatcacctgagctcaggaagttgaggctgcagtgagctgtgactgcgccactgcactccagcctaggcaacagagtgagaacctgtctcaaaaacaacaacaacaataacgaaaaggaaaagattttcaagttactttgaaaaagacaactgtacagctaacatgacccttctctcaaagatgtaatgaaatgcttaacttattgtaattatatgtgctttagattagcattggcaagctatggctgtgggccaaatatggcctgctgtttgtttctataaataaaattgtattggaacacaaccctatccttaaaaaaaaaaaaaagaaaagataatgtgtggctgcttttatactacaatggcaaagcgaaatagttgagacccagacagtgtggctcataaagcctaaggtatttactctccggctctgttgacccctggtctaggagatgtggaagagcgcatccttgaagctcttagattctgcttgctacgtataatagttttcctatgctgaatgataacttaatttcaggactaatttttaaattctaactgttttttttttttttagatggagtctcactctgtcatccaggctggagtgcagtggtatgatcttggctcactgcaatctccacctccaggattcaagcgatttatctgcctcagcctcctgagtagctggtattacaggtgcgtaccatcatgtccggttaatttttgtatttttagtagagatggggtttcaccatgtttgccaggctggtctcgaactcctgacctcaagtgatctgtctgcctcctaaagtgctgggattacaggtgtgagccactgtgcccggccttaaattctaacatattttaaaacagtgttgtttggccgggcgcggtggctcatgcctgtaatcccagcactttgggaggccgaggagggcggatcacaaggtcaggagattgagaccatcctggctaacacggtgaaaccccatctctactaaaaatagaaaaaattagctgggtgtgctggtggacgcctgtagtcccagccacaggggaggctgaggcaggagaatggcgtgagcccgagagtcggagcttgcagtgagccgagatcacaccactgcactccagcctgggcgacagagcgagactccgtctcaaaaaaaaaaaaaaaaaaagacagtgttgtttagctgcctttccccctcttccaagctgttttccgtttaactccaatggccaaatttatgagacatggaagaagaaaatatctgatgaaggttgttggctcagctcctgacacttatatattaataatttcttaaaattccaaaagagatacaagagggtttgttttcattcattcattcattcattcagcaaatagttattgaccacctgctatgtgccagatactgtgctagctatggtggacctcgtccttgtggagctgacttctgagttaagtgaactcagttaactgaattacgcttcaaatgccaaataggtgagaattgaggtatttgtactcatggttactgaccagagcctgcttcaaaagggtcatacacctcaacattgttaacattcgtttctgataaggccatagttccccaagttaaaagcccatataccatcagaattttgcttttaaatatatcaggggtgtctggggactagtgtgaaataccatatcctgaatgttgagattcttgcttggggcagaagtgtggacagaatgaataataagtatacttcagaagtagaaacttatctgtgagcaaatcaaaatatctagataaataacacagagttccccagtttcatccattcaccatgtgacagttttaaaagggactgggcattctggtttaggcttcgtagcatgttgaataaatgcaagtctctagagtcagacagtctgaagtccaaatcttagttcctctacttctagctgtgaaccttgagaaaagccatttaacatcattaagaatctatattctcatctctaaaatgatgactgtattaaccaatgtttactgaatgtctattatgtgacaggcagagtgctatgcttgtgcatattaactcattctaatcctcacagtgtctatatggtatacgactagggtctccaccctacagatagggaaactgaggcacagagaggctaagtagattctcagttaatgagcatcagagctggtgtgtgaaccctgggagtctgattttcatcatagggctgtgatgaggattaagtaaaatgatttgtgtaaagttcttagtgcagaacctagcactaagtgatcaaggaatgttagcacaagaaaactgaacttaaggctgggcgtggtgactcatacctttaatcctaacactttggtatgctgaggcaggagaattgcttgagctcaggagcttgagactagcctgggcaacatagtgagaccccatctctacaaaaatttaaaaaattagctgggtgttgtggcgtaacacctgtggtcccagctatttgggaggctgaggtgggaagatcacttgagcctgggaggtcaaggctgcagtgagctatgattgtgccactgtactccagcctaggtgacagagcaagacccagtctcaaaaaaaaaaaaaaaaaaaaaaggaaaaaagacaataaaacttaaaaaaaaaattgaactggagggaagaatcttgccccatgtaggattctgtgtttatgggaaaacaggcaagaggttatcccagccaactttaaaccagtcagtagagaagcctagcctgtgagttctggtggagactagtgtatcagagtctcccagattcctttcatagcaggtaagctgtctggcagtgtgattctccactggtgatgtggcttatgcatccatgtgtaagcctgtttctcacctaatccttggctaaagcactttgcagaagctctcccagaaagaacatgaagagacttgccacattggatgcaaaatgtccaaccatctatgtagatgccaaatcccctgaggtaggaccctcccagcacacagctattcttcccaacactaaaaatgcatgagtcttcactgaaggctgctagcattaaataaacatggcaatatatttgaaataaatcatttactcacagttttgtatataaaacaagcagaaaaaatataccttcaaatcaagctattattattctgaactagggatttttgttatgttttagggagagtttgaacttgttgggttaaaataaaatttcaaggcaaacaggtaaagcagacatcatcaaggatttgaattctctttttagcgtttgttcagagtagctttcattaggattttaactttgaactgggacattttagagggcaaaggataccagtgtactactgggaaatattatcaatgtttacataccagtgtttacctaggatcaaaatcatgcatgagtttactctagaattaataagactaccggtccgctgcactggctcaggcctgtaatcccagcactttggaaggctgaggcgggtggatcacaaggtcaggagttcaagaccaacctggccaagatggtaaaaccccatctctactaaaaatttaaaacaggccaggcgcagtggctcacgcctataatcccagcactttgggaggctgaggcgggtggatcacaaggtcaggagatcgagaccatcctggctaacacagtgaaaccccatctctactaaaaatacaaaaaaattagccgggcatggtggcaggcgcctgtagtcccagttactctggaggccgaggcaggagaatggcgtgaacccgggaggtggagcttgcagtgagccgagatcgtgccactgcactccagcccgggtgacaaagagagactccgtctcaaaaaaataaaaataaaaaaataaaaaaacaaaacaagtagccaggcatggtggcgggtgcctgtaatctcagctactcgggaggctgaggtagagaattgcttgaacccgggaggcagaggttgcagtgagccgagactgcgccactgcactccagcctgggtgacagagtgagactccatctcaaaataaataaataaataaataagactacaagttaactttggttcacagctcttggagtgtgactgtgagagtgtgtgtgtgtgagtgtgagtgtgtgtgtttgagtgtgtgtgtgtgtttgagatgagtatgcaatttggaattcttgggagagctttatttgctgaccaactgacaaattgcaatttgaagctatatacagtggggtacagtgtcttccaatcactacctggaatttaattcagtggagggttttaaaatgtgttgatccaagagataattctatctctgtggttagatttctattttgatgttccttattcataccataaaattttgtcctaataatcacgtcttaagcatgacctaacacacacaatgcacataagagcaaaggctttggagtcagagatctaagttcaagtcatgactgtgccacttactagctgtgtctcctcaggcaaatcaccttagttccatttccacatctctaagatggttctagtaacagcaccaggactaagtgacatttggcaatgtgtggcacacaatttgtttaaaaagtttggcaattattattattactttaaagaatgccacttaaaagccatagtttgtgttttagagaggagtctctcacaaaagttcagaataacctcatggtttacagaaaaattatttgattatttggtaaaggaagatgttgccccaaacttggggtgaaggagggggtggggtaggaaatcagagagaaaaacagtttctgcaaaaggtttccaagatttggccttaccctgagcatttatcttactgccttggtccaagttaccaccacccagtagaataaacattggagaggacacgcccactctcgggcaggcccctggcaccaggatgtttctattacctcagagtttgaaagtggaaaaggagttccactcaaaatggaggcagaacatggaatttacttgggaggtcaaacaataagccgaagactttgaaacacgggctctttttttctatcacaggcagggacctcttgctactgaaaagcatggcccttggggcacataaacatctctccttgactctcctttctttaggtaaaatcctgggaggttgaagatacaagggaataatgacattccgggccatgccttctgcccacccctcgctcatctgagaaagcgttcattcataatgggtcttaattgtgttgatgattgtacagattttgttatgtcaaagcacatcattcaatgaatgcttgtgtatgataaacagatgcaaagccaagaggctcaattttcccagacgtttctatcaacacacacctgagaatgcggccttttgctgtgggttctcagggaggcctgctgtgtactacaagacggctgaagccaccctcccgaaaggggtggagtggggagattttctgcaggggtttggcagcacacaaataccagttaggaaactattatcttgttccctttatttatttagacggaatctcattctgtcgcccaggctggagtgcagtggcgccatctcagctcactgaagcctccaccgcccgggttcaagtgattctcctgcctcagcctccggagtagttaggactacaggcatgcaccaccacgcccagctaagttttgtactttttttagtagagatgaggattcaccatgttggccagcctggtctcgaactcctggcctcaaatgatccgcctgccttggcctcctaaagtgctggttttataggtgtgagccaccgcacctggccttgttccctttaaataagcattacttacactttgtctctaaaggttgatggggtaatgctgaaaccaacaaaaatgaaactcacaaattcagcacacatatgcctcccgggccaacgtttttccaatccatgaacaaacagtaggagggacttctagtttcactccttaccttggctcctttgacctaagcctttgagggatctggcaaggaacagaaaggccgactggcagacaccagaaaggaaaaggaaggagaagccacagtggcttctatcatttaacactagcttgaattcatacagtgttttgcaatttataaaattctttcaggctgggcaaggtggctaacgcctataattccagcactttgggaggctgaggcggcctgatcacctgagttgaggagtttgagaccagcctggccaacatagtgaaactctgtctctactgaaaaaaaaaaaatataaaacttagccaggcgtggtggcatgcacctgtagtcccagctatttgggaggctgaggcagaagaattgcttgaacctgggaggcggaggttgcagtgagccaagatcgcaccaatgcactccagcctgggtgacacacaagactctgtctcaaaaaagaaaaaaaaaaattatttcacatatattatctaatttcataaaatcccagaatttgagctgctcagggaatataggtgttctctaacccagggtttttgaacctcagccctattgatatttgtgataattctatgttatgaggggctgtcttgtgtgttttcagatgtttcataacatccctgtcctctacccactagatgcaaaagccccctacctccacaatgttgtgacaaccagaaatgtctccagacattgcaaatctgggggcagggggtgcgcataaaattgctttctgtcgagaattactggtggagtctatcttggagctgtgtaatatgattatatactggcacacatggtaggtactttttaaatagagaagaagttgttattttctacagccctccctcaacatgggcctggtgtcttgatctggctcttacgaatagtcaaggctggccgggcacagtggctcacgcctgtaatcccagcactttgtgaggttgaggtgggaggatcgctggagcccaggagttcgagaccagcctgggcagcatggcaaggcgcagtagctaccaaaaaaaaaaaaaaaaaaaaaagtcaaggctatcaagactgagaaacgtgcaacatttttcaagggtttgaggtaagtgtctctgtgatacaataatactcatttaatttggttgaaacactatcaatttaattttcagacaaaacaacagctaccataaaggcttgttaagaatggttctgttgtctaattgacttgtcatcacagcaaacttgacaggcctgggtcatagaaacatcactgccgaaatcagtctaaagcatccaactgtctcatttaaattccgaccccgctgctacatggacacatgagaactgctgacaatctggtttttaagacttgggctgttttcaaatgtcattactggtttcttcaataatgcaataacccttacttaaaatttacagtttttttttaaagacatactatgaacaatcactgaaaatgggcttctgggatacagtcaattcactggtactaaagtcagcatctgtacaggtctgtaggcaaaaggcaatgatgtggtaaaataaatgattaaacaatatttgcatatgaattgattcattccctcgctcattcaaacactaattgagcactggctgcgtatgaggctgtgctagatgcttggggatacagtggtggctactgcatgttccttggagttcacagtctggcaagggtagatgaagaaggaaggggaggccaggaacagtggctcatgcctgtaatcccagcactttgggaggccaaggcgggcagattgcctgaggtcaggagttcgagaccagcctggccaacatggcaaaaccctgtctctactaaaaatacaaaaattagccgggtgtggtggcatgtgcctgtagtctcagctacttgggagggtgaggcaggagaattgcttgaacccaggaggtagaggctgcaatgagccgagatcatgccactgcactccagcctgggcaacagagcgagactccatctcaaaaaaaaaaaaaagaaggaaagggaggagacagagcagagggaacattatgagcaaaggtgggcatttgcaaaaatgctggaatggtctcaaatagctgaaatgtaggaggtggatatggggcagaagatgaggctcaaaaagaaaatgaaaccagattgtgaagggtctaagtctctcactttctgtggtagacagtggagagccacgaagctttagccatgactaggaagttcaggctgagtcctcagtgaaagaatgagtagctcttgcaccaggagttttatttattcagaggaatagaaacgattttataaatttgtttatgaagtattctgctaagcaagcaggaggcctgagtagtgtttataaggggacaagagaccgaaaactcaggaattaaaagcacgagataaacctgaagttctgtatcttgtcagccttagtctagcgtccgccaggtcaaatctaccgtctattataaacatccgccttttcataatacataacactactgcagtttttttttaagccttttttctacaattagaatgtaaactttgagagagcagaatttatgtctcttcttggttatcataaactcctcaaagcttgacacttaaaagacaataaatatttgtcaaataattaaatggactgtgatttccttctttttttttttttttttttttaagacagagtctgactctgtcacccagactggagtgcagtggcttgatcttggctcactgcaaactccacttcccgggttcaagcagttctcctgcctcagcctcccgagtagctggaactacaggcacccaccactgcacccagctaatttttgtatttttagagacggggtttcaccatgttggccaggatggtctcgagctcctgaccttgtgatctgcccgcctcagcctcccaaagttctgggattacaggcttgagccactgtacccggcccatttccttcttaataacataattaatagcgataaatacttaaagattacttatttttgtacaaggcactgtgctagaaatgggtgggagggaacataaaaaaccatataagattgttcagccctaggaggtcacaaaacttccttcaacaaacattgattgagtgccaaaatgaagacagtggcttagtaaagtgcacaagcaaggatggactgtgggccaagacagacttcagggaataagccagctatcacatgtagccgaggattgaaaatctgcacatttcttgtttaattatatttagagacagatggaaattatgcagcagtagaagttctacttatcctcttacacttagaactaattatgttatcatatgccatgttattgccaatgcaatacacaatgatgttaaataattgattaagatgatgaagatgaactccattttattgaacatctttatgagtgagaccttctgctgactgtcagcagttagcaccatgagagaatttcagaggaggatactgtcccaccccatgtctagtatttctggagaagtggctggagagtgtatttcacttacatgctaagaacagagcagcgctaaaagagaatagccagcttaaatgcaatcctccctacagggaaggagatgaattagaaataatctctcttgttctttgctctcagaggtcaaatttttttttttaaaaaaagaaagaaataatctctccaagagtttccttaatgtatggttttaaaactcccaagttaatgatagttaactatttttttgaacacgtatgtgtaatttgatttctcatgacatttctatgagtggaaattttaaatgtgggctctagagtacggggtagacgcctgctggagacctgcacatttgactccctggctgttttaataaagttttgttggcacataatccacagccattcgtttacatatagtctgtggctgcatttatggggacggtggcagagttgagttaagtagcagcagagatgatacggcctatgaaatctaaagtgtttactgtctggacctttactgcaaacatttgccaacctctgctctaaagtcagatttcctgggtttgagccctagctcttcagctgtgtagctgtgtgacacattggtaaactaactatttaaaatcctgattcctcattatcgtcacctgcaaaatgagactagtaataattatcgctatctcaaagcatcactgtgaggaataaatgagatagccaagggcttagaatgaagctaagtaagggtgtgatcagtgttagctattagtgcccccttttaatttttttattatttatttatttacttatttttattcatttattttttgagatggagtctcactctgtcacccaggttggagtgcagtggcaccatctcagctcactgcaatctccgcctcctgggttcaagcgaatcctgcctcagcctctcgagtagctgggactatagacaagtgccgccatgcccgggtaatttttttgtatctttagtacagacagggttttgccatgttggccaggctggtctcgacctcctgacctcaggtgatccgcccacctcagcctcccaaagtgctgaaattatgtggtggctcacgcctggccatactgcccctttttaaagatcaggagattgagggtatcaaataacttgacccaacttacagaattgaaatgtaggtcaatctgatgacaaagccaaagctctttctaccatgatactcattctttgctacttacttacttacagcaggtttagcaatagccagtgttaacaggataagaccacgattggtgagaaatggacattggctgatagagtggaaggaatttccagtacagacacatggtaaagttgttgggaaatcattactttctaccatccccatcgcttcccctctgcactctccccaccactcttctaagctttcaaagagttctgcaaactgtcccatagcctatttctggctctttgtaaaggagttaacatattcaaactatgtttttagacttaaaaacctatggaattaaattcttaaatggaaatgttgaaggactagaattcacgtaatcgcaatgttcaagtgagaacatgggactgtgatgaggcagtgattccacgcccaggctctggagccagactgcctcgcttcctatctcttgactgtactacttgaaaaacaaatgccatcacacaagtcactttctctccttgagcctcagcttcaccatctataaaatggtgataatattatcattaacattgttgggaggattaaaaagtacctggctggttgggcgtggtggctgaagcctataatcccagcactttgggaggctgaggtgagaagcttgcttgagctcaggagttccagaccagtctgggcaacatagtgagaccctgtctctacaaaaaatacaaaaattagccaggtgtggtggctccagctactcaggaggcggaggtgggaggattgcttcagcctaggaggttaaggctgcaatgagccgtgattgcatcactgcactccggtctgagcaacagagggtaaccctgcctcatagcaaacaaacaaaaagaaacaaaaaagaaaaaagtacctggctacagtaaatgctcaaggccctttgttattatttcagatggtcaagaataaatgtttttcaaggatcttctttttgtagacaactgtgtagtcacagtttagagtcgttaattatctgcctggcaagatactttttaaaattaaaatgtaaagaacctgaggggattcactcccaaatgtttatggacaaactgaaagggcatttacacagatattaccttctacatttatgtgagaaagtgctttaagacactgtacatgtgaaatgtgtagttataatggctactactatgttctcttttatattttctaattatgtaagtattatgttctttttatcactactttgtattcctgcacgggagctttgtgcctacccattgaatgtagtaggccctaaatattgcctgttaactaattatggtgtcatataccatgttaaaattaaaatattacaattactgaagcaggtttaagagagaaacccgggcataatattcttagaaaaactttatgtgccagaagttgaatatatgaactggtagtttgatgcatgattactttttaattataaaagtcatctttaattgcaaaaaattcataatagtgttcttttagataggaaatttcctgtgttgttaagaatatgattcaagttactgagaatttatagatatatatttcctgtacatactattcctatatatctatatataccaacaatactatacaaaagtattagtcccattttcttttttttttttcttttcttttttcttttttttttttttttgagacaagggctctgtcacccaggctggggtgcagtggcatgatcacggctcactgcagcctcaacttctcaggctcaagcaatcctcctacctcgacctctcaggctcaagggatcctctcacctcagcctctcaagttgctgggactacaggtcctcaccaccacgcctggctaattttttatttttttgtagagatgaggtctcaccacgttgcctaaagttgttctcaaactcctgggctcaagcaatcctcctgcctcggcctcccaaagtgctgggattaaaggcgtgagccaacacgcccggccagcctcattttcttgatggagaaactgagaaggagggcgatcatgtgcttacttcaaaatcacaattagataatggcaaatttgtgattgtaattttataaagatgccttatctttggggtgatactttataatttaacttctttttggcagtagagttgttttatatccaaaaccaaaccaaacccagagagtccaaatataaaagatagaattttaaaaaattttaaaatttgtgggggtcgggcgtggtggctcacgcctgtaatcccagcacttttggaggccaagtggagcggatcacctgagatcaggagttcaagaccagcctggccaacatggtgaaatcccatctctactaaaaaatacaaaaattagccgggcgtggtggcctggtgcctgtaatcccaactacttgggaggctgagacagggagaatcacttgaacccaggaggcagagattgcagtgagccaagatagtgccactgcactccagcctgggtgacagagtgagactccatctcaaaaaaaaaaaaaaaacaaaaaaaaggcattttaaaatttgtgtgtaaaaggctgtttactcagggtggaatgtagtgacacgatctcagctcactgcaacctccacctcccaggttcaagtgattttcgtgcctcagcctgggattacaggtgcataccaccacgcccagctaatttttttttgtatttttagtacagacagggtttcaccatgctggccaggctggtcttgaactcctaacgtcaagtgatccactggccttagcctcccaaagtgctgggattagaggcatgagtcactgtgcccagccaagggtatttttcattcgttaaacttcttaaattttactatcacattggggattaagtttaaaaaaattttcttaaatttatgctcaaacagatttagaaagtgaactttttgctgggtgtgctgtcctagcactttgggaagctgaggtaggtggatcacctgagccttggagtttgagaccaacctgggcaacataatgagaccccacctctaataaagtcaaataaaattaaataaaacaaaataaaacaaaatgaaagtgaacgttcccaaacataaacttacagtcattataatggtgtgtgaatgctagtcttctcctcctaatttgaaactatattagtagtttgcaagtagtagttatatagtaacagtatggtctattattactgtgttatattacacatgaatacatgtacaatatgcaccttctggtggtatgtcaaatagtagtatacaaaaataacataggtctttttgtaaaacaaatgacaaattgcctgtcctgaaacaaaggctctgaaacagactgacatagtcaaacattagcttcagttttaggtgtgaccttctgcttttatttggtgaacattagtcatttcagttgcaactaggaaacaatatctgctactatagaaaaaaacagatcctgattatgttgatgtcatgttcattgaccagttatctcaaggcaataattatagtagaatagcattcgcccaggaatactctcaacattgaaaaagtcatgagttaaaatactttcttctataaatgtttaagtttaatgtggggtattttggaagctaaaaatattttcaaaatcaactatatttatgacaatatgaccatagtaggctgtttatgagaaaatataaaaaaggaagtgaactttctggtgggggatcacttaaagacaaaatgcattaaatacaactttaatccagaaaatatgtgttctttttattcattgcattgtttcaatgttgttccacctttccagctctggtgataattgtttttttttcccccttttcttttcttccttttttgggtacacagtgaaaaacaaaaaaagatagcttaaaaaacaggtccttctgcaaacatacggcgaaggttaaactctaataccccatggcttgtttactttaaaaatttggaaaagtaagcaccatgagttcattgatatgagtaggaacctgcgtcatcctgtggtatttgtgaatattgtgggctcttttatcaatttcatttgtttctaagtctttccaaagaactctattagaaatgagaccatctgagacaggtcctttaacacagaaaaagtaaaattcgccttctattatgaagtgattttagatattaaaggctctttccacttctttatgcattgtttgaaatgtcttagaaaagttaaaacaatagtgtttatagtttattttattagctacacttgaagcatctcaaaggcagtgatgcttattttatccccagtgcctggcactgaatgaatgtttgaataaaagaatgaatggatagaagaatgaatgaatgtgcactgtcttttgcaagaaacatggtaggacaaagctacaaaaagagtttccttttataactaacatccaccaaattgctttggacatttttttcacgtatctatttactaagttttgtgggagagccgtgcatgggggtgcatgcctgaaatcccagctactggggagggtgaggtgggaggattgcttgagcctaggagttcaaggctgcattgagctatgattgtgccactgcactccagcctgggcaacagagcaagaccctatctctaaaaaaaattaataataaaaataatttaaaaaaacttttgtggtttacctgcatatagaactgggtacaaatagtcatacccaggtactatctggtggtatttctgcatggccgaaaggagcccatcagagaatgaataggccagctttggtacaggagttggcatttctttctttcttctttctttttttgagacagagtttcattcttgttgctaaggctggtgtgcaatagtgtaatggcgctatcttggctcaccacagcctctgcctccgcctcccaggttcaagcaattctcctgcctcagcctcccgggtagctgggattataggcatgtgccaccatgcctatagctaattttgtatttttagtagagacggggtttcaccacgttggtcaggctggtctcaaattcccaacctcaggtgatccacccgcctcggcctctcaaagtgctgggattacaggcctgagccaccacgcctggccaggagctggcatttctaacacatgcccaggcatcaggaatgtcacatggaaaagccacaccaacccctaatggattatattgaatgccaatgttaatatcccttgagccgtcttggtaaagtaggtactggccagggagctataaaatttccatcactgttttttttttttttcttttttcttttggccttaactgatatgcttagcttctgctatactgtctcaggaattcggtagagattttatgccacaaggaaataggcacataaatgaggcctgcccatgaaggcagtttttaatcactcttttatctgaaggtattttgagaggctgcttattacagtgcttgagctcgagctcctgcatgccagagctcaaccgcttgagttcaataccatttattaactgtgtgacttcaggtgagtgacttactctcccaagcttcagttcactcaactggaaaatgggaatagaccgggtgtggtggctcacgcctgtaatcccagctacttgggaggctgaggcaggacaattgcttgaaccaggaaggtgaaggttgcagtgaggtgagattgtgccactgcactccagagaggctgaggcaggtggatcacctgaggtcaggagtccaggaccagcctggcccacatagcaaaaccccatctctactaaaaatacaaaagttagtcaggcatggtggcaggcgcctgtagtcccagctactcgggacgctgaggcaggacaatctcttgaaccccagaggcaggtgttgcagtgagccaagatcgcaccactgcactccagcctgggtgacagagttaagactctgtctcaaaaaaaaaaaaaaaaaaaaagatacttattaaaagaagaaggaagagaaggaaaatcagttttcccagtctctataattaaactaggcagttagagacaattggaaattcttacaaatttaaataaaaagcacaactacattaattaaagaaactcaagaaatatgcacttaaattaagaatggaaatgaacagaaaatacatatctagagtttcactgaacctagagtatttaaaatgaaaaattcaggtgtcaggaaatttatgatttcccaggtctactaaactcctggaacaattgttggcatttaattgctattcatgtctcgcgtactctgtactttcactgagtgcacttggagttaatatttcaattaaaaaactaatacatcagtaaaaacgcccagatttgagctaatcatttattctcaggctcacagggaaatactggatattcttcgagttaataaagtgtgaaatgattttaattattcaagggaaatatagtataccagtcttgcaaatggtttttttagacagcatggtctgtcttatcccatcctacatcagaaaatttaattggcttagttatttcctctttcccaaatccctttttatggcaaagagaaaatgaggacctacagcagcccacgttgctgaggacctaaaccagtccctgtgaaaaccaaaacagggatgggctggatttcagtttgtttctcataggttccgaagtcagagttttaaaagatttaacaggctgggcacagtggctcatgcctgtaatcccagcactttggaaggctgagatgggcggatcacctgaggtcaggagttcaagaccagctatggctaacatggagaaaccctgtctgtactaaaacagaaatacaaaaattagtcgggcatggtggcaggcgcctgtaatcccaactactcgagaggctgaggtaggagaatcgcttgaacctgggaggcagaggttgcagtgagccaagatcgcaccattgtactccagcctgggtgacaagagtgaaaactccgtctcaaaaaaaaaaaaaaaagatttaacattaatttatttggaatttggacagccaactgccaatgtcaagcattccaatgttgagagcctaatacagaatcttgttcatgtggggagacctctgagaccctgagttgcattagcatggcactactgtcatctccaagcccgtcagagaacagcgcccgtccagtgcagacatttgaagctaggcgaggcgggttacacagcctggggagtctttgtacttttcaatattctccaagggaagtctagacaggcttcacattttgttaagtacagctaggttctgtccacaataaaacagaactaggacaactgttttggaaacatagttagcacataattgtagctaatttagtttttttctctgaagcagcatgaaaagaaatttgtttttgtacaaaagatgtttttatcttctatagcccacaattcccaacaacagagtgtcctctctccttccctctgctgcaaatatatgcacctacataacacccacatgcacgtttttttctagcctaagccactatctacccctgctgttctctttttggggatttcttcaagcatatttacaaaacacttgctgagcccaactgccgcctcactgctgtatcctagttacatgagccatcagttccccaaacgcttgctttcacctgtctgttgggaaaccacctaagcctatacgaggaagaaaaatcattcagaacaaatgttggcttgaatactcatgtcgttttcttaactgcttgatacaggctttcaccgagatttggtgggaatcaaaagtacatctttaaaagaatcctggcctttaccttacactatatataaaaataaactcaaatagatcaaagacctaaatgtaagagctaaaactataagacttggaagaaaatacaggggcaaactttcatgatactggatttggcaatgattttttggacaaccccaaaagcacagcaacaaaagaaaaaatagataaagtaaacttaatcgaaattaataacttttgtgcaccaaaggacactgtcaagagagtgaaaaggcaacccacagtgtaggagaaaatatgtgcaaatcatgtctgataaggaattgatattcagaacatataaagaactacaactcaataacaaaaagcaaacaagctaatttaaaaatggtcaaaaaagttgaacagatatttttccaaggaagatatacattatacatccgcaaagatatacattatacatctgcattacacatctgcaaagacccttgaaaaaataaagaagacacacagatgccccttaaggacatgagaagatgctcaacatcattcatcattagggaaatgcaaatcaaagccaccatgatataccgcttcacactcactgtgatggcaattatcaaaaaaacaaaaccacaagtgttggtgagaatgtggagaaactggaacccttgtgcactgctggtgggaatgtataatggtgcagcttctgtgggaaaaagtatggtggtgcttcaaaaatataatcataataaacagaagtaccacatgagccagcagcttctcctgatgcacagtgcaagaaatgaacataagtggtaataataaatattcagtgaatgaatgtaggcctcacatatctttttcccatagagagattgaggttggtaagtaataacagatctggtgacactgtcttctactttagagacctgatattggctagaggtggggtaggtaaaggggagggaataggcttttattaggttggtgcaaaagtgattgcagtttttgtcgttacatttaatggcaaaaactgcaattacttttgcaccaacctaaatattttttgagtatctataaaaatatttctggttttaaaatcttcctaaattggtaatacagtttttacatgtgccctgtgaaacgcacattgccatatatgatgcgtggggataggtgggaaggtgggtaaaatttgctgtttctgaaagagttggacaatatcaagagctttacagtgttcattagtcaattctcattagcccaatgattccatttatagacatgtataatcaaatacccaagcaaagatttacattcaaatctgtttactgaagttctatttataatacaatgcaatgaacataatagtatatatttacacgtaatgtaataaacacaaatattcaatggtataaaaatggtcaataaatcgtggcatagccacagcttagagtacctgtttaatgttctcagctattttaactttgctaaataatatttaaagatatgcggtagtcccccttcatctgaggaggacctgttccaagacccccagtggatgcctgaaacctctgatagtaatgaaccctatatatactgttttttcctatacatatttacatatataatacatacctatgattaagtttaatttataaattaggcacagtaagagattaacaacaacaataataaaatgtaacaattatagcaatactctaataataaagttatgtgagtgtggtctctctctctgtctcaaaatatcatactgtatgcctctattttgggaatacagttgacaacgggtaactgaaaccgagaaaagtgaaactgcagatgggggctgactactgtatatgaaaattaaacaatcagccaggcatggtggctcacgcctgtaataccagcactttgggaggccgaggcgggaggatcacgaggtcaggagatcgagaccacggtgaaaccccgtctctattaaaaatacaaaaaaaaaattagccgggtacagtggcaggcacctgtagtcccagctactcgggaggctgaggcaggagaatggcgtgaacccgggaggcagagcttgcagtgagccgagatcgcgccactgcactccagcctgggcgacagagcaagactctgtctcaaaaaaaaaaaaaaaaaaaaaaaaaaggaaaagaaaattaaacaaccaaacaaaatcagagtaaatacaccatgttaattctggttatatttggattgtgggcttatgggtagattttgttacatttttctataatttccagatttccttccattagtatacttttataagaagaaaaaaattacaattaaaaaaattttgctctctgagtccctgaattcaatggactaaatccaaaacccagcctagggaacatgaagacaaagtacctattttctctcgcagggattattgggcacatcagtgtcgctggcagcccctccctgacacaccaatatctactgcctccaccttctggagctatgtgagggctggggtccaaggtcagggtgaagctaatctttctcctatcttcccttcctagcacacacaagattatcgtccatagaataatctcactcactagatccatagaaagatctcagctcagcggggcactgtgcctcatgcctgtaatcctagcacatgggaggccgaggagggcagattgcctgagctcagaggttcaagaccagcctgggcaacacagtgaaaccctgtctctactaaaaatacaaaaaaattagctgggcatgaaaattagccgggtgtggtagcgtgcacctataatcccacctactcgggaggctgaagcaggagaattgctcgaacccgggaggcggcggctgcagtgagccgagatcgtgccactgcactctagcctggtcgacagagcgacactccatctccaaaaaaaaaaaaagagagatcttggctcactgcaacctctgcctccttggctcagtcctacttggagaagattaaatggttgtcaaagtgcttttacatatgttgtggttctttggatcatcatgaattgggatgacagttatttttacctcatatgacaggcaaggaaacagaaacttagagaaggtatgaggattgatcaaaaatacaagatactatcacactgaatcctagtctagtttgtaccaagaacccagcctcgtgtcacacaatcaaaatacagtctgactgaaacatagttgactggctgggtgctgtggctcatgtccgtaatcccaggactttgggaggctgaggtgggtgaatctcttgaggccagcagtttgagaactagcctggccaaaatggtaaaaccttgtctctaataaaaatataaaaatcagccagatgtggtggtacacacctgtaatcccagctactcgggaggctgagtcacgagaattgcttgaacctgggaggtgaaggctgcagtgagctgagatcgtgccactgcactccaccctgggtaacagagtgagactgtctcaaaaaaaaaaaaaaaaaaaagaaagaaagaaatacagttgacctcttttttgggaggttaagggtcagatttataagcaacacatagttatatcttgtctcttaagtcacaaagatgtaaagtgtacaaagacataaaggtttatattgagggttccaaatgacttatcacgttctatattccactaacgttgccacatgaacacacaacaggtacacattgtctaagtagcaggtatcttggttgaaaggaatgaaaacttatgttcttgcttaagtggaagggaaaaggaccagaggaagtatactcaccaaaaccactaatttgatttgtctggtcctttataagtcgcagaacgagagtatacaggcaaattcaggcagcttccttgggattcctctgttcaatttttgcagtgccctttgaggcaaatcctaagggttaaaaaagaaatggttagaaatattttctatttcaacatgattttcatatgtgcattagaaattgggggggggggggcagatcctcttgcgtagttcctaagcataataattagaaactggggggccattttcttcaaaaaatgaaataccattactctaattatcatgttctctataaaccaagtgcaactgcttatctgattcttaaagaaacaaggaacagtaataataagaaaatgactaatttcttccatttgtgtttgtctctatgccttcttcagagtgtgcatgacttcaagatgcacataatgtttaagaaggaatacagatgtagcctatattttacacttatagactcacaaaaagaggtagtatcctttacagaaataatcatatctagctcatggacttcccagccaatttgggagcttatgctacacatcactaatagatcttcaaactcttcctgcagggtccagagagggttcccaaaaccattgaagcaagtactccagctatccactaccaaccagagttggtatgaaagagacttactgttctgcccctaaaatgtagaggtaagactcttttttttttttgagatggagttttgctctgtcgcccaggctggagtgcagttgcgtagtctcggctcactgcaaacgccacctcccaggttcatgcgattctcctgcctcagcctcccaagtagctgagattacaggtgcccaccaccacgcctggctaatttttgtattttttagtagagctggggtttcatcatgttggccaggctggtctcaaactcctgacctcaagtgatccacccgactcagcctcccaaagtgccaggattacaggtttgagccactgtactcggcagagtcaagactcttttgaggatgttcatcgcatggagaggcccatgaaaaatatgatttgggggtttagaataatctttaataagtaatgatataggaaatattcacatgaaaagaatttaaagttcaagataaagatatttcagatgaggaattaaaatatatcttaagcacaaaacttttatttttatttcaatgtgtggaaatataatctgcctgattttccaaactacagagagcccccatcaagccaactgaagctccaaataacttatacaagattcaatatggcacagtggtttcaacaccagactgggaaccagaaggctagttttaaggctatctctgtcatgcccagttcatttcacctgtctgagccaaagtttactcccatggaaaaaaaataataaaggaggccaggtgtggtggctcatgcctgtaatcctagcactttgggaggtcaagatgagtggatcacttgagatcaagagttcaagaccagcctggccaacatggtgaaaccctgttaccgctaaaaatacaaaaaattagctgggtgcagtggtaggcgcctgtaatcccagctactcaggaggctgaggcaggagaatcacttgaacctgggatgcggaggctgcagtgagctgagattgtgccactgcactccagcctgggcgacagagcaagactgtctcaaaaaagttaaataaataaaaataagaataaaggagttggattaccaatagttctcaacattaaaaaaaaattgtgtttgttttttctttgtgttttagttgtagcacacttttttccaccaaaaatctaactagttgcagaaacaacaccaataaaacagttgctggttgaagtataggtaggggatgttgtcgggaggtgcccccacttccatcattcattgtgtccctgtggagacaccgtaagacctttaggactccatagagcacagttggaaaccttctggattaaatggcctttaatataacttatagctcaaaattattctgccataactatctttatattggaatgactgggtgctcagtgagatccataacgttatgggaacacagcaataatactttaccatgatctagttttaatcttgttaacaatgatctcctgaaagaaaaaaagccacaccctcaaataaattacagagcaatagctgttaaaatgatttacgttttaatacacataatctttacccaactctgtgaaaagataattcctgaaatgctgcatcctggataatacctagtaatcaagatcatagtggttgataaaaactacgaaaacgaatgtacaaagtacaagaaggtgtgtcttgaaattaattgtacactgtctggacaatagactcctgcatctctcatctactagctaagtaaatccagacaagtatattcaactttcctgagcctcagtttccacctccataaagcagaaatcattcctggcaggactgttgtggagaacagagaaaatatttataaagcaccattctcgacatatattatttgtgcagaattttgagttttcactctttctgtaatggtaaaatgtctccctttaaaatgtaataccaaggtaatgaacatgtaaactctaagaattgaaagcaaattattaatatataaatgaaacacagaattcacgtagttttgtgctacatcataaaaagggaaagaaggatcacagatgtgcctttcacggctattcaagtaacacaggacatttccccaaaatgaaacacttagggtcaatgtttgtttccagaaaaatctgactttccagaataactccaaacacaatccattccataattttttttttttttttttgagatggcgtctcactccatcccccaggctggagtgcagtagcctgatctcggctcactgcaacctctgcctcctgggttcaagcgattctcctgtctcagcctcctgagtagctgggactacaggtgtgcgtcaccatgcctggctaattttgggaggccgaggccagcagatcaaatgaaatagattgtgtttggagttattctggaaagtcagatttttctggaaacaaacattgaccctaagtgtttcattttggggaaatgtcctgtgttacttgaatagccatgaaaggcacatctgtgatccttctttccctttttatgatgtagcacaaaactacgtgagacattttgtatttttagtagagatggggttttgccatgttggccaggctggtctctaactcttaacctcaagcgatctgctggcctcggcctcccaaagtgctggggttacaggcgtgagccaccatgtgcggccagaatatttaatattgttatgtttgccataaaaatcttcaagcaaaacctatatgttatgtttgtcctgtggcttcacattcctcctgacacaatattggatactccagagaacccagtttgagaaggttagttccagtccaaacctttgattttactatggaggaaactgtcttaccaaaggtcacacagtaggtaggaaacatagtaataagatttgtggggcagtttctggagaaacggggtggtttccagacattaatggcgttaattcattccagctccccccgccccccagcctggtaccctgaaattgcatagacatcactcaccccatcatggagtctttataaagaccaaatggggaaaagtttatagattccagtaggaggaaagctatactgacagaacaactggtttgttttaatgttttggggcatgtgaatctcacagccgctcatgactccgtcttcaacacatggggggacttgagggcaagcatttattggatgcttctggcatcatcttagtttgcctatcttgatttttttgccccctcttctatttgtgtcttgacgtgtcgtatgtagttttgaaagctgtttcaagtccatttttggaatgaagcatagcatacataaaacacttgaaattaatacatttatttttcggaaaaagatgctccagtctaatatcaagtcatgtcctgttctacttctctcagtcataaagctaagctaaaaataactttctcaccacaaccctccaccaaggaatgataattccatttcttaaaaacagatcctttcttttctttatttttttaagaggcagagtctcgctctgttgcctaggctggagtgcagtggcgtgatcttgaatcgctgcagcctctgcttcccgggttcaagtgattctcctgcctcagcctcccacgtagctgggattacaggtgcacaccaccacacctggctaatttttgtatttttagtagaggcagggtttcagcatgttggccaggctggtcctgaacgcctgacctcaagtgatctgcccactttggcctcccaaagtgctgggattacaggcgtgagccaccgcgtctcgccagaacctttcttaagataaaccaattgccctcacccaaggatgctagtacatggggtcctaaagctgccaggagaccaccaggttgagagtcaaataactaagttctagttctcgctttgccacctgaacagtttgaccatggcatgctacacaactttctgagcctcaggttgttacccgtacactgaaagatcaccattataaggattacacaagacacaacatttgaaagcatctcctaaactaaccattagctcctgcctggacttctacagtagactcccagctggcttctccctatccactcaggcctgctgcaatcaatctaggtctccttacaggcaaagggaccgtttaaaaaatatacaatttggtcaggcgcagtggctcacgcctgtaatcccagcactttgggaggccaaggtagacagatcacctgaggtcaggagttcgagaccagcctggccaacctggtgaaaccccatctctactaaaaatacaaaattagccgggtgtggtggcacacacctgtaatcctagctactcaggaagctgagacagaattgcttgaatccgggaggtggaggctgcagtaagccgagatcgtgccaggcactccagcctgggtgacaagagcaaaactccacctcaaaaaaaaaaaaaaaggaagcgttttatcacccttctgcttaaacccctacactctcctcccattgcccttagactaagtttgtatcctttgtaaggcttgtaaggcctataaagaggctccacgtcctcctccagcctcatcttgtgttacttcccccttacacatgctgttccaatatttcagccctcaccaattcccatctagccagcttgcactcatcccgaacttcattccttctacaaagctattcctgcagccccctgtgatatgctcccccaacatcatataatccttcatatagcactaggttgaaccatatgaaattgctattttataggacaaaaacagtagactgttgacaattttctttggtttagccttatagtaattgctgtaatgctagtcatcttgagtcagttttaaactctaccagggaagaatctagatctgactcataactagaatcctagagttccacacccaatccaagccaatagtaggcacttaattttttaattagtctgagatgttgttactacctttttaatgccaagcatataaattttatatcgtcattaatagttaaaaatagttttttgtcgggtgcggtggctcatgcctgtaatttcagcactttaggaggccaaggtgggtggatcacctgaggtcaggagtttgagaccagcctgaccaacatggtgaaaccccgtctctgctaaatacaaaaaattagccaggcatggtggcgcatacctgtaatctcagctaaggcaggagaatcacttaaacctgggaggtggaggttgcagtaagctgagatcacgccattgcaccccagcctgggcaacaagagtgatgctctgtctcaaaaaaaaaaaaaaaaaatcatgtttttcttcaaatgctattgatacattccataggactaaaatgaaaaaaatggaatgaaaaagaatcactttcatactttcatttctggcatttctggaaagcatgaattctagtaagtgtaatatatatataaacaagtatagaatttagcccactggtaaggtatcatttatggattttttttttaaactcaaatgtttttcactgcttggcagaataaaggagctctcaaaggaaaccagataatttggatttatccccttttatagtttttgccatgtgacagcaaatcagctaaagaaaaaagatagcatctaaaagagtgctagacttgaaatggaggaattttataagcttccccatgacattcaaaagaaatgcatcctgaaacattcccaaatcaccttatcctatgccacatccaacgatgtccctcatgaaatgaacacagccaagaccaagtctaaaccaaattgagatggtatatgtggtaggctaggtgaactcacaacctaagtaacataataatattaataatagtaatgaccatcaacattcattgaatgtttatcatgcaccaggtatggcactaagcattccacatacatcgtcttatttaatcattgctacaacctcatgaagcaagatctatgatgctactcattctggagatgccagaactgaggtataatgaggctgcccatttgttaaggtcccttagctggaagtgaagaagctggggttcaaaccccaggccttctatggaagaatccaattgctgctgcactccaatctggaagagtagaaaactgaaatctgtgctataacaaaaatgacaaatgattctatatgcattatatattacagcttcagagtcaacatgaggagttaaacctgaatggcaaattcatgaattgttaaggcctaccaggtaggaattttttcaagaaccccaatattcagctttaaacagtaaatgatattctcaacctaggttagaaatatagataggagttcaactttttgggtgacgaatagagaatatcagataggcataaatatcatgggctcagaaatatctggtgttctgacttgtttcctagcttcttaaaaaactatcacactttagaaagtttttgaggactcagagaccccacaaaatgagtaaacaaaactgcaatttcactttctactgcttagttaataatctctaatcagacagttgtttcctgctaacacctaacaaaattatccacctctttcaaatagcaaagaaaatgaacatactaacattcttacagtggaaatataattttacaaataaacacaaattactgaatctttacatatgattcacagatggtggtgatgagattatcatgcccctccccactccgtctttgtgcactgacatttgaccctttttataatatgcaccttgtaccagtgaaacctaaggcaccagttagttactcattaaacttgggtgctgagggctgacttgtacaaattacgctgttaactgcccagcctggcctctgtgcagaagtggaaaaaagcaatcatcatagctgtgaaattctgtcatatcggcagaattgaactacaaattgcagcaattcgtacctgacctctgatctgtgaagttagtctaaacctttgaaccttagcttggaaccgagaagcagcactgacttatacaggacaaggtggctagcaagcgttctccatcgtgaatagttaacactgtgactgttggtcgccccccacacccacctcccccacagagtcatccagagtaaaagacacaaataacgatgatcttgagaatggcagacgtcttacaaaaaggcatttggaacaaatctaatacaagtatacaatttcaggatgcaagtctttttaaatgaatatgtcaaaataagaaaatggaatctgcaataactgaaattcttggatatttaatactttgtgatatgtacattaaaaaatttcctttacaaattagaccaaagtagagttcaaaatgaaatatttaaatacatttttaatcaaatggtgccatctctcatttgtcacattttaaaataaacatattacctaatctctgttataaaatacaaacccatattaagccacctttggcaaaaagcaatcagggaaaaccagttacacttttctttgaacccaaacttatcttttgacactaaatatcagatgtaggctaataaaaagtataagaatatgcatttctcacatatacattttgttgcaacattgattcatcataatgagaagggagaagggttaagagagaagagtatttttctttaaaagattagcttctacttcaaatgctattcaaattgctccactgccagacagaaatgactaaagattctacttctctggtcatttgagttaatattaaaacaaattttgaatagcatataaaatataactaaacaattatttataatgaaagtgaaactaatgttaatactttaaagcatataatctacacctaaataattccatttcataaatttaactattggtttgaaaacaatgataaaagtcttcttatacaagaactttactctgagaggaaatgtcatcattgtcaacctttatatgctaattatcataaagctaattccattaatttttccttattttaattatcacatcttaaaattataatttccttctctaaacactgactctgaaatggctttaaaaatcaaatatgggcaacactgctgataaattcctgcttcttaccccatagtttaaataacaggaaactataaaacaacaacaatactgtgaagatctagatttttcaagcatataaagtgaaaagctgttagaaaaactcattttttagaaaatgtttttaacttaagaattttggttttactgctggtaaggcagactgtgcagcagttgaaattcttaccaacttccaaatttttttgggggggtcttcaattaaaaaacaaacaatatggatcatttgtttatctggtctgatctaaattgctttaaccaaacacagttacctcttcttctcttcatttaaaacaaataaggtttcccctacctttccaatcttgatctgggtgcgacaggctaactgtaatgaaagctttgcttaagcaaccttcgctcccaataccaggagctgtgtaactctgttatacatggcacagggctcctcattggtcaacgaaatgagctttggccacttaatgccttgggagtcatttgctaagggcacctggaatgagcttgagtgggtggtacagaaagaagggaggtgttaaaactgccacaaagataatgctcaacagcaacctgaaacggaatggaaaccctactgtaactgatggatttggggaaggctcaaaagctttgccacttcatagaggacatttaacagaaatattttattcaaacccaaataacgaccgtaaggaaacaaatgatttttcaaagtccaccatcctagaaccagatagatgcccattacatttgtacagctacatgcagagataaaaaacaataatgcccaccttgtctaggctgttgggattaaataaataaatatacgtaaagtgtttagaaaagctcctggcatatagaaagtactcaaaaagtgttactaggatttcttagaaatgttatatttttagcaagtgttgctttttccccttctcattatatctggggtaggtaactttggttaagtaccctgtgtctaaaagactgtcaacaatcatgtttatgatgatcagtctgggagaaaaaaaataggaaaaaattacacatgaaccaaaccctcaccttattttactttatcagtttggagctagaaattgatttactcataagaagtggagacaagtagaagaggcatagaatgaaagagaagcaggcagtacagcaggatttatggtaataaaaccatctgtacacaacaacagatcaggaggacctgaggcacttaagctgagtaaatacactccttttcaggcagttatgggatggaacctcatcgaaagtctctctggaggctgagtttgtcagttcaggcaattgggaggttagaggaaaagggagctgaagttgcctggaggaggtcctgaaagcaatgtgacttctgtgtcctctgcatcaggattaaagtgagctctgcagcacatcaagagaggaaggagaaactaactcctcctaaaacaaaaatttcaaaaaaatgtggtccccagttttccctgagtcatcactgtatcattgttaagcttattcagttaaaccttagtaactggaaggagccagagttggaagtaaaaagaccagaatgggccgggtgtggtggctcatgcctgtcatcccagcactttgggaggcggaggcgggtggatcacttgaggtcagaagttcgagactcgggcgtggtggtgggctcctgtaatcccaactactcggaaggctgaggcatgagaatcgctagaacctgggaggcggaggttgcagtgagccaagatggcgccactgcactccagcctgggcaacacagtgagactccgtctcgaaaaacaaacaaacaaaaacggccagaatgacgacaagaacattttcaatctattcatctacgcatatattttttaaaaagacagttttattactcctagatagaataatagctatcgacagtgactataaattatcaacaagttaacatagggtcaaaatccaaaacaagtctaagattataactatgttaaatattatataaaactaaatcgctatgttctggctgaaggaactctgaagcagtcagttactaaggcagtgttttcaaaatctactgatttcagacaaatttaaattcctctcgactacaaatgggactcagaaagtctgtttttctataagagtaatttagtatattatataagaaaaagttctggcatgttttaagcattagagagtattctgagattgaggtttggtgtgagtgtgtgcacgtgtgctcctataccaaatgctaccaaaaaataacttaggcaaaaacataggaaataaaccatctcaggatgatgaattttaagactaagggggtaaggagagagcaatttttcactgaatacctgaaaacaacaattacaattatgggctgccctaaataaaaaatgagcaaatttttcctgccttggctttgaacaaagttaatttaaaaaatacatgcacataaacatactagttttaacaaactcaaaaaatatagaaaagtacacagaaaaagcaagtcaccccttctactgatagtaaaagtggctcctactacacagccctctgtataggcacgtgtgcatcacagtagaaaagtcatgccacatgagccatgtggcatgttctttttttttttttttttttttttgagacagagttttgctcttattacccaggctggagtgcagtggcgcgatcttggctcaccgcaacctccgcctcctgggttcaagcgattctcctgcctcagcctcccgagtagctgggattacagccatgcgccaccacgcccggataattttgtatttttagtagagacggggtttcaccatgttggtcaggctggtcttgaactcccgacctcaggtgatccacctgcctcagcctcccaaagtgctgggattataggcctgagccaccacacccggtcacattaacttctgtatagctctggcttgcaacaagcttaaatcatccctggaggagtgatcctttgtcttttacaaagcatctttgatttagagtagagtgacagcaggcagttctgaggtctgaggctgtggagaaaaggaaaaaaaagtacagacgcaaaacagaagcctgggatgagataagctctgaggtagatttggaaaaaggggtaagaaacaggactcaggtccaggagaggaagaaatggagcatagtaagacatgattatgtggcctatttcagataggatctattaaggccactgtggcatcctggtaagagagttattattattagttattactttcttatttttagagacaggtcttgctatgttacccaggctggtctcgaaatgctaggctcaagtgatctgcctgccttggcctctcaaaatgctgagattagacatgaacccccatgcccagcctactttttagtttaattatctaaaagctaagatatagccaatgcaaagattatgtgtgtatttgcttttgtatatagtagtagcatatcattttccacaagtatatttgacactatttagaatttcaagcctttgctgaaactgtttattgtattaacacatgactaaagcataaaagaaattgcacatatgtgtgcgcatagacattcagatggtagccttcacctgaaaaggtgtcaaacactgataatgaaatcacataactgtattggtggtatcagcaataatagttggctaagaagctaattaaccagtattgaaaaacagatgaagtataaagcagtatccacaagcctatatgattaaagcaccatagtattttctttcggttaatttgtctattatcctattatagcatcaacagtcacagagaaggaagaattaaacaatggacattgtcatatctgaaatgagtgttccttatctggacattaggaaggatctgtgggctgtccttttaaaatttaaaatggtaggctggatacagtggctcatgcctataatcccagcactttgggaggccaggacaggaggattgcttgagcccaggagttcaggaccagcctggggaacatagtgagaccccatctctacaaataataaaaaaattagcagggcatggtgacatatgcctgtggtcccagctactcgggaaaattgcttgtttgagcctgggaggttgaggctgcagtgagccatgactgcatcactgcattccagactggatgacagagtgagatcctgtctcaaaaataaataaataaataaataaatatataaatataaataaaatggtaccttctcaattggcatccttggtttatttactcatttttgttttgtgatagagtctagctatgttgctcaggctggtctagaactcctgggctcaagcgatcctcctccctcagcctcctaagtagctgggactacagctgcaccattgtgcccagaggtacaactgttttaaagattaaaattattcatcacatccacctgtaataaaataactatagctaactcctacatacagcccttgtccttcaccaggcactgttctaagtgtttcgcatatattaacacaggcaacccccatacataggttgaggcaggtactagtatcatctccatttttttttttttttttttgagacggagtcttattcttgttgcccaggctggaatgcaattctgtgatctcagctcactgcgacctccacctctcaggttcaagtgattctcctgcctcagcctcctgagtagctgggattacaggtgtccgccaccatgcctgactaatttttgtattttcagtagaaacagggtttcactacgttggtcaggctggtctcgaactcctgacctcaggtgatccatctgcctcggcctcccaaagtgttaggattacagccgtgagccacgcgctcagcctcatctccattttatagatgagaaaacaagaaataaagtaattggtccaagaccaacagccagcaaataagtagtggagtgaggattcaaacccaggcattctggctcttagagatcacactttaccgcctcaagctaagtagataatcttctttctttcctcctaattagctacctctctacctacctacccatgtttcaccttgctgctctgtcagcctgccagggacaggaacttctgtactaacccagaaaaactttggaactttgagatggcatctttggagctaagtaggaaaccctttaatgttcaatgaatgaaaccataagttaagaaagccacaaaatctaatttgaatctaaagagaattctctttgcattttctctctaagcccttcctctacccgaggcagcactcttcattaattcttagaaacctgctagattttatggcgatccctttctgtctgtccctctaacacagcaaaatgtagcatctgataagctaagtaattattagtatttacctaatagattctgtggtagttttaacagacttcttaatcttaaaaagagaaagttcagaatacatattgaatgctggtggagagaagacacctattaccaagtcacatatcatgtgtaacattatagccctttcttccacttgtgctaaggaaaagccagctacattgtcataatatgaaaagtagatatatttcctcctgagccaggaggaacaaggcagtcaggttaacaagggctcaggaagtgtgtggttttgccaagtattttgtgagttttactctttaataatcaaatgatattttaataatttcctcaaaattgccacaaaaatcccctaacattctggatttatcaagtactatgctcttccatttcaactggtgtttaagtagcactttctataatatcccgagatgtactcaagccctggggaagtgcagtcaaagacctggatcatatgttgtttctttcttttttttttttttgagatggagtctcactctgtcacccaggctggagtgcagcggcgtgaccttggctcactgtaacatctgcctcccaggttcaagcaattctcctgcctcagcctccagagtagctgggactacaggtgaatgtcaccattccctgctaatttttgtattattattattattattattattattattattattattatttttatttttatttttgagatgtactcaagccctggggaagtgcagtcaaagacctggatcatgatgtggctttttttttttttgacggagtctcgctctgttgcccaggctagagtgcagtggcatgatctcagctcactgcaacctctgcctcccaggttcaagcaattctcctgcttcagcctctagagtaaccgggattacaggtgtgcgccaccatgcccagctaatttttatatttttggtagagacagggttttgccatgttggccaggctggtcttaaactcctgacctcaagcgatccgcccgccttggtcttccaaagtgttgggattacaggcgtgagcctccgcatccagcctttttgtatttttaatagagatggagtttcgccatgttggccacgctggtctcgaactcctgacctcaggcgatccaccggcctcaacctcccaaagtacttgtgattacaggcatgtgccactgcgcccggccatgatgtggtttctattaaattacaggtgtgagccaccgtacctggccatgatgtgatttctattaactgggagctaataatcctcttggagagatcattaaatgtctgataattacaacatatagaatacacagaaatggaacagcatgtgctatccagacaatgggagccaccacaatcaggtgaagagtattgctaagacagatcagagtccatggggaaagcttcctggaggaggtataactagcctgcattcccttttttatcttatttttttaattttttgagacagggtctcactgtgtcacccaagctggagcacagtggcgcgatctcagctcactacaacctccgcctccccggttcaagccattttcccacctcagcctcccaagtagctgggactacatgttcatgctaccacacccggctaatttttgtatttttagtagaggtggggtttcaccatgttggccaggctcgtcttgaactcctgacctcaggtaatccacctgcctctgctttccaaagtgccgggattacaggtgtaagcacctggcctagcctgcattcttatttacaattgcatcaggttacaaacagaggcaatcacaaaatcctacacttcaaaatatgtattctctgtatttgtttactttgtgatttaaaaagtaaaacacctctttcctgaagaatgttccttatttcaagaattgagtattcctaaaattggaataaaccttagacatattttataatcagccaagaaacggaaatttttcaggagcttgataagctagcaagtaactaaatgagttatgtggagtctaaaaatctttgaaaatttttcttcttaagaccttgtggttcagttcttatttaagcctagttacctgttcaacatattattttaccactttgaaaagggagctcttattttttgaaaaataaaagtagatattctaaagaaatttgaaagcaatatggaaataattgaaatcattcgaaaaaaatcaaacactaaaactttagctgcgatggatctataaatactggttacgctattaatgattacaggtgaaattagaaacacgagaacatctttaaaaggtcaactccaaggctgatcagtttagacgggatgctaaaattagcgaggagtataagctcaggaaaaagaacaacataaaatgctagtgaagcaaatcgtttcgacacaatgagcctgattttccatgagcaaatggtaacttggcaaggcattcaattttgaattggttgcaagagtcactcaatcgttcaacaatggctattgatcctactatgcgtggctttgttctagaccccgaagattggatggtgacaggcagaggagtccctgaagaacagaacaacaagaaaggggcggggtagcggaagcagagggagcgagacaggcaggggtcagatgggagcgttataacacccaggagaggacttcaagttctccttggctgattggaggattctgagcagagaagcgctgtgatctgcttttctgttttttaagatcactggtgtgcagccgggtgcattggctcacgccggtaatcccagctactcgggaagctgagacaggagaattgcttgaacccgggagtcagaggttgcagtgagctgagattgtgccactggactccagcctgggtgacagagcaagactccatctcaaaagaacaaaaatacaatacaatacagtacaatacaatacactatcattttttaatcaaccaataaaattagctaaaatacttaatagtgattaagtgtcacacttcagtaaaacaagtatgaaagcatcaaaacccttctaaaaaagaaattgcatagtgtatttgaagagcctggaaatgtttattctttttacttagcaatgatgttattataaatctatccttaagaaataagaaaaaaagcatgtttacatccaaagatatttatctcagaattctttataatacattgagaaacaatccttataggaatggttaaataaatggtgacacaccagccactaaaaattacatttatgaagaatttaatgtcatgagtaaaggttcacaatatgtgagcttaagaaaaaagagagtagagaaaactttatgtagggtacaatttctactgatattatagtaatcaaatgtagaaaaatataacaaaatattgacagtggtcgtctctggagagtaagaatatgaatatgggtgattaaaatacatatgtaacacatgtatgttaaatatctgtaacatatatgactttgatcagcaaaattttaatgatttgataaaacgaacctatttgttctgtccctcattctctccatttcgacccatcattacattctgccaattcctttcttttcctttcttcctgatttagttcagcactaaccatgcacaacctcccacccccacccattgggtttcctagctgacacctttccctgctaaccatcctgaaagcagtaggatgaaccattttccttaggtatggttgggatcatgttactcccatgaagggaatttgaggtgatccttggtcatccataacattgcaggcttttgatcatgagctgcaaatctctggttaacttatgatgacaaatcactgcataatttccctttgttcccttcaacctcaacagatacacagctacacacaaaatctccaagactaccttccttccttctctatctaccagattcttattttcctttgtaactctcttctagaatcaccttcctccaaaaggattttttttatccaggtatctatctttctcaacacaactttactcactgccacaccacttcagcatttcttcttttctagatatttggcaattgtgtatttgtcatttgggatcaaatttgattcctgtttcatcacaacattgcctaaacagcaatgcttctgattctacatttgaaaattaaagcttatacacaaagtttaagattgtctctttttttttgtttgttttctttttcttttttgtttttgttaagactgtctcttgtaaaaaatgtttgcacagttgtcatatgtttgcatgacaagctgatcatggttccttacaaagtatacccaaggtatttgctctcaaccttttctcaccacccagtgcacacacacagaaattcactaacatgggtgctcaataattgttattgacaagaattccaaacagttggtcaaatgactttttacttacaacatggagccataagtcataagataatttaatttatgaagaatcaatatgaaataaagacttaaagctcaatcttgttacctgtttggtgaacaactctggaaagtcaggataaaggaaagccaagtcgacagctgctttatctaagcagtaagaatatgcagatgggaccctcttctgttctcctaccatgtttgttccaggattccaatttgaaatctgtatgtgccccttgacacctcaatgctttgtcaagcacctcatttctctggctttagttttatagacaaagaaaccaaatacatggtgatggagcagcttatcacagtatgtttttagaaacaccaatgctaaaattaccagtccccaagtgtcaggtgaaattactataagaattaagtgagaattactttgatctaaagtattaatgaaaatggtagtgtcagtcatgattctggataattactcaaatagacaattttaaaaattgggacaacacattaatatgagaatatactgttataaagagaaaataggccgggtagggtggctcactcatgtaatcctagcattttgggaggctgaggtgggcggattgcttgagtccaggagtttgagaccagcctgggcaacatggcaaaaggccatctgtgtaaaaaaaaaaaaaaaaatacaaacattagctaggcatggtggcatgcgcctgtagtcccaactacttgggggtgtgaggtgggagaactgcttgagcccggaagctccaactgtagtgagccatatttggaccactgcattctagcttggacaacagagcaaaaccctgtttcaaaaaaaaaaaaaaaaaaaaaaaaaaaagagcttagtgtgaagagtttagaaactaaatacagtagctaaggaagaaactgattatttatctgaatttcaaattgaactaaacattggtcccaatcactcttcctttttccaagaactgagcattaaatggaattttaaaacatttattaaaacaaaatcaaagacaaactacaattaggagtgtgtcattaaagagccaatttccttaatatgccagagtgcttccgtatcaacaaaaaaatacaacacaatacatacgagcaaagatatcagcaggcagtttgcagaaaaacaagattctatgatgaataaacatgaaaatagttcaactctattcaaatcaaactttgtctgattaaaatagatagaaatcgaaacagtgagtcctactatatcagcaaaaatttttaaatttgggctgggtgtggtggctcatgcctgtaatcccagtactttaggaggccaaagtgggtgatgacttgaggtcaggagttcgagaccagactggtcaatatggtgaaaccccatcacagatttaaatggaagttgtaaaatcttacccccagtagaggatctttagaggaaatggggtgagggttgggtagagggcacatggattgagcaaccttgactgtgattcccataaatttagaagttcaggcaggaggacttcccccatgtaactatgattcaacagagcacacatcctgtttaataacaaaggcatttatgcaacattcattctatgtctctgggtaatttatatgttgcttgatcttggtaatgtgcaaacatttttagccagttcttaactgtcaggtgatctctgattgttgctgttttctatagttgttgtctagacactcacaaggattcaggtttattttggatcctaaagtcaaggccagtatttctttaagacttacttaaactggaagagtcctaagatttcagtagccacaaaaaattattctctgtgctcccccaagagggacagacacaatgagcaaccttaggatggtcaagggtcatctgttagctcttttagactcagtggagccttcatggggattggcagatggaaccgaaagcaacaaaaaagaccccaaaggaattggcatcttgggaactcagatttcctcaaggactcctccatctgatgatgttggtaatttcagctctacatcatcatttcttttcttttctttttttaaagatggagtctcactcggtcgcccaggctggagtgcagtggcgcgatctcggctcactgcaaactccacctcccaggttcaagtgattttcctgcctcctgagtagctgggtctacaggtgtgcacaaccatgcccagctaatttttgtattttttagtagagacagggtttcacctggttagtcaggctggtcttgaactcctgacctcaagtgatccacccaccttggcctcccaaattgttgggataacaggcgtcagcccccatgcttggcctcatcatttctttttttatcaaaaaccagacagtcaactaggcacccctctgtgctcacctttcacgtcctggcataacacttcgtaagcatagctacacaaagaataagaatggcaagccccaagtatgaagagataaatcaaatttaattgttattaatatattattgattattcacactaaatttagtcttccaaaaaaataaatctacttggataaaattcatgttgatggatagaccaaagaaagctggttatcaatttatatgctaatgaatttttcttacttttcccctatgtatagcctagtattttgtaatttctctgcacctacagggccagaggagggaaaaaaacggaacgcacatcctttctgttctttagtgaagcttttgatgaaagggattaataagagttaggggtgagggaaagaaagaaagagagagagaggctgggcacggtggctcacacctgtaatcccagcactctgggaggccaaggcaggtggatcacctgagatcaggagttcaagaccagcctggccaacatggtgaaacccagcctctactacaaaattagccagtgtagtggtgcgcacctgtaatcgccactactcaggaggctgaggcacaagaatcacttgaacccgggaggcagaggctgcagtgagcagaggttgcagtgagccgagattgtacaactgcactccagcctaggtgacagagcgagactctgtctcaaaagaaaaaaaaaagggtgggggggaagggggagaacttgagacgctataaaatgaaaattagaacttttcagtgcgcaccattttcataatttatggtacttccaccccaagcatgcctcaaatttgtttaggaaaatattttcttctcataccttcatttgttctcatatcatcattgtaatatgggtggatgatcaaataagcaaggccggcaattggtctgagaaaagagctcatttggaaataacatcctgagctttgcaaccgcaagtgagaagtgtatctcagcacctggtagcaaatgcaggtgaggtccaccctggtagtacatacaggagagttcatagatggttggcaaagaggtacaaactaatggaaacacaacaacaagctctgtagctactttacatggagttgactcagcaaaggcccatctgacctaacaacaacaaccagattagaatagttaatctttattgaacagttgttaccaccagttctgggtgcttcacatatgctatttcatttaatcctcacgacaatcctatgaggtactaattatctttctgctattttgcagatgtggagactgaggcttacaaagattaaataagtgttcaaagtctcacaactattaggtggcagatgtagaactcatatccaggttcccaaaccccagagcccaagtttttgccccagaatcacaatgctatatggactgcaccataatgaaacagctgtgtcaactgtactctgtatgcccccctcatgtattcagttgccctgtaactctgtccccaaaggagaaagtttgcatgccctgactgtttcagcattggtcactcatactcacaaactgtcctgtaaaatggagcttgggggaatggagataacagttaaaatacagtaaacaatctaagctttcagtttaagaagccagaaaaaagaagggcaaaataaatctgaaacagattaaggaaggaaataataatgatttaggtgggaataaagcaaatacggactataaaaacaaaataaaagttaataaaaccaaaagttggttctttgaaaagagcaacaacattgacaaaccactagctagaatgacaaagaaatgaaaagactcaacttactaaactcagggataagagaagtgacaacactactgaccttctagaaataaaaaggatagcaaagaaatactatgaacaattatatgccagcaaattagataacctacatgtagaggagaaattcctagaaagatgcaaagggccaaaatagactcaagaagaaatagaatatctgaatagacttataagtaaatacactgaatttgtaacataaaaattttccacaaagaaaagcccaagaacagatgacttctctggaggattctatcaaatgttttaaagtctaattaccaccaatccttcacaaattcttccaaaaaacagaagggactagaacacttcccactgaggccagtattacatgcatagaaaatacagacaaagttatcagaaaatgacaaatcaatatgtcttatgcatatggactttttaaaaatacacaactaaatactaataaactgaattcagcaacatgaccaagtctgatttaacccagaaatgcaagatagcttaacagatgaaaatcaatcagtgcaatacaccatatcaacaaaagacaaaaactatacacagtaatctgaatagctgccagaaaagcatttgatacaatgcaccaacccttcataactaaaacacaacatattaaagcagaagggaacttcttcaatctgataaataacatctacaaaaaacccatgactaatacacttaatgtgaaaaagactgaatgctctccccatgaagaacagcaacaaggatttgcactctctcaacttctatatgcaacattgtacttgtttctagccaggataaatagaaaaaaaggaaaaagaaaaaaaaagaaagaaaggggatccatatgggaaaggaagaaataaaactctgttcatagatgacgtagtcaattacatgtaaaaaacctaaggaatccattaaaaaattattagaactaataatcaagttcaacaaggttgcaggacataaaagcaatatagaaaaatcaattataaatttctatctactagcaatgaacaaactaaaatataaaattaacaaagcaatttcatctacaatagcatcaaaaataatacaagtgttaaaactacaaaacattgttcaaagaaatcaaagatctaggccatctattaaaaatacaaaaattagccgggcgtggtggcgcctggccgagacataagaatcacttgaacccgggaggcggaggttgcagtgaggagagatcgcgccactgcactccagcctgacaagtgagactctgtctcaaaaaaaaaagagagaaaaaaaatctaaataaatggaaagacactgcttgttcatgaatagaagactgaacgctgctaaaatgacaatactcctcgatctgatctacagagtcaacacaatattcccatcaaaatctcagctagtttctgggaaaaaaaattgataaatggatactaaaattcctacagaaattcaaggggcccagaatagccaaaacaaacttgaaaaagaagaacaaagctcaaggactcacccttccaggtttcaaaatttactacaaagctacagtaaacgagacagtgtatagggtgcagaaatcttaggggaaaaccataaggtgcggggagggtgggcagcgtggtactggcataaggatggccataggacaatagattcgaaatgagagttcagggaaaaaacccaaaacatgtatctgtggtcaatcgattccggacaagggtgccaagactatttgatgggaatagtcttttgaagaaattatgctttaataactggatacgcacaatgcaaaagaatagagttggacccctaattcatatcatatacaaaaattaaatcattatagatcaaccacctcataagagctaaaactgtaaaactcttggaagaaaacatgggtataaatcttcatgaccttagctcaggtaggcagcagccttttagatatgatacctttcaaatatgataaacacagcaataaaagaaaaaataatgaaattgtcctttgtcaaaatgggaagctttatttctcaaaggacaccattaagaaaggaaagacaacttacaaaatgagagaaaatatttgcagatgtatatttgataatagccttgtatctagaatatataaagaactcctacaactcaataatgaataagacaaataacccaacttaaagataggtaaagagtctgaacagacatttctctaaagctacacacactctttggtctcagctgcagaagccaaatgacaaagagaacgtcatcgtctggaaagcatcgcaataagatgcacacgatgtgccaccgctgtggctctgaagcctaccaccttcagaagtcaacctgtggcaaatgtggctacattgccaagtgcaagagaaagtgtaactgaagtatcaaggctaaaagttgaaacaccaccaggactgatcatatggggcgcctaaaaattgcacactgcagattcaggcatggattctgtgaaagaacaacacataaacccaagaaggcagctattgcaacatccagcttatctcacgaatttcagtgattagtcatgccataaaggttctggtttaaaacctgaactgaaaaaaggctaggcacggtggctcacgcctgtaatcccagcactttgggaggcagagataggcagatcacttgagctcaggagttcgagaccagcctgggcaacatggcgaaacctcatctctatgaaaaatacaaaaacatagccaggcctgggggtatgcgcctgtagtcccagctacttcggaggctgaggtgggagaatcacttgagcccccgaggttgaggctgcagtgattgtgccactgcactccagcctgggtgacagagcgagaccctgtgtccaaaaaaaagtaaagaaaagaaaaaaataatgaagtcacactttgcgagagtgggagaagtatggcagatgctgccacttattaccctccacttcagaagggcacatttcaaaggctcccatgacacctctcctgttccgatcattgtttccaaggaacaaagctcaggcatgcacctgtggatgccatgatgtccatgttccatgttctccactaatttcacttcagactagaaccttatcactaaaaacctcaccatgcagaattatcttacagagaagtttccttatgacacaatttttatgtcccaatggctgcctggctttgtgtcccagctctttgttctcacagtgaatagctttccaagaaaatgcttccctggtccctgttcactcagcactcccatcatgacctgtgtgtgtgtgtgtgtgtgtacgcgcacacacgagtgtgcagtgtgatgaggatgggaatcagggggctggagcattgcttaactgagcaatgcataattagcctcccttcccagcctcagcaggcagcaactcccctgcatcttccccttctgcttcccctcctccatcaccctcattatctcaatgttgctttccaatattcccaagcaaccaagctaaacaaagcaaacattaagcaaagaagacagaaagaaaacaggctttggagtgtggcacagagaagctcaaaaactagccctgtcattttccacttaggaaccccaggcaagcctacgatgtcaactttgtcaaatgaagatcacataatacccaatttcaagatatatttataggattccccctatgagctgggtgccgaggttacaacctgaatgacacatgtagactgtcattgaaaaactcatagtgtagtaggagatatagaaatgcaaacaaattccaatgcagtgtgataaaggccatgacaggtggcattaaggaggcaggagggattaattctcttcatggttgaggaggaggaagaaggcattctggggtggatgtaagacttcagtaagacaatgtgtccacagaacacttggcacacggtaagtgctcaaagaatgtgaaattctttcttcacaaagagccctaggaatgcagaaaataaaatttatatgttttggcctggcgcagtggctcacacctgtaatcacagcactttgggaggccaaggcagacagatcacctgaggtcaggagttcaagaccagcctggccaacatggtgaaaccctgtctctaccaaatgtacaaaaattagccaggcgtggtggtgggcacatgtaatcccagctacttgggaggctgaggcagaactgcttgaacctgggaggcggaggttgcagtggctggcactgcactccagcctgggtgacagagtgagaccctgtctcaaaaaaaaaaaaaaaaaattagatgggcatggtgatgcatgcctgtaatcccagctactccggaggttgaggcacgagagttgcttgaacccgggaggcagaggttgcagtgagccaagatcgcaccactgcactccagcctgggcaacagagtgagaccctgtctcaaaaataaaggatattaattataataaatttattgtataacaaactaatgttgatgtcttagggttaatactgtgaatttcaactgataattctaactttgccaaagaacaatggtcagaaatccttgattcttccttcaatggacacatatttattgacccccttttatgtgataccgggtaacagagacacaaaattgaacttacaacaagtttacagatgactcgaaaagacaaaacaagttctcaataattataatacacggcagaatggcatgttgcatttatcccccacctccccagtcactgcttcagaggttttcttactcttgaaataaagcagtgagataatgttaacatgagtcccttctgatcagacctttcctgcacttctatgctaatttctaggactagatatttagaaatggcttccccttggtgaaaacaagaaatgataaagtttgtcagtagagacaagtcaaatacttagtgtcctcagagcaatatcttgctaaatctaccacttaatgagtggctcagctgtacagagataatccggagagtcagtaatctgtgggagggcaaggaacaaggtgtcattcagctttgggggcaactgagtctgtgggataggatgtggagattcctaaatcagagatcaacaaagcaccgcattgagacgagggctctcaggtgtagcccatatgtgctttctcctgtgcactcaccttcccaagtctaccaataacagacccctccaagccccagaagccagggacaggtacaggtgtggtaccatgagggtgaatcagagtcctttgggggaatttctcatcctgcagataagactgctataggttttcctcaggaatggtagaaaataaaaccaacacagaaaacatatagagaaaaacagtcctgatgaccaaagcatgtcatgctgcatgctttggaatttccagttaggtaaatatatatgtataaatataatctgatgcattcatttgtcgattgattccttaagctatttttaaaattttctttatttttagagatgggagtctcactatgttgcctaggctagtctcgaattccccagctcaagcgatcctcctgcctcagcctcctgagcagctgggactacaggcacgccccaccatgcccagcccttaaactattttggattaggtttctattacttgcagccaaaagttctgaattaacaaagggcctcaccctggctcttccttggtatatattactatggggatgggatgaccgaggtcccatagaaatctcaactgatccattcttcccatctatttttccaggtctcatgaaaagttgccattttccctcctcaatttgttccctaaaattttactcagccaggcatggtggctcacatctgtaatccccttgggagcctgaggcaggtggatcacttgaggccaggagttggagaacagcttggccaacatggtgaaaccccatctctgttaaaaatacaaaaattagccaggtgtggtggcaggtgtctgtggtcccagctacttgggaggcagatgcaggagaatctcttgaacccatgaggcagaggttgcagcgagccaagatcacaccactgcactccagcctgggtgacaagagtgaaatttcatctcaaaaaagaaaaaaaaaaagtttaggttatgactcgttccctgtactgaaaaggacatttaataatttctacagagtttttgggataacagaagagtggtgctaatctaacatttctttgaagaggcatgctagcactcagactgaaaattgacaaagcacattgtaatcaaagaaggctcctcctggaggttccttatttataacttctgaaaagtggtcacattgtgcgcgctctctctctctctctttcctctgtagtagaagctaacagaataccctcacgttcgtggagagaacctttttcactgattatagctgattgccgcttacatgctgccctgaaaagctctcttgcctgtcgatctcttgtctgtgcctaatgtcctgacagtgttaactgagatggctcaaaggactaagaaacaattgatcatccccatctttctattcccttttatttcatctgccttctcctgctttcctctgagaaaaaaggcagagagaagaaacaagagtaaagaacaaaacccacaaggaggcaacttgcacaggaaactgtggaaaatccataagactttttgactagggttgaatcagatcagcacctgtgttgtgtgggttatgcagtggctcactcacaaatcaaggcaaggctaccagcaggagtgatagcttccaaactgtcacttggtctaaactattctgtatcttggctggagaacttaaacacacacacacacacacacacacacacacacacaaagagagaaaaacctagaatctttgtagggtcctgggccgcaatagtttttaaaagcaccctctaacaccaccccagccaggtgagtctaatgtgtagccaaggctggaaaaaaaaaatcacttgtctatgcagacattcacataaactctttatccaaccattgcaattgttcagccaattttggctataacccaaatagctaccaaccaaaatggctacctaggctactctgtttcctctctaccagcagacaaccacagcgatcactgttcgaagtttacagtgtgtcaggccgtactaagcacattacatgcgtaatctctaatctttacagccaccctggattggaaagtagtaccattcctgcttttagcataagaaacagaaaaatgtccaggcacagtggctcacgtctgtaatcccagcactttgggaggcaaaggtgggtggatcacctgaggtcaggagttcgagactagcctgaccaacatggtgaaaccccatctctactaaaaatacaaaaattagccaggcgtggtggcacatgccctataatcccagctactcaggaggctgaggcaggagaatcacttgaacctgggaggcggaggttgcggtgagccaagatcacgccactgcactctagcccaggcaacaagagcaaaactccatctcaaaaaaaaaaaaaaaagaaagaaagaaagaaagaaatggaaaaatggagctgttaaagaatttgcccaagacaaggtacagcaattaaatggcacagcaagatctgaatcccagctggccttaactcccaagttcgacccctctccactacaaagatggtccctcacttcggtgtgtctttacttctggctttacttttttcctgcttttgacaaaatccaaagtactttcagttcatatccttctaatatcctgccatgtgtacaaatatatgactatttaaaaacaagcaaagggccgggcatggtggctcaagcctgtaatcccagcactttgagaggccaaggtggagggtcgcttgagcccagaagttcgagaccagcctgggcaacatagtgggacccccttctcttcaaaaaattaaaaatgagttgagcgtggtagtgtgtggtctgtagttccagctactcgggaggctgaggatggaggatggcttgagtccaggaagtcaaggctgcactgcagcctgggcaacagggtgagatcctatctcaaataaaataattttttaaaaaattttaaataaataaataaaaataaaaactagcaaaacccagagaaatacttataaattcaaagtaagcctccctggccaggcacactggctcttgcttgcagtcccagtactttaggaggctgaggcagaaggatagcttgaacccaggagttcaaaaccagcctgggcaacatagggagaccctgtctctacagcaaattaaaaaaaaaaaaaaattagtcaggtgtggtggcacatgtctatggttccagctacttggaaggctgaggcaggaggatcacttgagcctgggagcctggcaggtcaaggtttcagggggccatgatcacaccactgccctccagcctggatgacagagcaagactctatctcaaaaccaaaaccaaaaccaaagtaagcctcctttattttgcaaataaaatgtaagtgcttgttttatatatatatatatatatatatatgtttatctaattccagaaagcagagacaaatgttgagcgctgttagcagaccaacttcaaaattctaatgcccatttttaaaatgatcgtacttcactgaacaagctggttctgcttagtttgatgaatacacaattggtttgggccatataaccaaaggtgagccttccagtaatgcacaccccagaatactggttacctaaaattgatgcttttttaaattccctttcctgaagatacttatattactggtaaatttaggaattcctcttgggaattcttgaaaagcaaattatactacagcattctattaaaaattgttaagtattggccttggccaggcatggtggctcacgcctgtaatccctgcggggggatcacctgaggtcaggaggttgagaccagcctggccaacatggggaaacccgtctctactaaaaagacaaaaattagcctggcatggtggtgcttgtctgaagtcccaactacttgggaggctaaggcacgagaatccacccagaaggtggaggttgcagtgagccaatattgcgccattgcactccagcctgggcaacagagagactccatctcaaaaaaaaaaaaaaaaaaaaaaattgttaagtatgacaattgatgtacgatgtgctagcttttgattgcaagaaggtataaggcatttatacatagcgtctgaaaatacaagttttcacttctaacacaatgtataaatgtgactgtgatttggtgcctttataaactggaggtgttacagcctgaccaacacggagcaaccccgtctctactaaaaatacaaaattagccgggcacggtggcacatgcctgtaatcccagctacttgggaggctgaggtaggagaatggcttgaacctgggaggcagaggttgcggtgagccaagattacaccattgcactccagcctgggcaacaagagtgaaactccaactcaaaaataaataaataaataaaagaagacttagctgaatggaaaggggagtgatagatggcacaatgtagcaaaaccttaataactaagaaatctgtgtgatgggtatattggaatttgtattttattccctctaaacttcaatatgtttgtaatttttaaaaaacaaaaccaattagtacatacttacatgaagactgcaaaactcagagggctagtcaaagttctcttaaggttttgaaataacattctgtgattgatgtaatagcacccctatttcattaaaagtaggttaggatgtagattttcttttgtaaaattaaggtaaatctaatttcaatttgttattagaattttgttttattttatttatttgtttattttgagatggagtcttgctctgtcgcccaggctggagtgcaatggcacgctctcagctcactgcaacctccgccttccgggttcaagtgattcgcctgcctcagcctcccgagtagctgggattacaggcacacactaccacgtccagctaatctttttatttttagtagagacggggtttcaccgtgttggccaggcttgtcttgaactcctgacctcatgatcctgctgcctcagcctcccaaagtgctgggataacaggcatgaggcaccgcgctcagcctgttattagaatttaaaaaattaagttctatgactccttggaataaattagataaacacaggtcacaattgcaggtcttagaaccattgggttaatcatattatagagtattcactcactcattcactcagtcattcattcaataaatgtgtgcttaatgccgctcttttgcaagatccataataatataattataaccctctataaactttttttagcataaagataacataaatccctaaaacacctttgtatttggggtatcccaaagctactagctgtgcttaaacaattctaacatatctggttgtgacattaaaaaataggccgggcgcagtggctcacgcctgtaatcccaacactgtgggaggccgaggcgggtggatcacctgaggccaggagttcgagaccagcctcgccaacagagtgaaatcccgttctactaaaaatacaaaattagccgggtgtggtggtgcatgcctgtaatcccagctacttaggaggctgaggcaggagaatcacttgaaccctggaggtggaggttgcagtgagccgagatcgtgccactgcactccagcctgggcgacaagggccagacttcgtccccccccaaaaaaaaaagggctggactcagcggctcatgcctgtaatcccagcacttcgggaggccgagatgggcgaaatgcttgaatccaggagtcgagaccagcctgggcaacaaggtgaaaccccatctctacaaaaaatacaaacattagctgggtgtggtggtatgtgcctatagtcccagctattcaggaggctgaggcaggagaatcacctgagcccaggaggtcgaggctgcagtgagccatgactgtgcctgggtgataaagcaagaccctatctccaaatatatatatatataaaaccaacaaaagtttcatctacttgaccctaaacaacttgccttaattttgtacttaatgaattggtcataggtatagccttgcagggataacaacatagtacataaacttctgaattttaccaaatgaattagaaggtagtttaagtcattttaaaaaataatttagcaacttttcttatgctttctcaatacatttaaaacctgattgacttaccagatgttccttaaccacaattttttcagtaacaaatctatcacagaaaacactgaccatggtcgtgacattctttggttttctatcacgtctcttactcaggtttcacttgtttctgaatttcaaattctaaggtttgaaaaaatatctgcaagtcaatatttaaactggccactggcaatgattatgttcttcattaagttcctcaatgttaaaaaaaaaaacaaaacagcaatataaaacaagcgatcccgggtgactgaagttttaactcagagtccaaatgctgcatagaagagcagctgctggcttcatttatcgtgacgagtaaaataaaacataggaaaacagtcgcagttttaatttaagcataatctaaacttcaacttgatccttgcaatgtagcatcataccttatggagaaacatgaagacaaaggttgtaataaaatttggatgataaaaaaagttggatgacaaagaagatgtggaaagcagaaagaggattggtatgcaaaacccatttaggttctgctgctcacagttctaacctcagagggtggagagatacacagcccatacttcacatagtcagatgctgaaaacaagcatctaggccagtgccatccaacagagctttctgtaatgatggaaacactctgcgtctgcaccgtctaatacaaaagccactgatacgcatgtgccacaaagtccttggcatgtgtgtagtgcaaacaaggaattatttcatttaattttaaacaaatttaaataactgcactgcatgcagctatgggctaccatattggacaacacatgtctgtgttcacagggtagctcctggacagaagaatgagagatttggggcagagttagatcagtaagtcttagaaatgctgcacccactctggtggagaagctaatctaactaatgccttttccattgcaatggtgagcagaagcttccaatacactttaatacactattagaaatgtgtgatcaacttttctcaagagtcaacagatgctcagataagagtgaaataaagctcagaaactcagaaaatagtggccctattttcagtcttttagttcttcttctccagaggcagaattccctttctgatgctgacattaattacccactcaacaccaccacaagccccacagcgaggccctcaaatgcacacatcttcttccacctgtctcctgcttggcctgcttgaaggtttccatccatgtagacttgaacactaacatggtctagaacctccatacaagccagtcagctcaatagaatgaatttacagaggccaagcttgagcattttgtaactgtttctgacatatgtctaaagcaggttggactgcctcacttcttggatgagaagggtgggtacgtcacattggacaaatcacctgttatattgttttcatgttgacacatttcccacagcaaatttgtttgatgtgtccttgttattctgttcaaaaaatggagtccagaacgtcatttgatgaatatagcctggtctgaattgaagggaagtcaagcatgaaggaggaagtggactgaactccctgaatgctgctgagaaatgcttccccagctaagacagtgtttttcccatctctctggtaaggaggggtgagaagaggtgaggaagagaggccaatgagtgctcgtgaatcagtaagactccaacgacacagaacttgagaacagttgaatttgctgggtgcagtggctcaggcctgtaatcccagcattttgggaagctgaggcaggaagattgcttgagcccaggagttcaagaccagcctgggcaacatggggaaacgccatctttacaaaaaaatttaaaagtcagccaggtgtggtgacatgcacctgtagctccagctattcaggaggttgaggcaggaagatcacttgagcccaggaggttgaggctgcagtgagcagtaatcatattgctgtactccagcctgggttgagagagcaaaaccctgtccgaaaaaaaagacggctgggcgtggtggctcatgcctacgatcccagcactttgggaggccaaggcaggatgattgcttgaggctaggagttcaagaccatcctcgtcaacatagtgtaacattgtacaaccctgtctgtacaaaaaaaaaaaaaaaaaagaatggaaaaagaaaacagttgaatttgttaagcctggacagacagaggacagtgttacatcacagactcagaaacagtgactaaagtctgacatttctatcttccctcctccttcacttcctgtctttgaaacaagcactacaaagacatgaaatcagaacctaaaactgagaagaaagaaaaactgtcacaggagtatgatgagtctgcattaggcaaaggactctcctgacaaggtggcctcaaggtggaaggaggctgggtagatgcttttggaggtgctgatggccattagtaggtggtgggcattgggaagagtaggtgtacttcacatcatggatgaggggattattcatgagaggtgatttgcaggtttgcctctaagggaggacaagagtgaaagaggaggagtgggtaccagcaatgccagtcctggacgttctgaaaagatgcagaggattccagtttgagaagtgctactagcggtgtccactggaaggtcaaaaaggtgaaggtgaagggcagcagagacagtgactgtggttacccctcactgctgcccctcaccttggacagtgtttactgtcattgtcttgtagatttgccagcagaaggcttttaattatttcagttatttttagaaataatatgtattatatgctgcttctcattatataagaaactcatggaaagcatggaagagcctaagaggggggagagaagaatatatgtaaatatattacacacacacacacagacatatacacacacagatacatatatacatacatacacacacacagaggtatggccagagatttcatattaaagacaatagggacgcaaaagaggacacggaaataagcaaaattaacaatgaaattaggctgggcatggtggctcacacctgtaatcccagcactttgggaggctgaggtgggaggatctcttgaattcaggagttcaaggccagcctgggcaacatagtgagacccccgtcttggaaaaaaaagtgaaaaaaaaatttttttaaggaaatggtataccctctcattatgggtgggaattagagtgctcagattcttcagggatggttttctattttgcattctttctttggaacagtattagtagggatactgagttaagcatctttaaggttcttgacatacattgacatgctgttttctgaataaggcatacctatttgtgtggccaccaggcatgtatgaataagctggggtctttcatggaagggaaatggtatctctctgttgtttccttcttttttttttttttttttgagatggagtcttgctgtgtcacccagtctagagtgcagtagtgcaatctcagctcactgaaacctccacctcccaggttcaagaaattctcctgcctcagccttcccagtagctgggattacaggtgcccgccaccacacctgactaatctttttgtatttttagtagaaacggggtttcaccatgctggccaggctgatctcgaactcctgacctcaagtgatccacccgcctcggccctccaaagtgccgggattacaggcttgggtcactgcacccgaccctcattgttgttttaatttgcaggttatttgtgaggttgtaaaccagtatttttcttttgtgaattagactgtttatttctacttccctccccacctcagcttctatgataaggccttgttaatagaaattaaattaaaagaatattggattacttatttgtgctgaaagtcccacccaccaaaaattatcaccatttaatttgtccaccttctattcacattccttattttggtcatggtttttgtagggcctagatataagtcatttgtgagttatctgccaatggcagattctttaccaaagaagtacttggggaggaccaaggactgccaacctctgaagacaaaaaattgttgtttgtattttgtttttcagaataagcacaagattccttaattttcctttaggcaaagataaagatttttatctttaaaagatgctgggctatcagttaggcacggtggcacatgcctgtagtcccagctgctcaggaggctgaggtaagagaattgcttgaggccaggagtttgaggccacagtggctgtaattgcaccactgcattccagactgggtgacaaagcaagatcttgtgtctaaaaagaaaaaaaacaggctgggcactgtggctcacgtctgtaatcccagcactttgggaggctgagatgggtggctgatcacttgaggccaggagttcaagaccagcctggccaacatggtgaaaccccgtctctactaaaaacacacaaattagccaggcatggtggtatgtgcctgtgttcccagctacttgggaagctgaggctggggaatcacttgaacccagtgaggcgagattgtgccatcgcactccagcctgggtgacacagtaagacttcatctaaaaaaaaaaaaaaaagtgtaaaaaaaaaaaagatgctggactaaaatttataagccagcattccctggtatttaatttttctatatccaaatcaacgttatttcctagaatttaaaaacatatatattttggctggacgcggtggctcacacctgtaatcccagcactttgggaggccgaggcgggtagatcacgaggtcaggagttcgagactagcctagccaacatagtgaaactccatctctactaaaaatacaaaaaaaaaaatagctggttatggtggtgtgcgcctgtagtccccagctactcagaaggctgagacacgagaatcacttgaacccaggaagcagacgttgcagtgagccgagaccacaccactgcagcctgggtgacagagcgagagtctgtctcaaaaaaaacaaaacaaaacaaaacaaaacaaaaaacaaaaaaacttacttgtcattttatgcagcaaataaagcccttatcatatgacaagtcaatcttccttgggggttgggtgggcagtgagctgtaaccttcattatatgatctttctctgacctatctactatcaaacaacagcagtgatggtacagacaaattgctctaatactcttactaaaaaatgaaacagtaggtatttattatggctttatagtaagaagccattttattggaaaagcagaataaaagtctttgttttgtttctactccaagtccaggtttgcatttgtgattgacagcaacggtgcttacttaaacaatggctaatttaaatgtttcacaatcctcaagggaaaaaatgccacctgggacaatgttcaatgtcttgaattcactattaagtaagagtccggttccgttcatgtatgcaaatttccctccaaggaatcctgttcaaagggaaggcaaactgagatctcctagacacccatgatgtgccagatactttaatatactgcaaattatctcaattaatcccaacaataaacacccatggttggaatctttgtggaaaaggtaaaagttctatacagagaaagccactgcactgggaagggcagagggctccgctgttgactggctctttcattctgttacacaggacaagaccagcatgaggtcaaccttgtggcaatggcttttgtactcaactggcttccaagttaccttctggctgactcagtgtctctgagaccatcctgagtgccagggacatttgtacctaccttgggtgctagaaaccagttgattctacttcttatgttacctaaatactttgctctttattggaggaaaagaatgattcagatggagccaaacaagcagtggcttgaacgcctctctccaattttccttcaaaaaaatcttggtcaggcgtggtggctcatgcctataatcccagcactttgggaggctgtggcaggcgaatcacttgaggtcaaaagttcgagaccagcctggccaatatggtgaaaccccatctctaccaaaaacacagattctgctctgtcgcccaggctggagtgcagtggtgcgatcttggctcgctgcaacctccagctcccgggttcaagcaattctcctgactcagcctcccgagtagctgggatcaaaggcatgcgccaccacatctgacaaatttgtatatttttagtagagacacggtttcaccatgttggccaggctggtctcgaactcctaacctcaggtgatctgccagtctccgccttccaaagtgctgggattacaggcataagccactacacctggccttaagcacgtccataaactccactttaaaatacatgattattgactcccaggaaacttctcagtaattctcacttgaaattcacctaactttcttatgatgattaaatatttccttatgtatacacactaaaacctgatcttaaaaaaaaattcaaaaattgctaaatgaaagtttttgaatatattaataccatgtgtgtctgaaaataacaagtattcataagcaaaaatttaaaattccagagttacggctgggcgcggtggctcacgcctgtaatcccaacactttgggaggccgaggcggatggatcatgaagtcaggaattcaagaccagcctggccaagatggtgaaaccccgtctctactaaaaatacaaaaattagccgggcgtggtggcgtgcacctgtaatcccagctacttgggaggctgaggcaaggaattacttgaacctgggaggcggaggttgcagtgacccgagatcgcgccacttcattccagcctgggcgacagagtgagactccatctcaaaaaaaaagtccagagcaagtcttatttttaaaacaaaacaaatttgaagggaaaaagagacaaaatgacctaagtaaaaaagtcagatggctggccagctctccaacagaagatagaaaagtctgcaaattagccaggcgtggtggcgcatgcctgtaatcccagctacttgggaggctgaggcaggagaatagcttcaacccgggaggcggaggttgcggtgagccgagatcaccccactgcaccccagcctgggcaacaagagcgaaatcccatctcaaaaagaaaagaaaagtctgcagtacgtaaaacctgagcctcagaaatcggaggtggcggagcctcaacagcgttctggcattgtctttgccaggacgggactgccctctggtgtaactaacaattttcacgttttgttcagcctcactgtaaagtcataaaacttttctgatgcttagtttcctcatgtacaaaacagcagcagtcaccttctagggtaattactgcagttaaacagccaacatagagcacttagcaaatacactcccagaaacagacctctttccttccaccctttcaggtcataatatttccatcccaccttaagatatcacttaactttaaagagctggcacagatagggaatgattttcagctcatatagtcatgtttttaattcctgaaaatgctctgcgttgtggtctgttcttacaaaggaatactatgcagcaacaacaggataaattataactacatgaaactatgtggatgagcgtcaccgataaagggttgagtgagaggccagatacaaaagagtacatactgtctgattccatcttaatgaagtaagaatagccaaaggtaatctatggtgatacaagtcagaatggtggttaccttgggttgaggggataatgggaggagaggcacgacgatactgagatgctgaaaatattttgtgccttaatctgggtggtggttccacaggtacatacacatataaaaattcatcaagctgtgtacctaacagtcgtgcagtttactgcctttatgttatacacttcaatgaatatttaaaataatatgttttcggccaggcgcagtggctcacgcctgtaatcccagcactttggtaggccaaggtgggcggatcacctgaggtcaggagttcgagaccagcctggccaacatggtgaaaccctgtctctactaaaaatacaaaaattagccaggtgtggtggcgcgtgcctgtagcccagctacttgggaggctgaagcaggagaattgcttgaatctgggaagctgaggttgtagtgagccgagattgtgccactgcactccagcctgggcaacagagtgagcctccatctcaaaataaataaataaataaataaataaataataataatatatttttttcaaagtagttatttgatttaatattttctctgaatgataaattcattcactggtgcttcataattgtagacatcacttgtataggatattttccaaataactgaatttactcatgtaagcaaacacactattactttcttgggtaaaaatatttctaaaatgatttgtaccctcactatcattttaaagaggctccaaagcacattcttcttggtgaaccaaggttatccatagaaatttacatgttggtgacctgtattggctcatgcctttaatcccaacagtttgggtggtctaggtgggagaattacttgagcccaggaatttgagaccagtctgggcaacatagtgagaccctgtctctataaaatttttaaaaagtaaagaaactgggccgggcgcggtggcttacgcctgtaatcccagcactttgggaggccaaggcaggtggatcacgaggtcaggagatcgagaccatcctggccaacacggtgaaaccccgtctccactaaaaatacaaaaaaaaaaattctccaggcgtggtggcgggcgcctgtagtcctagctactgcggaggctgaggcagaatggtgtgagcccgggaggcggagcttgcagtgagcggagattgcgccactgcactccagcctgggcgacagagtgagactccgtctcaaaaaaaaaaagtaaagaaactggccaggtgcagtggctcacgcctgtaatcccagcactttgggaggctgagggggggtgggtcacttgaggtcaggagttcaagaccagcttgaccaacatggtaaaaccctgtctctactaaaaatacaaaattagccaggcatgatggcacatgcctgtaatcccagctacttaggaggctgaggaaggagaactgcttgaacctaggaggcggaggctgcaattagccaagatagcgccattgcactccagcctgggcaacaagagtgaaactccatctcaaaaaaaaaaaaaaaaaaaagtaaagaaacttacatggtagagctcagctgagatggggcaatagcttcggggaccattgcttctggattggatggcagcagttttacccctttgttatatgccctatttctcaccattgtctgcctgcctgtaatcatccctgtccttctcatttgtttcctttcattcatttattcatatatctggtacatatttttgaacacgtgggatatgctaagagctagagatacagtagcaagttagacacttgtgatccatgacctaagggaacttaatattttagcaaaagaggcaagcataaaacaaatacaatgtgtattttcagagcaaaattagaggacctcctttaggggacctgggaaggtcaccttgaagaggtgacattcaagaactgtgagatgagaccctatcccagagtgagccattagtaagtactgactgaatgaatgagtccatgtgtgaatgcttgcttgaatggtcatcagccaagtagaaaggagaaaagaaagagtcgtgatttattatgcactgaggaaccagaaatgttattgaaagatgtctaaactaagagtcaatagggggacgggcatgatggctcacacctgtaatcccaacactttgggaggctgagacgggtggatcatttgaggtcaggggtttgagaccagactggccaacatgaaaccctgtctctactgaaaaatacaaagagtcaacaggcactgagtgaggtactaatagaatttatggcattaattttggctgctgtgggggctgttttattgccttacttaagatcttgagttgctagacaactgaaggatttttcattatcactgggctaacctatacgcattcagtttttacttcatcctgcaaaaagcaaaaccagccacatatggcccaagtgtctgaaggttcctccaagttgcccgtgtagttctgactccgagctcctacgcatgtgacttttctggcacagccgccagaatcaccttgaaaggttgtcacctacctgttccttaacaaagccatacagctctgttcagaaaagacagcaggcctgcctcttaggcattatggcatgttgtgaaatgccttttcatttgggtcctattattgtccccagaaatttcagcctcatgacattttacaaatcaagaagaacttgcagtctaaaggatggaaggagcagataacaaacaagaacgcttgtagagacgttactcaattatatgcctaatacagccaacctgacatagaagcattattatcatatcacgtttaatagcagcagagtctaaaatgccagaaacgtgggccaagttattcaggacttaatgtgatgcatgactagatctgtcaataaactatcatgaaaccataagaacccctaacaggaggatccaacgtagcctttgttgatcttagtttcttacaattcctcatggaaatactaaatcgggctgggcacaggggctcaagcctgtaatctcagcacttcgggaggccgaggtgggcagatcagttgaggtcaggagatggtgaaaccccatctctactaaaaatacaaaaattagccgggcgtggtggcaggcgcctatagccccagctactggggaggctgaggcaggagaatcgcctgaacctgggaggcacaggttacagtgagccaagattgtgccactgcactccagcctgggggacacagtaagactctgtctcaaaaaaaaaaaaaagaaaagaaaaaagaaaaactaaacaaaaagattgtaccgaatatggattttcctagtgaaataaagggaaacaaggaatgacaagtgtctagaaatggtttgtttttagatttttccccagagtctttctgttcctttgataaaatttcagactcaacacaggctcaatctactttagaaagtgtggtattgccaggcgcggtggctcacacctctaatcccaacactttgggaggccaaggcaggtggatcacctgaggtcaggagttcaagaccagtctggccaacataatgaaaccccttctctactaaaaatacaaaaaattagccgggcatgatggtgggcgcccagctacttgggaggctgaggcaggagaatctcttgaacctgggaggtggaggttgcagagagccgagattgcgccactgcattccagcctgggtgacagaacgaaactccatctcaaaaaaaaaaaaaaaaaaaaggccgggtgcggtggcttacgcctgtaatcccagcactttgggaggccgaggcgagtggatcacttgaggtcaggagttcaagaccagcttggccaaaatggtgaaaccctgtctctacaaaaatacaaaaattagctggagatgatggtggctgccagtaatcccagctacttgggaggctgaggtgggagaatcacttgaaccccggaggcagaggttgcagtgagccgagattgtgccactgcactccagcctgggtgacagagtgagacttcatctcaaaaaaaaaaaaaaaagaaagaaagaaaagaaaaaaaaggaaagaaaagaaaagaaaaagtgtgcttttaatgcatgaattatttcactggtcagggtttctattttggattcacatggtatggctctctttccctacttgatagactcaagcaatctaagtgcacctgtgtaacaggcaattagatacagtaagtatcaaaatcttaaaagagacataggaaaacattaatccacttgtcaaaagttacataaacttgcagtggtcagagtagtgaaatgactttctgctaaactcaattttccgatatgcatataaaaagatattaaacctgccatgcttccagggaactcaaggtctttaacctctacaattgttagatttcttcctatttgcctgaatatacaaagccacagcgaagtttgtcctgtggaggaaatgtcttccaattttgaaacaatcatttcttccagccgttttcaaatgactggccacttctcagaagaaaaaacccttggcttcttactgcaagcgtcattgggcaaaaatatacccaaatcatgttctttcataattggtgagctcttcaacttagtactgtccttgtacaggccaaagatcccacacccttgttatattgcccgttttatactgcaacacttttccccaagaactggcaattgtagaaatctgttggaactattttttttcctagattttcctataactgtttgagttttaactattaataacacagttactgctatctgtgtgtggcatatcattattacaattgatcatacataaacatttgattaaggctgtagctttattatattttctacccacccaaaaaagctagattataaagacttagtattcccaagaagtatttattcattagtttctcctaaaccatgaccagtatagaaaaagtcggtctcaagctggtctgtttcaaaaacacagagttgaggataagaggccgttttaaactgactttttttttttttcttttttggagacggagtttcgctcttgtcacccaggctggagtgcagtggcacaatcttggctcactgcaacctctgcctccggggttcaagcgattctcctgcctcagcctcctgagtagctgggactaccggcgcacaccaccatgcccggctaatttttgtatttttggtagagatggggtttcaccttgttggccaggctcgtctcgaactcctgacctcaagtgatccacccacctcggccttccaaagtgctgaggttacaggtgtgagccaccgcacccagcctaacctgacctttaatttgctgttatcttgtctaaatttaacagaattgggggtggggtggggggagaaagtttaaaagtattttcatgaaaccagaaccaccatttagcaaaacctttaaatggaatgaattcccgagctcacagaagtgcaaattgcaaggttacacattgcctcccagaaacacaggacctggttctgaactctttgctaaaggattctgattcagcccactgtaaaatctcaagcacaagtaggttttccacttactctccattacacacatgtccctctagcaaaaccaaaaacagcatttgatggaagctaaagattacaattatccggggactccgagccactaaaaaatagagtttgcaaagaaatcccttttgcccccgtcttcccctcaccatccctgccccttccgcagaagggaacccaaatcgtatgcaatttgaaatttttaatatgaatatactaaagtaggaagcacgtacctgctaagcacctggcgctctctttccctgcttgctctctcctcccacactctggcaacggaatgcccttcaaaaaccatggctcagtgcttttggtaaatgttttacgagacactaaacaggcttgtgtcccaccctcagagcaaacaccactgagggaacacaatataatggtcgaaaagatatcatgtaatgtacaataatgaaaatgaacaagcaggctctatttccacacttccccttaagggggaaagcaatgtcaaactttcaggtggtgggggcggagttgccggaaaggctcatagaaataaaccttgacgctggaagcgttagagcgatttttttaaaggtggcataacgataagctcattgttctaatcctcaaacaagtcttggcttgctgagctgaaaaactgtcaaaggcaagagttaataaagggtggagttcaccggcgaatatgtagacgcagtagcatctccacattgaccacatattcctatttatcagagaaaatgcaactcaaaaagtgctcataaaccatcctccacaataaccaaaggtacttcccattttccatatccttcaagttattcacagttaagacccaactctgctccaaaccagaagttttgcattccattcaagttaacaattacaactgaaggataacagaaacttgctggcaccaaactattagaatgtcaggtgcctcctggtaccaccagggttaatgagataaagagagggtgcccagggatgatctatctgcctggttttacagaaactacctatagagattgctagagtcttgggcccatgcaagcagcacgcactcatcggctactggaggactgagtgggacatctaagacatgaaaaagcagaattacttagctacagtcaagcccactcgctaaaaagagaccaagaccgtctagagaagaagccagaattggctttggttgcagaatcacacccacaggcaggataggcaaataagataacccattctctgtccccacccactcctccaatccccaagagagtgctcagaattttgcatttcctacctttaaaatatctgctggggtggaaacaaaacaaagcaaaacaaaactgaacctagaattgagatcatgtgttttctacactccagctgtgtgaccttgagggagtaacttaacctccctgagcccgtctcctcatctataaagtacaaatgtctagaaacacagaagttatttccaagaactgacagctctccagctccaggagcctagaaaatggcacagagcagttcttgacagttttaaaatgtcagaagggttgttgtcattttttggtctcctaccttatgtggatgggttccatcttattttcaatgtcctcctgttgcagaagcttccggttagtcctgggactaaagggcaattgacctcactcctcctgggtctgactgactaatctgttagggtgggtaccataaatgaccgttttatctgcctgcccggggcgtggcaacagggcctccccgccccccagccctgcctgtcagctccttttgctttcacaacatttctcgtcttgccctctatcacagtgagctgacccgcctcctaacgcctcatccgggcctccctttttctcttttttccctctcttcctctctcctttcttgccttgcttccctgagaggaacataatgggtgttgggggagggcgatgattctctttttcttttctttctttttttttttttttttgagacggattctcgctctgtcacccaggctggagtgcagtggcacaatctcggctcactgcaacctccgctcccaagttcaagcgattctcctgccccagcctcccaagtagctgggattacaggcacctgacaccatgcctggctaatttttgtatttttagtagagacagggtttcaccatgttggccaggctggtctcgaactcctgacttcaggtgatccgcccgccttggcctcccaaagtgctgggattacaggcatgagccaccatgcctggccctcatcattctatttctccttctactattttatgtgacatatcacacaacccagtgcatggtttacacaggtattattattattctcgagattcagagatgcagaaagatccaaaaacagcccaaggtcactgagccattgctgacaggccaggggctgaggtggcctttcctgacagcccaggatttcccttaagccactgacctccaaaagcacctcctctcagagccgtaaggccccacctggtctaacctgctctccccgccacctgtggcatagtttcctctcagatccctctcctcatcttccttcctccctcagcacgggccagccccttattctaatgttagggtttatctcacttgacctcttgtcccttgcgtgcccttctttatgcaaacccaagaggagtaaatcccctgcatgctagggattaattactcctatcacagaagtctttcccatgagcacccctcttgggtcacctgtctcattccactctgcattagggtatttgcgtgtcctcaaatgccatccctccctccctccccaccttccttccttccctccttccttccttccttctttcttttttcatggagtctcgccctcttgcccaggctggagtgcagtggcacaatctcagctcactgcaacctccacctcccagattcaagagattctcctgccccagcctcctgcgtagctgggattatagtcatgcaccaccacacctggctaatttctttgtagttttagtagagacagggtttcaccatgttggtcaggctggtcttgaattcctgatctcaaatgatccacccgcttcggcctcccaaagtgctgggattacaggcataagccactgtgcccgaccctcaactcctttctagatcaccagaacactcacctctgcaccccctggcatggagtccaatgccttactgttcagaaatatacttaaattttgataaaaaaaagtttgaagacacaaaatctgaatccaaaacagtgtttcaaaggcatatattctacgtacagtcagccctcagtgtctgtgggttccgcatccctgaagtcaaccaaccacagatcaagaatattcaaaaatctcatgtaccccataaatatatatactactatgtgcccacaaaaaattaaaaatgtaaaaatgtgaaaaggacggctgtgtctgtactaaacacatagacttctttttcttgtcattattccctaaacaatacagcataacaactacttactagcatttccattggattaggtattctaagtcatctagagatgactcaaagtatatgggaagatatgtgtaggtcatatgcaaatactgcaccattttatatagaggactcgagcatccaaaatctggggggcctgcaaccaattccccatggatacagaaggatcactatataaacaaatgccagaatttggggttttaaggtagttgctttgcttttatttatttatttattttgtatttcaatgaggatgagaaaatgggattatgaagtccagatagccaataagatagccatcaaatcacaccacaaaacaagcattgtttcttttcttttcttttttttttttttttttttttttttttgagatgaagtctcactctgtcacccatgttggagtgcagtggtgccatcatggcatcatggctcactgtaatctccacctcccgggttcaagcaattctcctgcctcagcctcctgagtagctgggactacaggcacacaccaccacacccggctaattttgctatttttttagagatggggtttcaccgtgttggtcaggctggtctcgaactcctgagctcaagtgatccacctgcctcggcctcccaaagtgctgggactacaggcgtgagcaaccacgcccagctgcaaacattgcatctcaagtgcctacaataatcaagtatttgatatatgacacctcatttaattaaacagacagatgagaggacagactcagagaggctgcccaaggatacacagctaataatgacagatctgagaacctcagcgggtcccagttggagcccttctctttgcctgagtcacactctcatgcacatgcacactgtagcctacacaccctactgcccaatcaggggtgtccaatcttttggcttccctgggtcacactggaagaagaattgtcttgggccacacataaaatacactgatactaatgatagcttatgagctttaaaaaaaaaaaaatcccaaaggaagcttatgaatttgtgttgggccacattcaaagccatcctggacatgccacaggttggacaagcctggtctaaatcaagatccagcccaggagtggtggctcacaccggtagtcccagcactctgggagtcccaggcaggaggatcacttgagcccagagtttaagaccagcctaggcaacatagtgagacccttgtttctataaaaaaaaaaatataaaaaatgatccaggcatggtggcatgcgcctgtggtccaagctacttgggaggctgaggtgggaggattgcttgggccgggactcctcactgtagttgaggctacagtgagccaagatcacaccactgtactctgccctgggtaacagagtgagatcttgtccttaaaaaaaataaaaaataaaaatcacttgcatgtattttctgccaacctctgaccagaaccagttcaactgtttttctccttcaatctttttttttttttttttgagatggagtttcactcttgttgcccaggctggagtgcaatggaacgatcttggctcactgcaatctctgcctcccgggttcaagcgaatctcctgcctcagcctccagagtagctgggattacaggtgtgcaccaccacacccggctaattttgtatttttagtagagatggggtttctgcatgttggtcaggctggtctcgaactcccaacctcaggtgatctgcccacctcggcctcccaaagtgctgagattacaggtgtgagccaccacacccagcatccttcaatcctttaccttggtctcctcaccctcctctcccacttccctctaccctaccctcctttttttttttttttttttttttttttgagacggagtctcgctattgttgcccaggctggagtatagtggctcaatcttggctcactgcaacctccatctcccaggttcaagcaattctcctgcctaagcctcccgagtagatgggacaacaggcgcccgccaccatgcccagctaatttttgtatttttagtagagacggggtttcaccatgttggccaggatggtctcgatctcttgacttcatgatccacctgccttggcctcccaaagtgctgggattacaggcataagccaccgtgcccagcccaccctaccctcttatccctaattaagatcatctctactgctcactttgaaatctactgatgaactctatttcatattgaagccctcctttgaccataaaatccaaccaaaaaatatggcttctcccactttgggtaagccttttatgttcttttttttctgtgatcacaaatttgtcatttgactttaaaccctgtaggttgtattagaattccccgtgttctatacggcacttggcacataaaagtctcatgctgctcagagactaaattatgtgtccctgagaaaggactgtgccttctgtgcaatagaaatgttttataatagcattttccacctccagccatgtgattctaagtggagttttttctctattggttttggtatgccagcatgcaggtatacccctagaattttcaactgcagagctgcaatagggcagaataatgtgtctctggggagtgctgctctatcgccccaggcctattccaaagcatctttcagctgtaggggcccatgtctagcctgaatatctttgaggctagtatatatttggcctgcagaatagtttcagcttctgaaaggggttttgagctcccttggacactaggaaatagtagaggagaaaggagaggtagagatttaatctggagcttctaaatcttccggaatcttccaaaggtttaggaatgcccatgaatcatactcaaacccctttagaggacttcaaagagtaccatgaatgtgacctcagaaactgctcatcacctagccaacctcaacagatgtgtaagaaagggcccaggggctcttggtgctttcccaaactgcccaaggaaggaggggctgcaataggagaggggagatcagtctacactgtccggtgctgcctatcatggggacatcaaccgctagaccagcagttctcaaagtgaggtccctggaatgctgagaggctccacggttcttaaaaatactaacatatttcccttttacacggcattgacacggactagtgataaaaaggcaatggtggctaaaacttctagccgtgtgagaggcagtgccaccaaagtatactagtaattgtggcatttttttaccaccaggcatttgaagttgttctacctttttttaaagccaattttccttaagaatgtatttggtaacacagtattaattttattttattttttatttctttttaaaatgttttaaattttttaattttaatttttttgttgctgttgtttgagacagagtctgcttgttgcccaggctggagtgcagtggcacaatctaggctcactgaaacctccacttcctgggttcaagtgattctcctgcctcagcctcccaagtagctgggattacaggcacctgccataacatccagctaatttttgtatttttagtagagatggggtttcaccatgttggccaggctggtcttgaactcctgacctcaggtgatccacctgcctcagactcccaaagtgctgggattacaggcatgagccaccacatccagcctatttattttattaagtctcaattcaagtagatgttttaaaaatattctgtgcgatgaaacagaaagtatgataaagcacttctactgtataccaaattatgattgctgtctcaaggaaaaatcacttgagagtcacaggctacattacttgataaaacaaactatgattatttagacttgaatatttggcagaccttttctagaaaatgaatgaagtgaccctggcacttcaaagaacacaacagacagtattgatttccaatgatcaaattcaagctttcaagcaaaagttaaatatgggggaacctggctaactctgggtgtactgcctatgagttagctctgctgtgcaaggagaagaaaaataattttaaaaaatacaaaaaaaggaagaaaaaatttgggggcaacctgcatttatcaccacaagcttgactgcttgtcagtgattaaaggcttttctcatgagatcagctatgacattaacaaatgtggatttttaaaaatacatactgaaatgtttcaatatttggaagatcttcacaattcagtgaaccaatattttccaaataaccaaccatgatgttacagaatcatgcatgggtaagcagtccattcaaagttcaagatgggccaaccaattttaatgtaacagagcatgaaaatttcctttttatggtttcagattctgctgcaactaacctttaagaaactacctcttggctgggtgcagtggctcacgcctgtaatcctagagctttgggaggccaaggctggcagatcacctgaggtcaggagttcgagaccagcctttccaacatggtgaagccctgtttctactaaaaatacaaaaattagcccggcgtggtggcaggcgcctgtaatcccagatactcgggaggctgaggcaggagaatctcttgaacctgggaggcagagggtgcagtgaactgagattgtgccactgcattccagcctgggcaacagagcaagactccatctcaaacaaaacaaaacaaaacaaaacaaaaactacctcttgtagagtttgggtttagtatcaaagaagaatgttcacaataatccaaaaattctactataatattcctcccttttccaattgcatatctttgtgaggttgaattttctttccctatagaatttcagtgaaaatgacatacctcaatagattgaagcagaagcaaatatgagcatacagctgacttctatcaagacaatcatcaaagagatttgaaaaaatataaacgacatgatcttctctttatctactttttttggaaatataattatttttcatgaaaacattttcataaaaaatgagcttactattattcttgttaaaggaaattaatatttttcttaattttaatttctaatgcagtaaatatcaatatatagaacccaaataaaagcactttaaaagcactttgcatttctcaaaaatctttttttttttttttttttttacacagagtctcactcacccaggctggggtgcagtggtatgatctcggctcactgcaacctctgcctccggggttcaagcgattcttatgcctcagcctcccaagtagctgggattataggcatgcgccactatgcctggctaatttttgatatttttagtagagacagtgtttcaccatgttggccaggctggtcttgaactcctgacctcaagtgacccacccgcctcagcctcccaaagtgctgggattataggagtgagccaccacacctggctaataatttttaagaatataaaaacagggctaggcacagtggctcatgcctgtaatcccagccctcctggcttgggctcaggagttcaagatcagccatggtaggccgggcgtggtggctcacgcctataatcccagcactttgggaggccaagacgggcagatagcctgaggttagtagttggagaccaacccggccaacatggtgaaaccctgtctctaccaaaaatacaaaaattagctgggcatggtggcaggcacctgtaatcctagctactcgggagactgaggcaggagaattgcttgaacccaggaggcagaggttgcagtgagctgagatcacgccattgcactccagcctgggcgccaagagcaaaactccatctaggaaaaaaaaaaaatcagccagggtgacgtggtgaaaccttgtctctacaaaaaataccaaaaattagtcaggcatagtggcatgcacctgtggtcccagctactttggaagctgaggtgggaggattacctgagcctgggaggttgaagcggcagtgagcagtaatcgcgccactgcactccagcttgggtgacagagtgagccctgtctcaaaaaaaaaaaaagaggaaaagaaaaggaaaggaaaacagggttgtctgatttcgcaaataaaacttcagggtgcccaattaaacttgaatttcagataagaaatgaatattttcatatatgttccatacaatgtttgggaaatacttgtactaataaattatttactgtttatctgaagttacagccaattgagtgccctgtatcttatctgtctgtgaagatgtccagagtccccaaaatttgagaaacactgcactcggctatgtccctcccacatgtgctaaaacactaatacaaacatttattaagcacctgctgtgtactagacacagtgctaaattctcgacatatacaacctcctgccaaatctcatgtggcaagtactctcatgatccctattttctcatacaaatgaggaaacggaaacccaaagaagtcaagtgaagctaattattggtggaaagcaagactggaacccaccagactccaaaatctcagcttgtacctattaggcttacactgaaccctgaataaatgagatttctaaagatggttggcttttctgcatattttcatctcacattttagcacatccatttctgttgctcatcttctctctgtttcacagctgtgtgttctgctatcacagcaaccgtgaaaaccaaggctggaagtgccgtgtgtgtcaaggaattctaaccagaactggaattggcattcggactcagaaaaggattttctcatggatgctttcctaggcatgacaacagcatagttctgggctgggaattctagaatgcagcaatggtgcacagacaccgctcagctcactgcagccttgacctcctgggctcaagcaatcctcctgcttcagcctcctgagtagctaggactacaggcgcacgtcaccacgctcggctaatgctcattactatgaatgaaaagccactgggagcccggtactgcgctagaatcttctttgagaataagctgggaatttatccaaatgaatctgtaccaaccaaaacaaatgcaaacgttgtaagcaagccaaggtcctgtttttcacatgatcctgatccaggccactggatatatttaatgagctcaggcttgatagtaaacaaaatagggaaagtaaaatatttttatgatccagtatgggggtaaggctatgaatttcactgtgttacatgatttgcaaatacaaaaatgaatctgcttgcacccaactaggggacctcccctagttaccgcttgctataatgaaatgtagaaagtgataaacatggccaggcatgatggctcaggtctgtaatcccagcactttgggaggccaaggtgcgcagattgcttgaggccaggagtttgaaaccagcctggccaacatggcgaaaccctgtctctactaaaaatacgaaaattagccagctattttattagtacaaaatacgactattagcacacctgtagtcccagctacttgggaagctgaggcacgagaatcgcttgaacccaggaggcagggttgcagatcacagagtgagactgtcacaaacaaagtgataaacataaaaaaagagatgctggtctttcatattggccagatttctttaacaaaaacattcacctttcaaacaatttttgttttgtaaatctggatttttattaaggtgaggcacactggattattctaaaggcagttgtgtatacagaagccaggggcgaaagaacttcgaaaatagcctagaggaaagaatgggacaaagagaggaaggggaaaaaaaggataaataggggaaaaaatgcaaaaactggagttttttggtaactaagaagaggggcattttaaaagccaaggcttggtaaaaacctagggaataggcttaagtagaaaggagatttgggaagctccagggcccttggacacctggcagtgagcatcagaaagaaaagtaagagttcttaagaaaaaccaatcaactttgcatttgccctggggctggcctggcagtgctgctatcagaattcagatactggcccagccctgctctagggcctgaagtttggctcttgcctcttcatttcagtccctttagctgcccatccaatctagatccccggagtgctcaaaggagaggcaacaagaagaaaaagaaaaagaaggacaaactgaaatgcaagcatggaccttagatgacgattctcacagctctcccccttcatgggaccttcagaattcattcttgtgaaagctgtaagtcaaggaggacacagccagaaaccgtgactcatcaaattcccaaagccaagaccagaacacacagactctggatccaaggactcgctttctgctttcagaacacgggatcctgcctactttgtagtatttcaatacaaagctgatcaagccgagggtccccatctactccccgccagcctggctgcccttccctgtcttcagagttttctaaatcatagagaagatagagtttaattccatggtgtttgagtcacaggaccttagaacacttcagaaaacgattggccttaaaaaatggttgggtctgtacaagaaagtcactgagtacagaggatggcaaacatttctgtcatgggctaggtaaatactataggctttgcaagccatgtgttttctgttacatattattcttttatttgtttctttttgttttttgtttttggggtttttgttttttgtttttgagacaggatctccctctgtcacccaggctggagtacagtggtgccataacagctcactgcagcctcaacctccctggctccagggatcctcctgcttcggcctcctgagtagactgcaggtgtgcttcactacacttggctaatttttttattttatgtagagacagggtctctcactgtgctgcccagtttggttcttttttttttttttttttttttttttttgcaaccttttaaaaatgtaaaaaccattagctagagggccacacataaacagacaacagaccacagtttactgatgcctgacttagagcaatggaaaagggctggcagcattgactggtgactgctgcatgtagtgagactaaagatagtacaaaacctcaccaggtttgacgaaggcaactacctctccatctgacttgcccaagtcagctatagctgtggcagagaatttaatctggaaatgctaggcttatatctttgaaaaattagataaatgaagttgttggttttgtgtttgttttattttatttttttgagacagtctcactctctcttgcccaggcagccaccctgcagtgtcgtggtgtgatcttggctcactgcaacctccacctcctgggttcaagcaatcctcccacctcagcctcccaagtagctgggactacaggcgtatgccaccacaactggctaatttttttttttttttaagacggaatctagctctgttgctcaggctggagtgcagtggtgtgatctcggctcactgcaacctctgcctcccagattcaagcgatcctcctgcctcagcctgccaagtagctgagatcacacctggcaatttttttttttttttttttttttttgtattttttagtagagacagggtttcaccatgttggccaggctggtcttgaactcctgacctcaagtcatccacccgccttggactcccaaaatgctggggttacaggcatgagacactgcgcccggactaacttttgtatttttagtaaaggcggggtttcaccatgttggccaggctggtctcgaactcctggcctcaactggtaacgcccgcctcagcctcccaggacaaatgaagtttaaaataagctagaatattttttaacctgctagttttcattgtgtgtgtgtgtgtgtgtttggggggtgggggggtgtacgtttttatttaaaagtgaatactccatatgtaccacaaaattccaaacctggaagaatcttccaatatagtccagtctacaactgtttacccttgaggaaactgacctgcttcagttaaatgagatattctaagtcacatgttagtttgcagaagagaaggggccagaaacttgttttcgtatttcaaaattcatacactttactttaatggtgcactgcccattaagtactaaaaaatcaattcaacaaatacttacgaagtatttcttatatatctagcactggttaggtgcactaaggttacaaaataaatgtaagcgaagattactgcccatagaaatgttttgggccaggtgtggtggctcatgcctgtaatcccagcactttgggaggccaaggcgggcagatcacaaggtcaagagatcaggaccatcctggccaaaatggtgaaacaccatctctattaaaaatacaaaaattagttgggcgtggtggcacgcctgtagtcccagctacttgggaggctgaggcaggagaatcccttgaaaccaggaggccgaggttgcagtgagctgagatcgtgccactgtactgcagcctggcgacagagtgaggcttttttaaaaaaaaaacaacaaaaaacccttttggtctctcactgagaaaacaaggcacacacactaagcaaatatattcttccttgcattgtcatgtaactacatatctaaaatgggagccaccgtaatcctagcacttgggagacctgaggtcaggagttcaagaccagcctggccaatatggtgaaaacccatctctactaaaaatacaaaccctagccaggcatggtggcatgcacctgtaatcccagctacttgggaggcaaaggcaggagaattgcttgaacctgggaggtggaggttgcagtgagccgagatcgtgccactgcactccagcctgggtgacagagtaagtaagaccctgtttcaaaaagaaaaaaacaaaaacaaaaattagctgggcatggtggcatgcgcctgtggccatagctacttaggaggctaaggcaggagaatggcgtgaacccgggaggcggagcttgcagtgagccgagatcccgccactgcactccagcctgggcgacagagcgagactccgtctcaaaaaaaaaataaataaataaataaataaataaataaataaataataaagaaagaaataataaaacagggccatctcgtataactctgtaatggtggaaagtttctgtatctttgctgctatcaggatagtagccagtagccacatatgtctattaagcacttgaaatgtgccgctggctaccatattaaaaatttttaattttacagatgttccttgacttacaatgggctactttccattaaccccatcataagtaaaaaatatcataagtcaaaaatgtggctgggcgaggtggctcacgcctgtaatcccaacactttggggaggccaaggtgggcagatcacttgaggtcaggagtttgagaccagatgggccaaccatggccaacatggtgaaaccctgtctctactaaaaataaaaattagctgggcatggtagcacatgcctgtaatcccagctactcaggaggctgaggcaggagaattacttgaacctgggaggcagaagctgcagtgagccaagatcgtgccactgcactccagcctgggtgacagaaggagactctgtcacaaaaaaaaaaaaaaaaaaaaaaaaaaaagcatctaaggcggggcatggtggctcacacctgtaatcccagcattttgggaggctgaggtgggcagatcacccgaagagctcgagacaagtctggccaacatggcaaaaccctctctctactaaaaatacaaaaattagccaggtgtggtggcacacacctgtaatcccagctacttgggaggctgaaacaggagaattgcctgaacccggaaggcggaggttgcagtgagccgagattgtgccactgcactccagcctgggcaacaaagcgagactccatctaaaaaataataaataaataaataaataaataaataaataaataaataaatattaaaataaaagtaaataaacttcacgatggattttaaggatattagacccccttttttttttttttttttttttgagatggagtctcactctatcacccaggctggattacagtggtgtgatctcggctcactgcaacctccgcttcccgggttcaagcgattctcctggctcagcctcccgatgagctgggattacaggcgtgtgccaccacacctggttaatttttgcatttttagtagagacggggtttcaccatgttggccaggctagtctggaactcccgacctcaggtgatccgcccaccttggcctctcaaagtgctgggattacaggtgtgaggcaccatgcctggacgatcatgaagtttaaaaattctaggtggagcatcttctgtacttaattttaattaaattattattatttttcttcttctttttttcgagatggagtctcgttctgttgcccaggctgtagtgcagtggtacaatcttagctcactgcaacctccacctcctggtttcaagcaattctcctgtctcacctcctaagtagctgggactacaggcacacgccatcgcacccagctaatttttatatttttagtagagatagggtttcactatattggccaggctggtcttgaactcctgacctgtgatccacccgtctcggcctcccaaagtgctgggattacaggcgtgaagcaccgcgtccagccctatttttcttctttttaatctgaatttaaatagccatgtgtggctagggacttccgtactggacatcacaggtctaaaataattattataatctggatgaaaaatatgtcacattcattctgtcacttttccttcttttgcctatggcaaaaaccactatgatcacaggactctttttcctttgaacatgggcaggctttcagaattctccatgcaaggcgaggcacggtggctcacacctgccaccctagcaccttgggaggctgaagtgggaggatccttggagcccaggagttggggaccagcttgggcaacatagtgagacctgtctctacaaaaagcaaacaaaattagctgggcatgggggtgcatgcgtgtagtcccagctactcagaaattgaggcaggaggactgtttgagccctggaggtagaagctacagtgagccatgatcgcggcagtgcgctccagcctgggtgacagagtaagactctggaataaataaataaaatagaattctctatgcaaccattgtcaatggcatggacttggtttacataaaacgaaacctgtttgccattcccgatgcagattaaaaaaggtgacaaaggtgacctggagaaggaaggagttgaggtgagcttcagatgagatcgggagtgatcagggtggtctggccacagactagctgagcttcaaaggataacatctggagagataaagaggaaaggacaaagagtatggggttctctgtatagaggagagtagctgcgaaggagctgaatggagctcccctggtcctaggacaaggaggatgctggcctgccaagcagagagggttgggttgggtgtggttggagataaggggataggcggaagggtgggtctgggttatgactttgaaattccaggacaccctgagggtttcagaggagcctggagaacacattttagaaaggcaactctgatagctaggcacagataggttgtacaatggacatgcgctcagataccagggtgaaggctatgccagtaatgatgtgtgtttttcctttaggaaaataaaacttgtttattatgtaaaatgtataaatgtcagaaaagcagatataaaaaaattaaaatcagatgtctaccaaccacagatgacattttgatgtggtttcttacagtttttttcctccttctctggctagtgcagtaatttaggaattaacattatgacttgaactaggaagatggtagtgcgaatgaagaggaaaggccgtgaaagatatcgttaagtgaggcaggggggtgaggacaaaagagaattagcttccaaagacaggagttctagacctgggtattctgtggggcctgaactcccagccttggttttgccatacatcaatctctctcttttttttttatctttttttttttttttgagatggagtcttgctctgtcacccaggctggagtgcagtggcgcagtctcagttcactgcaacctctacctcctgggttcaagagattctcctgcctcagcctctcaagtagctgggactacaagtgggagccaccatgcccggctaattttttgtatttttagtagagacggggtttcactgtgttagccaggatggtctcgatctcctgacctcgtgatccaccttcctcagcctcccaaaatgctgggattacagacgtgagtcaccacgcccggcattttttttttttttttttttttgagatggagtcttgctctgtcaccaggttggagtgcagtggcacgatctcggctcattacaacctccacctcctgggttcaagtgattcccctgcctcagcctcccgagtagctgggactacaggcatgtgccaccacacccagctaattttttgtattttagtagagacagggtttcaccatgttggccaggatggtcttgatctcctgacctcatgatccacccgcctcagcctcccaaagtgctgggattacaggcgtgagccaccatgcctggcctttttaaaaaaaatattattctttttccttttttttttctttttaaatatttttttccattttttttttgagacgcctggcccatacgtcaatgtcttaaccacttcttattggagtctaattaaaggtcagatgagatttttgagacccccttcaactaacgtacagatatgtctgtgtatatttaaagtgaacatcacatataaatagaagtagttgtcataacaccacacaagatcccttgatctctaggctataccagtagcttatagcctcttgcaatctgcaaaattttaggggtagagtaattaaactttctattctgagcagtgttacaaagaggatctgtagctgtagttcatgggacaggatatgaatggggcagtgtaaacagagaattcactttcagacaggactccaccaagcagaaatagcttcttcctaggagccaaaaggttttcaaagcccaatacatctttgaagactataagaaaaacaatagtaaaaacagctgctagggaatacagattatgctctctgaggccagatgcagtggcttacacctgcaatcccagcactctgggagaccaaggtaggcggttcacctgaagtcaggagttcaagaccagcctggccaacatggtgaaaccccatctctactaaaaatacaaaaattagctgggtgtggtggtgcatgcctgtagtctcagctacttgggaggctgaggcaggagagtcacttgaactcgggaggcagaagttgcagtgagctgagaccgcaccactgcactccagcctgggaaacagagcaagactctgtctcaaaagaaaaaaaaaaaaaaagaagaagggaaaaaaaagctctcaggtaggaaagagcaatacaaagacattcatcaggccaataagcaaaagtttacaccagaggttatctatacatttttaaaaaatactgattcctgggctccccttcagaccaattaaatcagagtctcagtaagtgttgtctgtgaattgatttgtcttattttgttttattttttgagactggatctcagtctgtcacccaggctagagtgcagtggcaaaaacatggctcactatagcctcgacttcccgggctcaaatgatccttgcatcctagacccttgccactccctctccccagtagctgggactacaggtgcgtgccaccatgcctggttaattcttttttttttttgagatggagttttactattattgcccaggctggagtgcaatggtgtgatctcagctcaccacaacctctgccttccaggttaaagcgattctcctgcctcagcctcccgagtggctgggattacaggcatgcaccaccacgcccggctaattctgtatttttagtagagatgtggtttccccgtgttggtcaggctggtctcaaactcccaacctcaggtgatccacatgcctcggcctccccaaagtgctgggattacaggcatgagccaccatgcctggcgcctggctaatattttttaatttattttttttttagagatggggtctcactatgttgcccaggctggtcttgaactcgtgggctgaagtgattcttccacctcagccacccacagtgctgggattacaggcctgagccaccatgcctagcctggtaattttttaaaattcacaacatgattgaaacttgaaacacaagaagatgccctggagaaaaaacagttcaagggacagcagagcagctgggatccacactgtgcccttagccacctgggttaagggttacagcaagttccttagtgatgtgggagctagaggccaaaatagaacccaccaatacattttataattgcatattacactccgtatagctaaaattcagggtgtagattccatgattttcaatgcatcctttggtcattttcactgaactgtgagttagcgaactcctggggacctggtcagaatgtcgatggacatacctttttctgagaatcccttggccctctaaggagctggtagttaaaaaatgcaaactcggccgggtgcggtggctcacgcctgtaatcccagcactttgggaggccgaggcaggcggatcacgaggtcagcagataaagaccatcctggctaacacggtgaaaccccatctctactaaaaatacaaaaaaattagccaggcatggtggcgggcgcctgtagtctcagctactctggaggctgaggcaggagaatggcgtgaacccgggaggcggagcttgcagtgagccgagatcgtgccagtgcactccagcctgggcgatggagcaagactccgtctcagaaaaaaaaaaaaaaaaaaatgcaaactcgcctcagactgacgtaggtatgtgagccagctctgccatgcatgaactgtatgaccttgtgtgagttccctgttgtcttttaagtctgttttcttattgacaaaataggaatcctagccccttctttagagattatggaagagatcaaatgaggctatacaagtaaaactgataatacaagtaaaagacttccttatgcctggcatatagtgaaccctcagtaaatgtaaatcatcattattttcttaagacctctagggttccttacaactccaatattttaagattccaagaatcactgattacacaggtatagatgaacaaaaatcagtgggtactgacatgcctagactgaaaggcctggtttgtgttcagcaccttttcataccagcctggtatggtatttctttttttttttttttttttgagacggagccttgctctgtcacccaggctggagtgcagtggcacataccagctcactgcaacctccgcctcccgggttcaagcgattctcctgcctcagcctcctgagtagccgggattacaggtgcccaccaccacgtctggctaatttttgtatttttttttttcgtttttgtttttgtatttttcagacggagtctagccctgtcgcccaggctggagtgcagtggcgagatctcggctcactgcaacctccacctcccggggcaagcgattctcctgcctcagtctaccgagtagctgggattaccagcgcctgccaccacccccagctactttttgtattttgagtagagactgggtttcaccatgttgaccaggttggtcttgaactcctgaccttatgatccgcccaccttgacctctcaaagtgctgggattacaggcatgagccaccacacctggcctcgtatatattttttttccccctcatagagatggggtttcaccatgttggccaggctggtctcaaactcctgacctcaggtgatccacccgccttggcctcccagagtgctgggattacaggcgtgagccactgcgcccagcctctggtatggtatttcaatgcccacttcattctttgcttgaggtgtcacttgtattttgctgaccttgttcttagtttcaaataactcatttattttgcagacatagaaattttgtcattctttatgaaagcaatgcggctgttctactgctacttcttggcaggcaacacctgcatagaaaccaatgagcatggctgaagtgaatgtcagacattctatttctgtctgcccacggtgcagcaaccactgacacacttggggcaacctgctttacccaaagtgcagcccgggatgaggccccacctcagcagaactttgatgcatgtctaatgactggcttggagaccttgttcttggaaactacagggctgacatttaagtatcacccatgaaatttgcctcaaggttcaacgctgacattagctaccaatttcggcttcataaccttggagtattctctttgctttctagagcattaaataccatcctacaaagcataaagccattattgacctgttattctgccaaaagacacatacactttgttgatgcccacaattttctttttcttcctctatggtaggtccagacctcttccgtttaggtagacaggcctccttttgtaggtaattgtctgcttccctgccatgttattggttgagtcatggctcatatccacctctctgcctttgcagtttttggtgtgtgtgtgtgtgtttttgttttttttttattgttgttgttgacagagtctcgctctgtcatccaggctagaaagcagtggcatgatctcagctcactataacttctgcctcccaggttcaagcaattctcctgcctcagcctccttagtagctgggattacagacagctgccaccacgccaggctaagtttttgtatttttagtagagatgaggggtttcaccatgttggccaggctggtctcaaactcctgatctcaaatgatctgcgcccagcctgccttttcagttttgaaaataggttatcttgtttggcaaatagcaagacatcaaagagcacacagacaaagtaactaaccactagatctatgaaacttttgcccacatgaatgaactaattttattttatgttatttatttatttttgagacagggtctcactctgttgcccaggctggagtgcagtggcataatcatggctcactgcagccttgacctcataggctcaagcaatcgtcccacctcagcctcacaagtagctggggctacagggatgcaccaccatgcccagctattttttttttcttaagacagcatctctctctgtctccaagactggagtgtggtgcctccatctcagctcactgcagccttgactgagcctccgggtcaggagatcctcctgagtagctgggactacaggtgcaagccaccacacctggctaatttttgtagagatagggtttcaccattgcccaggctggtcttgaacccctgggttcaagcaatctgcctgcctcagcctcccaaagtgctgggattccaggcgtgagccaccatacctggcctaatttttaaatttttttgtagagacacgatctcactgtgttgcccaggctgatgaactgattttaaaagggcaaatcattaagtttggaattagccttaaactcactgctcttacactctaccaaaaaccatttttccaaatatctgtttgggtccagaaagcagatctcagcaacatcttagcttttacaggaaggctttgtgatgaagtcactggttgtctgtattcaccatgggctaaatgtaaattcggcgcaattactctgacaagtcttttttttccttctttttttttttttagatgcgatgtcactgttttgcccagactagagtgcagtggcacaatcataaatcacagctcactgcagccttgaactcctggactcaagtggtcctcatgcctcagcctcccaagtagctaggactacaggcgtgtgcgtgtgccaccatgcccagctacatcaagtcttggaaagttcttcagtctgcatcatagtggtaattatacatttatgtttataaacagcaaaggacttcagggttacttttgcataagttttcaataccagcaggctccatacctaaattaacactgacgtcaaatttgatcagagatcaggcagaaggaaagaaaagggagaggtccagacaagagggtagtgaatatactccctggcaaatctggatacagatgagaaaagggatccagtaacttctactgcattttcaaatataccattacatatgtgaggtaggatgctcttttattggtattgtttttttttttttttttgagacagagtcttgctctgtcgccaggctggagtacaatggcacgatctcagctcactgcaacctccgcctcccgggttcaagcgattctcctgtcccagcctcccaagtagctgggactagaggcgcacgtcaccacggccagctaatttttgtatttttagtagaaacagggtttcactacgttggccaggatggtctcgatcttttgaccttgtgatctgcccgccttggcctcccaaagtgctgggattataggtgtaagccatggcgcccaggcttttttgttttttgtttgtttgtttgttttgagacggagtcttgctctgttgtccaggctggagtggagtggcacaatcttggttcactgcagcctctgcctcctgggttcaagtgattctcctgcctcagcccaagtagctgacattacagatgtgcaccacaacacccagctaatttttttgtatttttaatagagacagggtttcaccatgttggccagtcagtttcgaactcctgacctcaaaagatctgcctgccttggcctcccaaagtgctgagattacagatgtgagccactgtgcccagccatgtttcttattaactaaatgtttaaatgctcattcttaaactctgctggggccaggatagtggtctgatttatctttgtatccctcacacacttgttccagtatcttttatatgatggtcctatgtagatttaatttaaatcaaattaaattataggccactttccccttctttgtagtaaaaagctacattgtacaaaataaacagtaccaagtaatgtgtaatggaaaaaaaaatctcttccattttcaagtgaagaagcagaaaactcgtttttagaagctgccttttgggattgccttgagcagcctggggtcattttgtgacagttccctaccagtggttggccaaggaaaagtcaatgtgttttagctcagttgtttgacctttgggtgtatttgctctttagtaagcatccctcatatggaccacatgagttttacctgaagtcttaactgggttagagtctgcctttttgaaacaacatgatgaggaggccattttccaaaaggtgtatcttctaagccaggcacggtgactcgtgcctgtaatcccagcactttgggaggccgaggcaggtggatcacctgaggtcaggagatcgagaccagcctggccaacatggtgaaacacgtctctactaaaaatacaaaaattagccgagcgtggtggcaggtgcctataatcccagctactcgggaggctgaggcaggagaatcacttgaacctgagaggcagaggttgcagtcaaccgagattgtgccactgcactccagcctgggcgacagagcaagactctgtctcaaaaaaaaaaaaaaaaaaaaaaaaaaaaaagatatatcttctagtaattattaggttattaggatagggattttaggaaaatctatttctaagagatctgtgacttcactaaatgagctacaattccaaaatatgaagagccatttaccaaagaaacaatgtcttcaccaggccacgttttcctccttttcaaatgcaacttgcattttcaacttgtgagttaaataatatctacctcttaatttattaacttacttggaatgaaaatctaggctatgattagtaggaaagggtaaggactccaaatgttttactatttttattttacttaaagttcccatcaggagccctgtggtatttcctcctctaatctttcctacagatcgccaccatctaacttcaggtgccatgttgatcaaggaaaatatgcttgctgtggcttgagaaaaatcaaggccccaatctaaacactttacatggtatgtctcaaaacatcactatgtacctcatgagtatgtacaattatcatttgtcaatgaaataaaataaaatttaaaaaagaaattaaccaaaagagaatataagaaggatgttaaaattctttgttaaaaataaacaggctgggcacagtggctcacccctgtaatcccagcactttgggaggccgaggtgggaggatcacctgaggtcaggagttcaagaccagcctgaccaacatggagaaaccccatctctactaaaaatacaaaattagccaggcatggtggcgcatgcctgtaatcccagctactcaagaggctgaggcaggagaattgcttgaagccaggaggcggaggttgcagtgagtcaagatcacgccattgactccagcctaggtaacaggagtgaaactctgtctcaaaaaaaaaaaaaaataataataataataataataataataaatggggaataatggggaaaaaaccctactatttttttccttatagaactatataggtttttttctccttcagttgggttttttaatttatatattttatttatttatttatttatttggtttttttaatcagctaactttaagattcattatttacattttgccaggaatttttccatataacctaaatgtcaagcttattgatataaatcatatataatatcctcattctattctttgtattgtgaaataagctctatataaggtcataaaacaaataaacatctcaaagaaagtcaggaaatgacctggactttttttgaatcaagccaggcacagtgggtcacacttgcaatcccagcactacgggaggctacgacaagcggatcgcttgagcccaggagttcaagaccagcctgggaaacatggcgagacctcatctctataaaaaattaaaaattagctgggcccagctactcacgaggctgaggagggagaattgcttgagcccaggagttcgaggctgcagtgagccctgattgcaccactgcattccagcctaggtgaccgagcaagattctctcaaaaaaaaaaaaaaaaaatcgcatcaaatttactcataactaagaaatcagcaagcttgagaaggccagttccatggaattagggttccttttgtgtatacatgaacatgtgtaaatttctgcatccgtcagttcagtaactggccaaagggcgccagctcagcagtactcttgatagaaaatgtcaacactgctgggtgtggtggctcacgcctgtaatcccagcactttgggcggcagaggtgggtggattccctgaggtcaggagttcgagaccagcctggccaacatggtgaaaaccccatctttactaaaaatacaacaaattagccggtgtggtggcgcatgcctataatcccagctagtcgggaggctgaggcacgagaattgtttgaacccgggaggcggaggttgcaatgagccgagatggcaccactgcactccaacttgggcaacaagagcaaaactctgtctcaaaaaaaaaaagaaaaagaaaaagaaaatgtcaacacagagcactaaggtttgaaacctgagaatctcacacgttcaaagcacaagtagagtcaagtagctggttcaagtagctgcctctgttcattctatttaaagcattattttttaaatcctgcccttggtgggagaatcgtacacatacattgactatgtcgatgatcacctttcctggatgccatcaaggatgcagagacaaagaaatgtggacacattgtctgtgaaaaccacctcttactagaagctgattaccttccttggggaggtaggtgaggtaaattaagaacatagatttggggagaattcaaaggattagcaggggagcaatacttgggctctaactctagggaataatgctgatacacaaggtaagatttctgtctgaaccacaaaaacaaaaaaatctgatcatcagtctgaaatcaatctctttaagaggttttaaagattcttccagaaatttgactaagttttcattttacaagagacacctgttctctgaagcctctccctctccctttccctttccccccatagctcatgctattccttgaccccaacactctctccatactgggcccctgcaaaggctgtttaatgtagccactgccgcctgtctccaatccccctctgcctatcctccaggtctcagttagaatgccattcaaactccaagcaaccttcccaatagtcacctcctgactcagattatgttaggtcctcttgtttttatttatttattttttcgagatagggtcttgctctgttgccctggctagactgcagtgatgcaatcttggctcactgtagcctcaacctcccaggcctaagcaattctctcactgcagcctcccaagtagctgggactatgggtgcgtgccagcatacccagctaattttttattttccagtagagaatgggatgacaatttttaaatttttgtagagacaggtctcattatgttgcccaggttggtcttgaactcctgagctcaagtgatcctctcaccctggcctccctatgtgctgggattgcaggcgtgagccactctggctagcttaggttttcttgttttagactcttaactccttacagttcttcatcagcccactcattactctgttaatgtattatttaatatcttctgtgactactaaagtagccctgtggggacagcaatcctttctgtcctaattacttcttaattatgctacatctagcacagagcctagcacagagcctggcacatagcaggtgctcaaaaaatgtttgttaatggatttacttgtatccctacagatcatgtactatcacctatagggtctcataacatggaggttttgcaaatgttaaagtctgtctcaatcaggcaaatgtggcttagggaatcatgcccattctgtggcattaactctcaagatgctatttttctgcacatttaacatgaacatggatttggactctgctttcacggataaatgaacgagtcactctgggacatagcatggagtgttttcattgcaaactcctacccgctgattgcaggaggggaaccttggataagtgtctgattctgggatcttatgtctggaaggctgcttcattatctcacatgggctgttctgagtgccagcgcccactatttacaaggtccttggggtgctcatctcaagactatcatatgaagtcaccaaaaaaaaaagtttttctttcagtattagaaaactaaattctggctgggtgtggtggctcatgcctataatcccagcactttgggaggctgaggtgggcagatcacttgaggtcaggagtttgagaccagcctggccaacatggtgaaaccccatctcgactaaaaatacaataattagccaggtgtgatggtgcgtgcctgtagtcagtcccagctactcgggaggctgaggcaggagaatcacataaacccaggagcagaggttgcagtgagccgagatcgtgccactgcactccagcctgggtgataatgtgacttcatttcaaaaacaaaaacaaaaaaggaaacctaaattctttctttggtaagcacagacttcttactaatcatctactcatcagactatgcatttcttacccttaaaaattcaaccctctaaaaagaaaaaaaaaaaaaaaacatttgtattgtgtgaaaaatagaaggtagggaatacttaatgctggtcatttggggattatcagagaaatgctgtatttcaccagacctgtttgcataaggtgcaccgaatttcagacatgttaaattgtatgtgtgaagggcgggggatgcattctagttgatgatatgcagtaatgctacaggaagaacccaccaccagacattttcatgaaatcagtattaaaagagtttcactgaaatcattcaaatacacctctgtcattctttttggctgtgggagtcctctgaggacatttgtgcttacaaacatacagggcactctggcctagtaaattaaacaaacacaacaacaatacgtttgtaaaaacaaaaacaaaggggggtggcaaggattagcattttgatgtcgctatgtgatgttcacccacttttctcccccgccaccgggttatgtgcatttgagtcatggtgaagatgatgccaacttaccaaacctcctcagtgagccaaggattgctgatctctgctgggtgacctgacgcagagtctctttccaaggcctccgttacctgagctgtgaaatgaaaaaaataacactactgacccaaaggctggtattgagaagtccaaagttagtgatcactaaatggaactgggagagcgggtgagaagaaggaacatggtgttttgctattatcacaggccgttgtgtgtgcctggaactacaagggaagctacataaccaggcaatataggaaatctccactggtcacatcattttgccagctctgcaagactattccgtttcatattaattaaaagacactcaaggaaagaaaatcttactatgacaaagagagaaaggagagcctcatgcctgtaatcacagcactttggaaggccgaggcaggagcatcactttaagcccaggaatttgagaccaacctgggcaatatagtgagagcctatctctacaaaaaaatttaaaattagctgggcgcccatggtcccagcttgttggaggagctgaggcgagaggatcacttgagcctaggagttctgaggctgcagtgagctatgatcgtgcactccagcctggaaaacagagtgagatcctttttttttttttttttttttcagacggagtctcgctctgtcacccaggctggagtgcagtggcgagacctcagctcactgcaacctccgtctcccaggttcaagcaattctcctgcctcagcctcccaagtagctgggattacaggcatgccccaccatgcccagctaatgttttgtatttttagtagagacggggtttcaccatgttggtcaggctggtctcgaactcctgacctcatgatctgcccgcctcagcctcccaaagtgctgggattacaggcgtgagccacggcgcccggcctgagatcctgtctttaaaagagagagagagaggccaggcgcagtggctcacacctgtaatcccagcactttgggagcccgaggcaggtggatcacctgaggtcaggagttcaagaccagcctgaccaatatggtgaaaccccatctctactaaaaatacaaaaattaaccaggcgtggtggtgggcacctgtagtcccagctactcaggaggctgacacaggagaactgcttgaactcgggaggcggaggttgcagtgagccaagatcacgcgattgctctccagtctgggcaacaagagcaaggctccttctcaaaaataaataaataaataaataaataaataaataaataaaagagaaagagagggagagaagaggaaatgtataaaaagtggactaacagggaggggaagctcacaggtttgaccaggtgctcgaaactccactctactgcttgctagctggttgatcttgggcattttactcagcctctctgaacctctgagtttttctcatctaatatgggcctaatagtacccatttgttggagacattgtgacaagagatatgaagcctttggggcctagcacacagagaaaatgttcaatgaagggcggctatgattattatgttcatttaaaattctttctgcagaggcacattaaattcaaaatcatttaaatcactatgagttgtgttagttttaaatgttccttcaccttggaagccctctacagctggcttttctgcctatacacaaataatattctctaacaattcagtttcatatttttaagtaaatactttttttttttccagatggagtttccctcttgtcacccaggctggagtgcagtggcatgatctcagctcactgcaacctccgcctcccgggttcaagtgattctcccaccttagcctcccaagtagctgggattacaggcatgcaccaccactccgggctaattttgtatttgtagtagagatggggtttcaccatgttggtcaggctggtcttgaactcctgacctcatgtgatccacccgcctcagcctcccaaagtgctgggattacagcaagtaaatacttttgattagctaggttcagtgtagaagattttattatactactgttccaccaagaataaataaagctgtgacaaatgtctcattcctgcgatcccctccaagaaagactacaacgtacctcttggataagaaaatactgggctatgctaactcctgcagtccagctcagtaatcatttgttccaaagttcttcccaatgcaatggccaaattaactaaggttgagcttctgattaacatacagtgctggaaggaactttgacccacagaaacctggcatttgacttgcttcggtgagtccaacctgtgtcacgagtgcctgtttcaagggtaataaaggacctggctgtttgcttacagcaaatggaggtggtgccatgtcattatacagcttttacctctcctgtccacctaacccttggcaaataaagtctgcagcccacacatcagtttttggagtgatagaatgaaaaagggtatggatttccaaactgaaaagcacctaagttctacctggcattctgactaaatgttagctgcttaagaaacatgaatatggtaccaagatcaaagggaccagagtagagatcaggtgtttgagcaggtgcatattataaccatccaaattgtgcctcagtgaacaaactgctctctctgctagctcctgggttcccttttagtgacatgttataaaacaggaatcagatgcaaggaacagaccacagtactagagagttcatgtctcttcctgttctaggatatacagtgcccctccctgccctgccaaattcataaattcaaggtctaacccctagtatctcacaatgtgactatatttggagacagggtctttaaatgggtaattaagattaaatgaggtcacggggatgggccctaatgcaatataaccagtgtcttcataagaagaggaaattcagacacagacaacacagaccgagggatgactgtgtgagggcacagtgagtgggcagccatctgcaagccaggcagaaaagcctccaggtaaacaaaccctgctgtcaccttgatcttggacttccagcctccacaaccatgagaaaataaatgtctgctgttaaagccacttggtccatggtattttgttatggcagcctaaacaaagaaatacactgcccctccccacatcccccaacctcatctcccaggaccagatgagtcgcagatgagtaaggaggtcaagggcatgataatcagagtggattaactgtgcaattaaacagtggtaaacaggagagcacatgctctatccaaaggtatcaaattcaaaaaacttaaaatactatgaggccatacaaaagacggctatggcttgatgatgcccttcaggttgcaattcctgagctaaaccattacagtatgatatttaaaaacacccattattaatgctttcaacaaatatgaaatgaatgcctcctacaggccaggccctatgccaggcaatggcaatagcagtggtgaatatgttctctgcctttgtggtattacagtgtggatagtgagtccaggtgctgagctgggctagaaatgtcaagttgagaagacaaagtcattgccctccaggagggtacagattagtggagcacagagttgggacgagaccattataaaacaacgtgacaccagctctaatccacaaggggccctggaagctgggaagaagatgatcccatgtctgtgtcaatcagggaacatgtgagccaagtcctgaaggatgaataacagtttacccggcagacacatctgaaagacaagagggcattttccagacagaacagtcagttcctggtgcagggacataagagcgtacaggatctctggagaacgacaatgagctgagcacagccagggtgaagacgggcaggggagagcaacaggacgtgccgctgccaaggcaaggaaccaggagcccacatttgattgccgagggagccatcggagaattttaatcaggaaggtgacatcaccagaactgcatgttagaaggatcactctgaccacaatgcagaggagggctaaaggcagggcgacctgtctggagacaaagaaggcaggaaatagggaaacagacatagggatgcttgccggtcaaggtcagtcatcatggcgttcagctgcagccacgggtgacactgcccaagggcattatgtagggaaagagaagccctggcttttaaatctgagtacatattacttttttttttttgagacagagttttgctcttgtcacccaggctgtagtgcaatggcaccatctcggctcactgcaacctctgcctcctggattcaagggattctcctgcctcagcctcccaagtagctgggattacaggcacatgccaccatgccagttaattattgtatttttagccgagacagggtttcaccatgtgggccatactggtcttaaactcctgagctcaagtgatccgcccaacttggcctcccaaagtgctgggattacaggcatgagccactgtgcctggcctgggtacatattattatgatcaatgagaaaatgagtttcttaagaaacttttaatttcacttatcctcatcaggaaactaaccttactcattctttttatcaatcaaaagccacacatgactgtacctcagtttctttttttttggggggggggacacagagccttgctctgttgcccagactagagtgcagtggcataatctgcaacctccgccccctgggttcaagcgattctcctgcctcagcctcccgaatagctggaactacaggcacgcaccaccgtgcccagctaatttttgtatttttagtagagacagggtttcaccatgttagccaggctggtctcaaacttctgacctcaagtgatccacctgcctctgcctcccaaagtgctgggattacaggcgtgagccaccacgcccagccagtacctcagtctccctcttattttcctcagtctgtaagtaaggataataatagcacttcccttagagggaggattccttaagttaaataatacgagtacataggtgcaataaatgttttttttgtttgttcgttttttttttttttttgagatgaagtctcgctctgtggcccaggctggagtacagtggcatgatctcggctcactgcaacctacgcctcccgggttcaagcaattctcctgcctcagcctcccaagtagctgggattacaggtgtgtggcaccatgcccagctaatttttttttgagacggagtctcactctgtcgcccaggctagagtgcagtggcgcaatctcagctcactgcaacttccgcctcccgggttcaagcaattctcctgcctcaacctcccaagcagctggtattacaggcgtgtgccaccacgcctggctaatttttgtatttttagtagagacagggtttcaccatgttggtctcgaactcctgaccttgtgatccacccgcctcggcctcccaaagtgctgggattacaggtgtgagccaccgtgcgcagtaataaatgttaaatacagcagaaataaatattaaagaacaaatgggaaattaatgattgttcagttaatgacagttctccctctccatgaatattagccagaggataaccaccaccacagccacaaagggtcaaacccaacagagctgtcttggaacgaagctgggtttgatttccttgcatctctcccgaattctcacatggtctcctacacaagaccataaattttgtgcatgatcattactttaaagttataaaatgctttgtgtcaggtaaaatgttctcaacgattaaagattaaaggggatgtggggccttcgaggggagactgactgcagaggggcatgagaaaactttccagagatgttagttcctacatcttgattggggtagtggtttcacagctggatacatgtgttaaaagtcaccactgaaaatgtgggaagtttatcatacgtaatttttttttgagacagagtctcactctgtcgcccatgctggaatgtagtgctatgatctcagctcactgcaacctcatcctcctgggttcaagtgattctcctgcctcagcctccagagtagctgggactacaggtgcccagcaccatgcccggctaatttttgtgtttttagtagagatggagtttcaccatgtgggccaggctggtctcaaactcctgacctcaagtgatccgcccacctcagcttcccaaagtgctgggattacaggtgtgagccaccgcgcctggccctatcatatgtaaattataccttaataaagattgaagggacggaagatagaggaaaaagggattcaaggggaaatgggtatttatattccagagaaggaaaaaatagatatgcatgaagaaactcgtcttaaaacttttaatttccaaaatcattctctctttgaatagatgaaactgtcaaggaatgcaaaaaaaaaaaaacttccttatgcaagaaacattttgaaaaatttagacatcttccccctctcattatcctgtaactaacaaacagcacttttttacccctaggttcactgaacaagctgccctcttgtggttctgatatatttcctgagcacaaaagtgggctgttaggaagctgtgtaggtagcaagcccagcctgcccacaaatatttgtcaaggtaactgagagtgaatgttctgacctgcttctacatgagaggtatacacacatcactatgggcttgggtcacagttacaaaagaatgaagaaaatacggtggccacaaaatacatatggttcgaggctgacaaattcaaaagacaatttaatctctgtttactttgctgcttaattttaaggccctttagtacatactttcacttttgcaacgtggaatcagcatatcagaagcaagcacgtctcaaacaaggtcagggcaaagaaagcagaactgcaaactccgattctaccatctgtgaatatattcaatattcccaagatatctttgtacaaagaaagaaaacaacaaaacaaagtaaacaaatagtacctaataaaaacaatcctgcattttattaacattggcaagcagaatccagatctctaataaaataacaagcacttttaaaaaagaaaggaaaggagggaagaaggaagtacacaaggaagagggagggagggagaatcaaatagcgtacttttctttttttttttttttttgagacagagtctcgctctcttgcccaggttggagtgcagtggtgggatctcggctcactgcagcttccgcctcccgggttcaagtgattctcctgcctcagcctcccaagtacctgggattacaggagcgtgccaccacatccagctaacttttgtatttttagtagagacagggtttcactatgttggccaggctagtctcgaactcttgacctcaagtgattcacctgccttggcctcccaaagcgctgggaattacaggtatgagtcactgcatagccacagcataattttcaaaagttacactaaaagaagacaaaagatgacacaggcattgactcaaaaactggaaacattttctcttctagagagcaatccatctttatacaagaccttgtttaaaagaaaaacatagaggccctaagacttttttaaagataaggatttaggggctaggtgcggtggctcacacctgtaatcccagcactttgggaggctgaggcaggtggatcacgaggtcaggagatggagaccaccctggctaacatggtgaaaccctgtctctactaaaaatacaaaaaattaacagggcatggtggcgggcacctgtagtcccagctactcaagaggctgaagcagaagaattgcttgaacctgggaggtggaggttgcagtgagctgagatcccgccactgtactccagcctgggcgacagagtgagactctgtctcaaaaataaataaataaataaataataaaaagataaaggatataaataaaaatgggctctgtatttcaactattgacgtgttaaaaattcatctagtccagatcctgcagtagcaggtgggctaaattaatttgaaccaggggtagactcatttctgtatatggctgccgaatccacattctgatagatcaatctttctttttaaacacggtcacgtcacttcccttctcaaaaccctccaatggcatgtcctcacacttggaataaaatccagagtccttccccaggttccctctaggagcctgcatagcgtggcttggctgtgctccattccctgctgttcattctccatcaacctcacagtgctggctataccactggccttctggccgtttcttaaacaaaccagctcatcctcttctcctgccttggcactcactgtcggccccacctggaatttcctttcccagcctttacaccaccccccatcctagctctctccctgactgaattcaggtctttgctcaaatgccatctcctccaagaagtcttctctgacaactttcttttcttttttctttttttttttgagacggagtctcacgctgtcacccaggctggagtgcagtggcacgatcttggctcactacaacctccgcctcccgggttcaagtgattctcctgcctcagcctcccgagtagccgggactacaggcacgcgccaccacgccccacctctgattgcttttttttttttttaatatggaatacttcatgaattgattattcttttaaaagagttctccaatcaccaactgtatactctttcttcctcttccctatctttatttctcttctttgctcatattattatctgaaattgcattatgtattttttattttattttattttatttttgagacagagtctcactctgtcacccaggctggagtgcagtggcgtggtctcggctcactccaacctcagcctcccaggttaaagcaattctcctgcctcagcctcccaagtagctgggattacaggcgcatgccactatgcatggctattttttgtatttttagtaaagatggcatttcaccatgttgccaggcaggtcttgaactcctgacctcaggtgatctgcccaccttggtttcccaaagtgctgggattacaggtgtgagccactacgcccagccaattatgtattcatttttatcacttttcactatctatctgccccactaaaatgtgagctccatgataagggactttttcttcttcaccaaggcactcccagctcctaacgcagggtctagcactagtcaatagtcaatatttgagaaataaaatatcccctggttggagagataataagcccttaatcaaacctgttccaagacttttactatcaacaagctaaaaagcccatgtcctttacttgaattcagagtgctgaacagtggttggccagcaacctctactaagaagttctttgcgatcagagacatttgaaggtaaaatagggccttcgtcgtaagatgagccagccagcccttttgtcctgaaactgagtacgcaagtgcagagaggttacctggtttctccaagctcacatagaaatggtgaacatcaggagacgcgggaccacttaaaggatgcacagtcccgtattcatctccgcaaccccaggacccagcacggtgcctggtgcaaagaatgcactcagtgggattgcgcccagggaacgaatgctctctaaggcctcattcaactgaactgtacttcctctcattactgtcccaatgataacttcctatccgagaaccatttccagtcacttgagtcatgcgtcatttacttcctgtcctctgtccttttaaagtgcagtttgacaacataccaggcacaacagtaacatctgggggctgctttgcttctaacgtaagtcaaatagcccagcatggaaaatacctaggaaaaaagtgggatatgcaaagcaaacctcaaaaaaaaaaaaaaaaaaagacaaaagctggtgggctggccacggtgtcacaaatgaagtctccagtggcttcatcataacaagtaagtttactttatgaaagctcacacttgcatggtgccttctgttctcagcactttatatatatatgctctcattgaattctttccaagatgtacatctcacctgtaagaggcactacaactctgaaaaaccaagtaatttttagaaataattcagcattctttctgattgctctagaggaagaaaaaaaattttaaagaaataatttagcagcaaaatccgacgctctagttccttcctcccttccccccatctctctctcctttctttccctccctccctccctttcttccttttttttttaacgaatctcccaggcttaagggcagtggcgtgatctcggcttgctgcaacctccacctccagggttcaagtgattctcctgcctcagcttcctgagtagctgggactgcaggcacgcaccacaacactcagctaatttttggttttttgttttgtttttgagacgtagtttccctcttgttgcccaggctgcagtgcaatggcgcgatctcggctcactgcaacctccgcctcccaggttcaagcggttctcctgcctcagccttcccagtagctgggattacaagcgcccgccaccatgcccagttaattttttgtatttttactagagatggggtttcactatgttggccaggctggcctcgaactcctgacctcaggcaatccacccgcctcagactcccaaagggattacaggcgtgagccaccacacccggcttaatttttgtatttttaatagagacgggattttgccatgttgcccagctggtctcaaactcctgtcctcaagtaatccgtccatctcagcctccaaaagtgctgggattacaggtgtgagtcaccgcacccagcccctgactttctagtttctaatgagactctctacagccttcgtttcttgcagcatgtctgagtgtccattcgctctgctgaagaaatagtgatgggtgtgatcaaggaatactgcctgagatgagtggtattaagcaacacagggtacgtgcaacatattatctttctaaaatctgaaatgttctggcttctaaaacacatctgacccaatgggtttcgacaaggatttctcacttatattaatgcagagaagtaacttgcccacatcacacacctagtaactggcaacgctaggactgcaatcaggcagcctaattctgcaggccatgcctgcggccgccacatcatcctgcctctctcatgaatgatgggaatgtgatctgaaagtcagtgattcctcaactgtttttctgatgtgggtcccagaaatagaattcggaaagatgaacagccaaggtggccttgtgctgtcacctgtgaaggcaatttggaccagcgatgacaccaggtgagttagggcacagaacagctgacttcccagaagtcatggccactttcgggaaaatggcatccagaggcttggagatcaaaacttttgcctccttgaacatcttccccaggagcctctgggaaacactgaagccaacctgctaaagacctgaaaagatcttcttttttttttttttttgagacagagtctggctctgtcgcgcaggctggagtgcggtggcgtgatcttggctcactgcaacctctgcctcctgggttcaagcagttctcacgcctcagcctcctgagtagctgggattacaggcatgcaccaccgcgtctggcttatttttgtatttttagtagagacggggtttcaccatgttggccagactgttctccatctcctgacctcaggtgatctgcccgcctcagcctcccaaagtgctgggattacaggctgagccactgcacccagcctaatacattctttttaagattacactatgaggttaagtaatcttcattacttaatgaagattaaggtgcagtaggtcatgcctgtaatcccagcactttgggaggccaaggtaggaggatcacgatcacaccactgcactccagattgggtgacaaagtgagactctgtctcaaaaataaagtaattgcagtttttgctattacttttaatggcaaaaaccgcaattacttttgcaccaaactaatacattctttttaagattatactatgagggccagacacagtggctcatgcctataatactagcactttgggagactgaggcgggaggatcacttgagctcaggagttccagaccagcctgggcaatatggcgaaatcttgtctctataaaaaataaaaaaattcaccgagtatggtggtgcacgcctgtaatcccagctacttgggagactgaggtgggtgaatcacctgagcccaggatgcaaaggttgcagtgagctgagtttgcgccacggcactccagcctgggcaacagagagaaaccttgtctcaaaaaaatatatatatatacatttacatgatgaggtgggatgaagagctgcaggtgggttgtgagcctgagaatgtgtgttggggggcacgttggggggagttgtgcacatatgaaagtgtacgctcattaaaaattgatatttccctaatgtccagaatgcagagcaattataatttatgcttcaacttttctgtcccctaaattcattattggtggaagtaaaagatgctgatcatttgggcccacagtgtgcttacttggctaagtccttggggttacctccattcttcagatctcagttcaaatgtcaattcctcagggaagccttccccaatgcccaaagtagactgtcccaccctttaattctcacccacatcttggtgtacactttccctttgagcagtcatcgtgggttctaattaaatactcctggctttctttgttcactgactggctgttcctactagactgtaatttccttgaggacagtactatatctatatgctcatctgtgttcccagcatgaagcatagcacctgccacatcctagtagctccataaatatttgttgagttggctgggcgcagtggctcatgcctgtaatcccagcgctttgggagtctgaggtgggcggatcaactgaggtcaggagttcaagaccagcctggccaacatggtgaaactccgtctctaccaaaaatccaaaaattagctgggcatggtggtgggtgccagaaatcccagctacttgggatgctgaagcaggagaatcgcttgaacccaggaggcggaggttgcagtgagccaaggtcgcaccattgcactccagcctgggcaacaagagcgaaaccccaccttaaaaaaaaaaattgttgaatgaatgaatgcatgagtatagaattttacaataaaaaatcagaggttcctcagcagacaaacacaaggccttctcccacctctgagttgtgaaattgttattgcctaggcaatcctatttggcaatttatcatatgttgctcagtgacctgttatctttatagttgtggattgttgcttaattttcttattcttttttaatgtgtactctggttagatcttgtcttcccaagcagattataagcacatctcagtgtaaattacatcgtcctgaattcctcaaagctcccatagtggagttttgcacctaatctttttacactgttgcttcattttgtgctcaaaacagatattattattctcattttttgcagatggagaaaactgaagctcagagaaataagtgactcacagtttgtataagttgatatttgaaatttgggatttctcctcttaaattacagatatctcattaacacaggctcagaaatcattttttctccctgtgaacttttggtctgtcatttgctttaacttaaactatatcgaattctgtgacttttaacatttagacattcatttactcaatcatttattgaatgagtaaatgtctaaaaaatatgtactgaggctgggcatggtggctcacgcctgtaatcccagcacttcaggaggccgaggcaggtggatcacttaaggtcaggagttcaagaccagcctggccaacatggtgaaaccctgtctctattaaaactacaaaaaaaaaaaaaaaaaaatgggccagacatggtggctcatgcttgtaatcccagcactttgggaggctgaggttggcaaataacctgaggtcaggagttcaagactagcctggccaacatggtgaaaccccatctctactaaaaatacaaaaattagccaggtgtggtggtggacacctgtagttccagctaattgggaggctgaggcaggagaattgcttgaactcgggaggcagaggttgtagtgggccgagatcgtgccacagcactccagcctggtcgacagagtcaaactctgtctaaaaaaaaaaaaaaaaaattagccgggcgtggtggcaggcgcctgtaatcccagttacttgggagactgaggtagaagaatcacttgaacccaggaggcggaggtagaagtgagccaagatttcgccactgcactccagcctgggtgacagagtgagactccgtctcaaaaaagaaatgtgtactaagcccctcctatgttccaagcactgtgctagtgattgtggtgaatagggcagatccagcctttattttatccctattacaaggtatttatccctattacaaggtatattaccatgacatagatagcatttgcccctcagtaatggttttttctttagaggctacttcaccaagacagaatataagctagtttggattatatggaaaagcagcctttgcctctatttctggcaaatagaaggagagagcctaataaatatttttcaagtgagtctaacatgaaatcaggctgtgtttctcaaacaattacaggtgacaaacacagaatacgatatggctagcccataatgtgggtgttatttctacaataacgaatcaagtgacatgggtatgcaagcatcatttcagaaactatacagagaagctgcattttctccctcaagccccaaagtccaagataatgtcaagtgagaaagcctgaagcaaacattggagatcttatctaaattttttaaaaataagactgttaaggaagaaaaactgaggtgttgtttaaatataaaagattctatctttgttcctgtgggtgaccaacaccagggtagagaaaatcttgattcagcaaatattttttgagtttcatgaaatatcccctccaccatcctctaaggtcccacccaaatcgggaagactcttggtggtgcaaaaataggattattgttgtttttgcgaagtcaggccctttattagagggtagaaagaacacttgttcctgatttctcaacttctgattcctgttggcagcacataatatgccccagccttgactctcaagcacaacaaactgcaaatgaaatagataagtcactgttccttcaaatctgtacattacaagccatttctagtgtttaccttttttaaaattttggccaaattacttgcactagccagatagctgttagagagattagcaagtaggtctgagaatcactcacccataaccacgcgctcactttcttgatattactctcttatttttccatcctgaccctggcacaatagttaaacaccagcctggtcagcaaaacagtgttgtcaaaacgcagccaagctgagttttgacccacagaggtctgacagttgtcaggaatttcctaacatggccagggtcactgacagttaaaggtttcactggtatcacctgcaaaatctaactccactccatgaaaagtgcagaaaactcttaaaatgctttctgtgctgcctaaggttctgattttaaaacacaagagtatggaagttcagacttttggttatctccactttgccaaggcacaggtgtttgaggaatgagcatgtgcatggcccagcactttcttaccactcttggatgatcaagagttcaaagcaaccttgccaggtgcatttaaaaaaaaaatctaaccagagctcacaatacaaccaattccttggattgaatgaggacacctcggctctccctgctcccggcagtgccagcctttggtcacttgccagtccaggggaagccaggaggtgacctccccgaccctctcctgcctagtcatacattcgaagttttcatctattttgtatgatgcagccatctatgccctctttgactgctgaccaccataactaaaaagttgctgctaggctgggcgtggtggctcatgcctgtaatcccagcactttgggaggccaaggcaggtggattacgaggtcaggagttcaagaccagcctggccaaaatggtgaaaccccgtttctactaaaaatacaaaaaattacccaggcatggtggcaggcgcctgtaatcccagctactcaggaggctgaggcaggagaatcacttgcacacagaagtggaggttgcagtgagccgagaacgcgccactgcacttcagcctgggcaaaaagtaagactccttctcggaaaaaaaaaaaaaaaagttgctgctattcccttttctctcactatttcccacattcttagcactgcctacgtgtcaggaactgcattaaaggagactatgtgtctggttttttacctcccaacaatcaagcctggtaaggaactgttaaacccactttcagtaaagaagactgaggtccagagagattatcttattataaagtgcccaagaggcaggatgggacttaaatcttagcctttctgggactatttttccattgtctttttttttttttttttttttgagacggagtttcacttttgttgcccagactggagtgcaatggtgcaatctcggctcactgcgaccaccgcttcctgggttcaagcgattctccggcctcagcatcataagtagctcggattacaggcatgcaccattacgcctagctaatttttgtattttcagtagagatgggatgttgaccaggctggtctcgaactcctgacctcaggtgatccacctgccttgccctaccaaagtgctgggattacaggcataagccactgtgcccaacttcttttttgcttcttcttttcttttttttttcttttttttttttgagacagggtcttgctctgtcacccaggcttgagtacggtggtgcaatctcagctcactgcaacctccacctcctgggctcaggtgatcctcccacctcagcctcctgagtagctggaattacaggcttgcaccaccatgcccagctaatttttgtattttttgcagagatggggtttcgttatgttgcgcaagctggtctcgaactcctgcgctcaagcaatccacccatctgggcctccctaagtgctgggattacaggtgtgagccacctcgcctggcctccgttgtcttaatgtaagatatccttttactagatcagaaatctctgtccttctctcattcatttattcattcagccagtcagttaacattcattagaggtccacaatgcaaggtcccctcaatgactcaatgacttgaaacctgtttctcaaatagcccatgtgactacttactcattttaaaaagctattattaaatcaattgcatgttttacaatcagtaccccatggttacaatccaggaaacatacccccaagtgataatctgcaaaatccactagatttaaagatatgcaaagttaacagaaagagaccacctggtctgctggactctaagactagcaggaggggtgggtaatcaggctgtaggattaacacgatcaaagaaaaatgtgtctctcagaaggagtggtcctcttttggaagcctggaaaaaagaggacaggtgaaagttgatcatgcccactgaagcacagaccaggagagggacttcagaaggcttccggtcccaaagacaagatcattctactgtgaaatacactgaggttgcatcagactaaggaggcgggtgtcattacattttagaccccttctcctcccacttctccctatttttttttttttttttttttgagacagtctcactcttgtgtcacccaggctagagtgcactggtgcgacctcggctcactgcaacctctgcctccggggttcaagcaattatcctgactcagtctcccaaataattgggattacaggtgcgcgccaccacgcccggctaatttttgtatttttagtagagacgaggtttcaccatgttagccaggctgttctctagctcctgacctcaagtgacctgcccacctcggcctcccaaagcattaggattacaggcgtgagccaccgtgcccagccgaaatatttcctttctgtttctgactactattccctagaagcaaaaacttgtttcattgataatatatagctgctcaggagctgcatcattttttagaagcgacagcaacaataaagaattccctcgaggggatgagtcattaggtgagcattatgctccaaaaagctgtacccccaaaagggtcaagtacaatgacaaagcagggtaaacaggctactaaaaatatccaaaatgacgggacccatgtgttgtattaaactggcatttgttagcccttgctaaaaattaaaagtatattttagcaatcccagctactcaggaggctgaggcaggagaatcacttgaatctgggaggcagaggttgcagtgagccgagatggcgccactgcactccagtctgggcgacagagcaagactccatctcaaaataaataaataaataaataaaataccttttttaaaaagagtatattttagcatggttgattacttcagggttgttgaccattcaattaggctagctccacagaaatctgttttgcttcctaaatagcactgaaacaatgaacactttaatgccatcatgctttcttttctttccttttccccatctttaaaaaaatgattaaatggctgtagaagcggtaaaatcaaactctgtgcttgtattatactgcaggatgacccatggcccgcattcttagaattgtgccctcttaaaaccgcaaaataccttagatatcagctagttgatctagataagaaacctgagattcagagagaaaggtgactttcccaaggtcacacagtggtcagttgggggccccaaaggaaggcctttcccactgcacacatggttaatactcacagagggtggtgtccactaagcagagcctgggtttacttccccatgtgctaagcttgcttacctcacccagaggggtaatcaacacccctttccgtgtggctgtgttaccaaagctacttcttgaaattaagacaaaagagcacaaaactgcagtggtagggccctaggtacacccttcaggaaggcacatttacaatggcaattgcccaatgtatttgaaagttatgaaaaatatattttatgatagtctctaaaaagctaagcaaaaatgtaaaaaagaaagctatgaaaaatagcccaggtgtgctggctcacaccttgtaatcccggcactttgggaggccaaggcagaattgcttgagcccaggagttcaagaccagcctgggcaacatagcaagacactatctctattcatataatgtaaaaaacaatttttttaattatgaaaaatacaaggtgtagaggtcaccaccttccatggaagcatagaccacagtctagcttcccatattgcagtgaggtgtgaccactgactatgctctggccagtggatgcagaggaagtggtgtgtgtcatcatgatgtgacgtggtcctgcccataaaaatctaccacacgttctcctctgggctctttcctcttctggctgactgggatggcaatgcccaggcaaccttggccatcatatgataaaaatggcaaagcagctgccagtctggatctccaaatgagtttatgaaggtgagctacccccgaacctgcacacacacatacccaggaaagctgcacacccaggaaagctacttaagtaaaaaataaatttctactgggtaagccagtgacatttggaggtctttatgttacagccacctagcctatcctaaggaatacatggggaatctccaaagattaggagaagtatggctttaaagcaggagaaataaacagcacaggcaacacatctgttggtttatcatcaaacatgaagcaataggaaggaatcaatagaatttggagaagagtaaaacatactcatttagtccttttagaatacaaaaaaatcactgtctagctttaagaaaagtttatttatgagttactttttgagacacagaaagcctttttcaaagagaggatattagaaatgatattcaagacctcaggccctaccgaaaatttatttttttgctcaagttaatagaaaccattctaaaagtaaacaccagtcttgtggtcctctgaggcccgaggatcctcagtgggaggaaggggcagaagcaggagtggcggagcttctgagcaagggccccagaggctgaaggcctagaaggagggctctcttgtgtgtgtcttgaataggtccggaagtgaacgtggggactgagcagggcctaaggaaacactctatccagtcacctcagccttggtgagaacacaaagagaatttctccttgtctgcagatgcaaccttcttcattctgtactttatcaagggaggcaatgaattcaactaagcttccacagtgtttctgatttgatcccaaatggcattttcattaatgagctgtgaagttattttctcattcattctgaactcccccagtgatgttaagcagtactcagcatgacacttgatactacacagcagtgtggttaagagcaggggagcctcaagggcaccaacatgcatctgctagccaaccttggtgctggagctgggtccttgatgcctctgctgggctggatattaaccctttagttgctggctcatgagcaggtccttgggttcctggggaaggggcaagggaggcctggccggtggtggtggacacataggaggcttcaagcagcagctctccactaagaggcacagagggacttccacattttaacaactagtttggctgtatgtgtacaattagccctggtgaaaagtgcaagctttggaattaagatttgggctcaaatcttattccgtgacaatccatctgtgtgaccatggataactactacttatattctctgagccttagtttctcagtcaatgctagtctccctaagtcccttccccagctcacaccatcttcagagcaagcccagggcacaggaacaaagatagagaaaaaagagaggataaatgataaagaaacaaaatggactggacccagcagctcatgcctgtaatttcagcactttgggagaacgaggtgggaggcttgcttgaccccacgaaagaccagcctgggtaacatagggagaccctgtctctacaaaaaataaaaaactagcccggcgcggtggcacacgcctgaagtctcaactacttgggaggctgaggcaggaggatcacttgagcccaggaggttaaggctgcagtgaactgtgactgtgccactgcactccagcctgggtaacagagcaagaccctgtctcaacaacaacaaaaaaaaaaggaaaaagatggacagaataaacagaataggaggaatgagggagagccaagagaaaagaacaaagcaaaagagcaacttggtggaagtggctacacattattgaggagaactgcttcaggaataagtaggtcagtggtagggatcaccgcccagacttgaccttcaggttagctgggtgctcattctcacaataagtcactgaccaaaagccctgtatcatgctggggatgaactgtggagtcacctctgaggccaacatcgttaagagttagatgtctgctgggcacagtggctcatgcctgtaatcccagcactttgggaggctgaggtgggtggatcacgaggtcaggagtttgagaccagcctgaccaacgtggtgaaactccgtctctactaaaaatacaaaaattagccgggtatggtggcgcgtgcctgtaatcccagctactcaggaggctgagacagaggaatcgcttgaatctgggaggcagaggttgcagtgagctgagatagcgccactacactccacgctgggcgacagagcgagactccatctcaaaaacaaaacaaaaagagttagatatcttagtttgaatcctagctctgtcacttactagtgtatgcaaaccatttcacctctctgtagctcagtttcttcatttgtacaaaggggataatcataacacattacctatgttctggtggataatgataaatgaaattaacacgggtaaagcgctaagagcagtagctacctcataaggagtgtatgccttagccactctttatcctcccatgagtcctcccacctcgtcctcccaaagtgctgagattacaagcaggagccactgggcccggcccattctgtgtcttcatcatttatcctctcttttttttctctatccttgttcctgtgccctgggcttgctctgaagatggtgtgagctggggaagggacttagggagactagcattgactgagaaactaaggctcagagaatataagtaatagtgatccatgttcacacagttagattgtaacataattaagatttgagcccaaatctaattattatgaatcggtgacaccaagaaaagagcagtggagtcagagacattgaactcgggcagtgtcactttctaacaacttcggaattttaggaaagttacgtaagtggctgaagctcagagaggttacctgtaaaatgcgattttgttacattacaactaacatttatcgagcatttattatgtgcctattactgcacatactatatataagttctctcatttaatgttcacaatactgtggaaaagattctataattatgaccattttccagaggacaaaactgtatctttgaaaagttaagtatctagcccagcatcataaagcccagccatgacttcaagccagtttagtaagacaccaattcagtaacacgcagtgcgcacagagaatagtcatgcagtaactgttgtctctgatcccaagatcttgtaaaggcattgaaagcatggtttttgggtggcccatataatggtttatagcacaacatacacatttgaagaaagatttataatccagtgtccacaaaaaccaaagaaatgtagggctagcctgacagaatcaagaccaaggttaaggtattttgttcccaacatgattcaggatgaggcaaaacaagagaggcacaaaaatgaaacccaatgcttctgttttccagaggccacaaatctaatatcacaatatcattgataaagttatgctttatattcctgtagagagatctaaaatgagtatttacatgttaaactacagcttcacactgacctctgttatgatctcagagaatgttctaaagtcccaaactgaataaaatgtacacctaagaatcccaacaatattcttttttttaagaaatgttgtcttgagagttgactgaacccgggaggcggaggttgccatgagctaacatcaggccactgcactccagcctgggtgaccgagcgagactctgtctcaaaaacaaaaaaaaagtgttgtcccaggccaggcatggtggctcacatgccacctgtaatcccagcactttgggaggcgaaggcaggacgatcaattgagctcagaagttcgagaccagcctgggcaacatggcgaaacccattctctacaaaaaaaacacaaaaattagctgggcatggcggcgcagtgcctctggtcccagctactcagaaggctgaggtaaagggattgcttgagcccgagagatggaggctgcagtgagccatgatcacgtcacagccctgcagcctaggtaacatggtaaaaccctgtctcaaaaaaaaaaaaaaaaaaaaaaaaaaagggtggtctctatcatattcttggataggaagactcagcatcttaagatgtcaatttttttccgaattgacatgaatttaacatgttgccctccaaaaacaaaagcaaacgaacaaaaaaataggaaggcatattttaagtgggagaggaactaaacaaggcatttgaactagacaagttgatcctaaagaattttcctaaccaggaatattctgactgacgggccactagcactaccagatattaaaacacagtagaaggtcttaatagatagtatagtgttgggaggccgaggcgggtggatcacctgaggtcaggagttcgagaccagcctaactaacatggtgaaaccccgtctctactaaaaatacaaaaattaactgggcgtgctgatgggtgcctgtagtcccagctactcgggaggctgaggcaggagaattgcttgaaaccgggaggcggaggttacagtgagccgagattgcgccattgcactccagcctgggcgacaatagtgagactctgtctcaaaagatagatagatagatagatagatagatagatagacagacagacagacagacagacagacagacagatagatagatagtatatgtggtctgggagggacattaatcatagaagtcaaattatttctacaaaaacagtttcaaatacatgatccagcatacagtcaaagataaccaggtgcatgaatacaacatgagtgagagccagaagaaatacaggaaacaaaattaaactcacagagaataccatagagtgaaattattagacagcctataaacaactacgcttattatacaaaatggagttttcttcaaagggctagcaggccgacaactgccttcttaagcaccaacaacggaagccaaaagagtagaacgagagcatcagtgtgccgggaaacaaaccatgaacttagaattctattctcattttttttttttttttgagacggagtctggctctgtcgcccaggctggagtgcagtggtgcgatctcagttcactgcaatctccgcctcccgggttcacaccattctcctgcctcagcctcccgagtagctgggactacaggcgcccaccaccacacccggctaattttttgtatttttagtaaagatggggttttaccgtgttagccaggacggtctctatctcctgacctggtgatccgcccgccttggcctcccaaagtgctgggattacaggcgtgagtcaccacgcccggctctattctcatttttttttttgagatggagtctcgctctgtcgcccaggttggagtgcagtgccgcaatctcggctcactgcaacctctgcctcccggtttcaagcaattctcctgcctcagcctcccaagtagctgggattacagattggctgtgaccacgcctggctaatttttgtatttttagtagagatagggtttcaccatgttggccaggctggtctcgaactcctgtcctcaagtgatccacccgccttggcctcccaaagtgctgggattacaggcatgagccactatgtccggccaaaaatattttttgaaaataaacataaactaatgagtgagagagtctgtcacaaatagactgccactaaaggatattctaaagcagcggtccccaacctttttggcaccagggaccggtttcatggaagacaatttttccatggtggataggggtgagaatggtgaagggagaagtgatggtttggggatgattcaagcacattacatttattgtgcactttatttctattattacattgcagtacataatgaaataattatacaactcaccacaatgtagaatcagtgggagccctgagcttgttttcttgcaactagatggtcccatctgggggtgatgggagacagtgacagatcatcaggcattagattctcatatgaagcctgcaacctagacccctttatgtgcagttcataataggctttacgcgcctatgagaatctaatgctgccactgatctgcgaggaatcagaactcaggcagtaatgtaagcgatggggaacgactgtaaatacagatgaagctgtgctggctcacccgctgctcatctcctgctgtgctgttcaactcctgcctggaacccctgatctaaagggcgttcctgaagcagaaggaaaatggaccaagatggaaagttggagaacacagcatagaatgaagagcaataaaaatgataaatttaaataaatactgcataaaataatcatgataatgttttaaggggttttaataagaacaaagaaatatctaataaatttcaaatatgtatataaagagaattaaaatacatgactagcatatgagtcagaaagtgggtaaatgctaaagttatattttttaaaagacagacttccaaactaacagaggaaacagtggaatgatacaacacagacacctacatacgaaaataaaatactgacggctgggcgcggtggctcacgcctgtattcccagcactttgggaggcaaaggcaggtggatcacctgaggtcaggagttccagaccagcctggccaacaaggtgaaatcccgtctctactaaaaatacaacaattaacagggcgtggtggtacatgcctgtaatcccaactacttgggaggttgaggcaggagaatcatttgaacctgggaggcagaggttgcagtgagccgagattgcatcactgcactccagcctgagtgagagagtgagactccatctcaaaagaaaaagaaaagaaaagaaaagaaaatactgacacataagtagtcaaaacaatggaatgggatagaaaatccagatatatgttcaagtatatatgggaatttagtaaatgataaaagaggtgtatcataccagtagagacaggaactactgaataagtggtgttgggacaactagatattcatctagaaaaaaataagttgtatctataccttgtaactcataccaggataagtcctgagtaaatcaaatattgaaatgtgaaaaattaaaccacaaaggttctacaagaaaacataggagaatcttttataatctgaaatgagacctttctattctgactcatgatccaaaaatcacaataaaagattgacaattcaactacataaaattttttttaaaaaatacaaaccaggtgggaggagggtgcgggataaaagactacactttggatacagtgggcactgctcgggtgatgggtgtacccaaatctgagaaatcaccactaaagaacttatctggctggacacggtggctcacgcctgtaatcctagtactttgggaggctgaggcaggcggtcacttgaggtcaggagttagagaacagcctggccaatatggtgaaaccccatctctactaaaaatacaaaaaaaaattagccaggcgtggtggtccatgcctgtaatcccagctacttaggaagctgaggcaggagaattgcttgaactcgggaggcggaggttgcactgagccgagattgtaccactgtactccagcctgggcaacagagcgagactccatctcaaaaagaaaaaaaaaaagaatttatccatgcaactaaacaccacctgttcctcaaaaactactggaaaaaaaaaaaaaaacccaccaggtgtggctcaccctgtaatcccagcactttgggaggccgaggcgggtggataacctgaggtcaggggttcgaaaccagccttgaccaacctggtgaaaccccctctctactaaaatacaaaaattagctggacctcgtggcatccgcctgtaatccttgccactagggagactgaggtaggagaattgcttgaagccaggaggcggaggttgcgccactgcactccagcctgggtgacagagcgagactccatctcaaaaaaaaaaaggcaatgtggaagctctcaatgtactgttattgagaaatcttcaagatatattgttaagtgaagaaaaacaagctgcacctaacattctactttttgtggaaaaggagaggaatagaagctctaagtgtatttacttgcatagcattaaaaaattccctaaagacagattagaaactaagaacagttggtacccacatgtagtttatttgaacaaaacaacaacttaataatgaaagtgggccggctgtggtggcttatgcctgtaatcccagcactttgggagaccgagatgggaggatcacttaagaccagcctggtcaacatagtgagaccttatctctattttttaaatttaaataataaaaattttaaaaaataataataatgaaaaagtcttcaacattatgcattcttcaattttcctgtgagcctccttgtttattcatttgaaagtacaatatattaaaattcaccacaaaattgcagaagtgggccggatgcggtaactcacacctggaatcacaacactttgggaggccgaggcgggcggattacttgaggccaggagttcaagactagcctggccaaaatggtgaaaccctgtctgctaaaaatacaaaaattagctgctgggtgtggtggtaggtgcctgtaatcccagctaattgggaggctgagacagaagaattgcttgaacccaggaggcagaggttgcaatgagccgacattgcgccattatactccagactaggtgacagagcaagacttcatctcaaaaaaaaaaaaaaaaaaaaaattgtagaagtgttttctatccctagttgagaactgaagaagagaaatctaaccagagaatttggtaagcacatcttatatgcattttttaaagacattaattccagttatccctggtactgggactgcaggtgattttaattatctcctttgtgttctgtgtttctccagggccactgttaattttataattagcttaaaatttgttcaaataaagtaaatattataaagagaaattgtcttcagtagttaagaaaaggatgaaattttgagtttgagggtaactaggctgggcatagtggattatgcctgtaatcccagcactttgagaggctgaggctggtggatcacttgaggtcaagagttcgagaccagcctggccaacatggtgaaaccccatctctacaaaaaatacaaaaattagctgggcatggtagcatgtgcctgtagtcccagctactcaggataattgcctgaacccgggaggcagaggttggtgtaagcctagatcatgccactaaactccagcctggggaagagacagagcaaggctctgtctaaaaaaagaaaagcaagaaagaaagagagagagagagaaagaaagaaagaaagagagagagagagaaagaaagaaaaagaaagaaagaaagaaagaaagaaagagaaagaaagaaagaaaaataaactttgactttgagggtaatgaaaaattggaacagtttcctaagaaagataatcataatttccatttctgtaaaactttataaaattgtattagacatctttggtttaaattttcatttgttaaaggctatggtggatcagatgaccttttgccacaaagctttcatagcaaccgaagagcagtgtttagaatatttttcacttaaataatgaggaagaacagggctgactgcacgaggtggaagaatccagattgtgcaaatggtcttccgttctgcagcctctctgcagttgttgtgggttattagacttccgagatctaaatattctcccagagtgtaggaaactcctcctaaagttttacataaaatataatctcattatttcagaaatagactgggtaaaactagtaccatgagaagaaacaagcttttcagttaagaccgagtttaattctggtttttctaagaaataaagacttttatttgtttgattccagagaacctcaggggacacccgactgagacaaactgaaaagttagaagaaagaatttccagattccaaaaataattcaacagaatgactcttttcagaacgttagacaaacctgtattctgtaggtatgttttagaatctcataggtaatcacaagattatagatgacagggaagatgaaaaagtcaaggaagctatcaaagtattggaaatgggctgggtgtggtggctcacgcctgtaatcccagcactttgggaagctgaggtgggcagatcacctgagatcaggagttcaaaaccagcctggccaacgtggtgaaatcccatctctactaaaaatacagaaattagccaggtgtggtggcatatgcctgtaatctcagctactcgggaggctgaggcagaagaatcacttgaaccccggaggcagaggttgcattgagccaagatcacacaactgcactctagcctgggcaacagagtgagactctgtatcaaagaagaaagaaaaagcatcagaattggcaaaactggaggaaaagaacaaaaaatgaagagaacatcagataggttacgaagataatcagtttgggtcaattcccctaaaacatgggagctgccatagacccctcaaggcaatagttttcaattgggaaccatttgggtccccaagaagttatctggcaacgcatgaagacatttttggtggtgggtgctactggcttctaataagcacaggcatactgctaaacatcctataatgcacaggaaaaccccttaaaacaatccaaaatatcaactgtgccaagattgagaaaccctacattgaagaatactggccctacagaaacactgaacagacactgtaattcacaaagggaatgttattaatacagctacctataaagaaataccaaggaagctgggcgtggtggctcacacctataatcccagctttttggctgattcaggcggatcacctgaggtcaggagttcgagaccagcctgatcaacatggagaaacccggtctctacttaaaaatacaaaattagccaggagtggtggcgggcccctttaatcccagctactcaggaggctgaggcaggaaagtcgcttgaacctgggaggcagcggttgcggtgagtcgagatcgtgccactgcactccagcctgggcaacaagagcgaaactccatctcaaaaaaaaaaaaaaaactaccaaggaatagctacctataaagaagtctccccaagttaactgaatacttaaaatttgaatacttaatggttttgtccttaatccccgttggaccactttgataagggctactgtgtgtctgagtgaccaacccatgccagtttgcccaggactgtcctggttttagcactgaaaggacaaatgaagccattctgtccgccaagagtacagtgatatttggtcatctggaattttctctcttttgaagagaaacctcagattccttcatggtttcctctgtgcttgttctcacacattaccaagctcctgaggcctggctccagcagggagagaaagggtctgatctcagaggtgctctctgatccagaggaagcccagaagaaatgggggcctgccagtgctggtggccaggagggcattgttaatagctcatctggttctgtcgccacccaaggcagggttctcctttggatcggacactggggaagtgttccttccctgcaggctcacatagcttgctaagaggcatctttcctcacctcctcctggggcagtgccccaggcaatggaatgcattccttgagaaaggatcccttacatgctttcccttatctttcccagattatgccctttcttcagcctatttctttttttctttctcttttctgttttttttttttttttgggggggggcggagacagggtctccccctgtcacccacaatcatatttatgcctgatcaattttttaaaaaaatttttttgtagagatggggtcttgctatgtcgcccaggctggtcttgaactcctagcctgagcaacatagcaacagccaccatgcctggcctccaagcctatttcttacaaaggtgaaactttctaactactacctagcccctgtgatcaacttacataacatatatgaaagcattttggaaactgtaaaatatcagacaaacgtaacatactaacatcacaatgagaaatcatttgtcatttttcttttttaaaagagacagggtctcactctatcgcccaggctggagtgcagtggcatgatcatggatggctcactgcagcctcaaacttctggcctcaagtgatcctcttgcctgagcccctcagggtgctgggattacaggtgcaagctcagctcatttctatttttgaagttagcaactgagggttgtttcactttctagatactttaaattcccgtgtggcaggcactgttgtaaacactttgcatgtgttatctcatataatattcacagaaatcctgatgatgatgatgatgatacccattttatagatgaagaaactgagataggatgacattaaataactttcccagggtcacagagctggtggagctgagtgattagattcagacaggctggctccaaagtccatgctgaatgctacctgtgactcaagccaggagaaaaaaaggagttgctcaaataaagcgtccctggcagtaacgaatcattaactttcagcccactccaaggaatgggtggcctgagggtcacgtgctaaagaggaaaccctgagtgagtcaatcatgaacacatgactgttcttagttccttataggtttgcttcctcaaatagccttcctggagtgctgagccaagagatggattgggaccagtttcagttctgggaaaggggctgaaccccatctagccaatgcctgcacccacgcttcagctctgtgcatgctggtggccgaatctaacacaggccacagggacttcctcaaactgggaaatgcctgctcatgttgtcaagagtcctcagcaacagcttgtttgccgactaaacaaggctgccacctcacacaggcagcctcagaaagatcagggagttaatagttacatgaagacagctcagagaacagctcaagtgacagtccagacaaatgcagatcgtataatgggtacctggttagattctgtttaaaaaaaaaaaaaaggatgttcctctctgctatttattccctgttccaatttttttaaaaatcctgttttccctttcctgatcctcccttatggtatctcatacttaaaaaaaaaaaaagtctgggataagctgatagtcacaaagaaacaggaatgcaacaaaccagaaacccaaagccccaaatctctgccttatcacagaccgtttaaaactctggagttttttcctacttcagcacatatctcaagattagataaatgtggtaccattgtgttactccctggtgaagaaaccaacaaactgtccaataaaaattacaggaagctaggagcggtggtgcgtgcgtgtagtcccagctactcagggggctgagatgggaagatggcttgagcctaggaggtcaaggccagcctagacaacacagcaagacctcttctcttaaaaaaagaaaaaaagaattataggaggtcactgttttggactaaacttctgcaactagggcccaatagaccagactgaaaatcaaaatggagtcacccaggctaaagttccacatcacaaaacagaaactaagttgttgtctgaccttctcagtaatcaggacgaagaaataacaccaaatttcttaaatgggccagtttcaaatctttaattggcataatgaaactccctgctttaatccttaaagtaatctgatgttatttttctgttgttctgtctcctgttgtcccattccttacaaaaaaagtatctttgaaacaattaatatactttaagttctttccttctactttataaagccaagctcttctgctcggctgactggaacccttttcctataatatggaaggaagtgttgcccgattctagaaactcaaataaaagcaattgagaactttaaactaaatttgttgcaattttgtcttttgacacataggattttcctcctgacacttatagacaattgtagaataaatggcctccctctgcctccattttctacttccattcattttcagtgttcttagctttttctttctacatgcccaccacttagatttcattgttcttccatctgaaagctttgcttatggccttttctatcattttctcttctaccttaacttctagagttattatgttacctaggacaagagatatgacttctcactgcctcagttcctcatctgtaaatggtgctgtgtagcagggcctgctgtaagggctaaggggtaacgcacacaaagtgcttggcacaatgctacacacagtaggtgctcaaaatgtgatagcaagctgggcacgatggctcacgcctgtaattccagcactttgggaggccagggagggcagatcacttgaggtcaggagttcaagaccagcctgggcaatatggtgaaaccccatctccactaaaataacaaaaaattagccagacatggtggcgtgcacttgtactcccagctactcaggaggctgaggcagaagaatcacttgaacctgggaggcggaggctacagtgagccaagatcatgccactgcactccagcctgggcaacagagcgagactctatcttaaattaaaaaaaaaaaaaatgcagccaggcacggtggctcacgcttgtaatcccagcactttgggaggccaagactggcggatcacgaggtcaggagactgagaccatcctggctaacacactgaaaccccatctctactaaaaatacaaaaaattagctgggcatggtggcacgcgcctgtagtcccagctactcaggaggctgaggcaggagaaccacttgaacccgggaggtggaggttgtagtgagtcgagatcatgccactatactccagcctgggtgacagagcgagaccctgtctcagaaaaaaaaaaaaaaaaaatgcaatagcaaagaaacaaattggatgggaataactagttcagattctctaggtaaaactctataactttaagggtaattatttaaaagttattaaaattataaaaaataagatctgacttaagtgggaactagattacctattttagggagatgatatgaagaaaatttacccatcttatggaggtggttcaaatcagagcacttctccatacacgagtcaatctacattcccaagaagctctgaagcatttttctctgtgggtctttgctggagttattacattgagaaagtaaactttagggtaattttttttttttttttgagactaggtctcactctgtcacccaggctggactgcagtggcacaatcacagctcactgcaacctctgcctccctggctcaagggatcctcctacctcagtctcccatgtagaggtgaccacaggtgcacactaccatgcctgtctatttttttaaattattttttatttttgtagagacagggtctcgccttgttgcccaggctggtcttgaactcctgggctcaagggatcttcctgccttgacctcccaaagtgctgggattacaggagtgagccaccgcttccggcctacttttagaggatttataaattcgaattggtctaagttccaacatgccaaatatcctggacctctcaccagtaaaaaattttccttcagttgaacttggtttagttagcaaagtcaaatgagtccacttcatggatattttctaaatgtgtttcctcatacttttttttttttaactcttagaatccaagtgactcatctgtgtgcttgaatcctttccactgtctcatctccctcatccaagtttctagtaccttctctttgttgtgaaggataatcaaactgaacaacaaaaagtttactctcctcatttggaacctaaaaactctcttcttcctgggtctgagggctccaagaatccttgaatcagttctcagatcattgtggacaccagatcaggaacctcaggcacgtgggaaggccagataattaggagggatgctgaagagaaagcccgatgaccacagcacggtgatggtttaaaggccttgaaatttggttaccatcattccccaacccaccaaccgcccatgggctgcattcaccagcacgcactggcagccgcagccacccgttctctttccttgcattgctgagcaagtttcccatatcattcagttaggctcagctctcacacatattgaggaatgatccctaccactgctcgcacatgaatgggaaaggatgtacaatacataaaggcagagacaggagaatttcagacagtggtaaaagttgtgaggtaaataaagcagaggaatgggacagagattaacagagattggtgagagagagaaggccactctgatatttgtgctgagagttgaacaaagagacagggagcctagcaaggatctagggaaagagcaatctaggcacaaacaagggcaaacgccccatggcgggaacaggtttgttcattttgttttcgctttaattccaggaacaagaatctgtggctggaatctggtaatggaggcagaggtgggagcacagaggttgggaggtggccagaggtcatgagctgaaaaactcatgagccataggagggagcttgggttttagtctaaagaaaaggagaaagccgggcacggtggctcaggcctataatcccagtactttgggaggccgagatgggaaggttgcttgagtccaggagttcgagaccagcctggacaatatagtgagacctcatctctacaaaacatttaaaaattagctgagcatggtgacatgcgcctgtagtcccagctactcgagaggctgaggtgggaagatcccttgagtccgggaagcagcggttgcagtgagccgagctcacaccactgcttccagcctgggtgacagagcgagaacttgtctcaaaaaaaaagtaataataaataaataaataaataaataaataaataaaaggagaggtcattggagagtgttaagcttgcagggggactctggggaagatgaagaatgagaaagcatctcatagagatggtttgtttggtttcttggaggaagacttcttccaggttgatacaatctacttgtgagtggatgagaaggtgggggtggtgggggaagaggtgagattaaattatctcttcttcagaagacagctcagaaaccacagacagaaaatgccttaaaagataaccagagagccttcagggtgtgtgtgaagagaggctgcagcccaggtgtatggcatcagtcctgcaagagggaaaagaagtgaaagggagcttcagcagctcccacagtcacagagctcgggagcccagctgtctcctgaacgccagccccaggagcaaccagacctccctcctccactctgtgagcagcgcctcaagctcaccatatccaatgctgacctcattatctcccccgaacccgcttcccctcctctgcacccatcttagcaagtggatcgccatcccccaggtccctacaccagaatcccggttggcgcctctcactcctgctcctacactcccttcacccagtcagtcactgaggcttactgagtccactcccagaacccatctcgaatcttcatgtctcatctccctcttactatccctgcagcctatgtcttagttcaagttcttcactcagaccctcactatagcttactaacaggtgccattcctaactctagtccttgttgccaaactaatctttccaaaactaagatctgggccaggcatagtggctcacgcctgtaatcccagcactttgggaggccaaggcaggaggatcacctgaggtcaggagttcaagaccagcctggtcaacatggtaaaaccccgactctaccaaaaatacaaaaattagccaggtgtggtggtgcgtgcctgtaatcccagctacttgggacgctgaggcaggagaatcgcttcaacccaggaggtggagggtgcagtgagccgagattatgccactgtactccagcctgggcaacagagcaagactccatctcaaaacaaacaaacaaacaataaaaacaaaaactaggatctgatgacatcactcactaccaatagtcagcaaagcattccaggatctgttccctgcctcactccaactccatccttccgtactatgaccccatatgccatacaaacttgtcacgtttcctgaacacattcttctggctccgggctgtttcatgtgttgcactgagccctctacctgtttcttcttcaaccttataccctactctcaacgcctagtcagtcatcaaaaccattcaattgtcacctcctctacaaagtctagtcaccaccctggtagaatccatgtctcattaccacccttgcccatgctgtactctcttccaactctatcagagcaactgtaacattgcattgcccttatttataaactctttctgctagtgaataagcacctcgaaggcagcttagcacatagcaagtgctcaatacacactcaaaaatcaaactagtagagtaagtggaatgtgcgaagtacagaagagacagggaaaaggagcttcaaggttatgggttaattgcagaatgggaataaagaacaagaaagagcaaagggagacaaaagcaaggtcaggccggccaagcacagtggctcacgcctgtaattccagcatttactgggaggctgaggtgggcagatcacttgagtccgagagttcaaaaccagcctccgtctctactaaaaatacaaaaaaaattagctgggcatggtggtgcacacctgtaatcccagctacttgggaggctgaggcacaagaatcacttgaacctgagaggtggaggttgcagtgagccgagatcacgccactactccatctcagaaaaaaaaaaaaaaaaaaaaaaaaaagggaaacagaagctggacaaggtgatgcacgcctgtagtcccagttacttgggaggctgaggaaactcctggcctcaggagttcaacactagcctgggcaatgtagtgagaccctgcctctaaaaaatattaattaactaattaattcttaaaagcagaatgggccaggcgcggtggctcatggctgtaatcccagcactttgggaggccgagacgggtggatcatgaggtcaggagatcgagaccatcctggctaacacggtgaaaccccgtctctactaaaaatacaaaaaattagccgggcgcggtggcgggcgcctgtagtcccagctactcgagaggctgaggcaggagaatggcgtgaacccgggaggcagagcttgcagtgagccaagatcacgccactgcactccagcctgggcgagagagcgagactccgtctcaaaaaaaaaaaaacaaaaaacaaaaaacaaaaaaaccaaaaagcagaatgattaaatatattttgtgatttattataacatggaatttgtttaaaatgcaaatctaccatcaaactctgcatttatttttttgagacagggtcttgctctgtcaccctggctggagtgcagtgacgcaatcttggctcactgcagcctccaggctcaagcgatcctcctacctcagcctcagagcagctgagactacaggcacgcaccaacatgccccgctaatttttgtgttttttatagagatggagtttcaccatgttgcccaggctggttttgatctacttggctcaagcagttctcctgctccggcctcccaatgtgctaggattaccagtatgagccaccgtgctgggctggttgttcacttattaaactgaacacgtcacacatcatgacactcccccaaggtaagctggtaaaaaccctgtgagccatgacatggaaacttccactccaatccatcagaccagtgttgtccattataaatgcaatgggagacacgtatttgattaattttctagaagccacattttaaaagcgtaaaaaacaggtgacaattttaataatatatttcatttaacccaacatatccaaaacattgtcctttcaacatgtaatcagtataaaaaactattaaactgagatatttcatattcctttttacatttacagcacatctcattttggatgctagatttcaacagaaatacttggtatgtattgcataaaatttacagtaaaaaaagtagatctcacacacacacacctacatgttgcctcaaatgtacttacaagcttcccaataaagttgtgtttaacaaaaaaaaatgtacatggcttcagtttttaaattcaaattaattaaaataaaagattcaactcagttgcgccagccacatttcaagagccacaggtgactggtggctcttatatcagatggcacagctatagatcatgtgtgtttgtttgtttgtttgttttctaatgctcaaaatggaaagatcagaaagctgatggagtctcagctagtgatacaaagaatctgttccaactaatggaggcgcagtgaccatatctacaggttccactaaagttgcacaacctgtggctgaaaattaaggcagagaaaatgactaggggacattattaattcactactttgcttttctaacaggtttcattcggggtcattaagtgaatacctagtccatgtgactggactacttaaagttttatcctcacaaatccttgtttgcaaaatcaagaaaactaagaggattaagtgtttccatgttagttaaactaggaaaacagagttgctgctatttattttaaaactttgctgtccataggggaaaaaaatgggtatggaatggaatttgtgagccaaatgaaaaagaaaagaggaaaatgagatcaagttcctttgagcctaattcatatggatcttccatttcagagccccagaacaagctttcaatcatcaagaactatgacttttattgtagaggtaagaaagcaacaaaatcgccccataaatattcctaattgtttcaataggctctaataaactgacttttaaagatcttgtgtaaagaaaaagcacgtacattataactgcctattgttataggcctattgcctcatactagcagccttgattagccagagtaaccacaataggtggggtgtggtggggagttttcaaggcaaagcctgtcttagcacccatacttcacaacaaaaccaaagcgaacccaagcagtcccacatgacaaaggtgttccggcacacgatcaagcacggtttattaaccatgcccctgctatcagtaatgtgactgtgatgggtcatccatcaagcacggcacataggacacagcatctgtcgttcactgctgatgcccagcagcaaatatcatatctggcaaacagcaagcactctagacctatgtgttgaatgagtggatgaattaacacattctagggaacagagcagagtgggcattctgtggaagtctggaagcaggtaagcaggacggtactctttatctctggcttcctcccccaacaccaagctccttctctataaagtacatttgatggtttcaaagctactcagcccgagtgttactaaatgcccagcactatgcaaaacgccatggggcagaaatccataagaggggatacacttcttgcagaattaacatgttagggagatagcataaatccccccaccctcaccacacccccacttcactctcctctgcactgtgctgaatgtgagcataactgcattggattctgatcggttcatcctgctgaggtttgaggtaaagaactctgttgagtcatggaggttgtgtaagtgtctttccaaaagattgtgataattcttactgtcaaacaccttgaaaagaagaggttcctcaaaccagagaaagagagtctggaaggtaagcctttgaccaccaggagacagaaacagagttaggggcttttctcctgggtgtggagtcagactttttgaaagcaggcatgttggagggtgctcctgggtaagaaggggttaatggcaagggctgttgcagggaaatgggagggagagagtagaggcagagatgaaaacgccttaccctgttaaccagaacagccattgcatattccgttctgggttaattccaccccaagcatcctagatccagcttggcgctccgtccacttttcaagtgagaatgggactcctgagaacaggcaggcaggggcaatggtaattgatgagcgctggccaacgagaaggtggaccttggaagcaagagtcacagtgaagaaggcaaagaccccaccggtgacctctctccattgtgaactttcatgacgggtgtcttctggggtttccttatagaagacagtgcacacagtcacagtgggtcaatccaagacagtggcacggtatgaaggggcaggaggggattcacaacagctgtgtgcaggcagctgccaagcatttcagacaacggcatgaccttgggcacatcacgtgatttcctcgggccttagtgttctcatttataaaatgaggggtttagtaatatccacattactaaagggaacttcctgctccggcatcagctaccaccctaaacactcaaatgtgtgatacaggcaaagggctggaagagccgtgaggaggggtccacctggggtgcatggaaagggctttgtgaagaggcaggactctgaactggggctgaggaggaggaggaagattcaggcatctagagacaagcgggggaaaacgggaagaacagtttgaacagactcagaggctaggatttgggaatatatggggtgcatctggggaaatcctcactgctgactcaggagagcatattaaggggccacaggtagtgctcagggaggaactgtggggcagggatgggggttaacactaagaagagaccagaaggccctgaccaccctcactttccctcagtctccaaacatctatccattcaataaacatttatgaagcgctaggagccaggggcagggaacacacagaaagagaaaaagaagacactgtaaatatgaagacataataagtggaactgccccttccttctgcttctaagaacccttttccccttggggcatgttttgcagtttaacttgatttcaccaaataacacattggaggaatggggtggggaattctcagaacctttacttaaaagggaaagaccttccagcactttccttaaccctcctgagccttggtttctctatctagataatgggcgtcataacacccctcaaaggtaagaattacctgagttggagaggtgatgccacggtaaataggattgctaataaaatgagacaagtaaatagtaatgctgacatgctggttactggtattttgactgttttcatttcagaggaggaaaaaggacaaaattgcagttccaaggaattatagtgagttgctcaaggcaagggtgactaagccagccctgaaatggggcctcaggctgccctcggctagacaacaccatgggtaatattgcagcctacatttcttctttttgtcagcaacatgatagaatctcttttttgcctggccagttcatggggccctgcaattcagaggaccagtggcacacagcaaacacaaagccacgaggtgtactggggtgcagccaaagacagttgccacataaaataaaggatacgcagtaaatctgaatatcagataagcaaccaataattttcatttgctaaatatagtaaccttagaccaacaagaaagtcagggctgcctacagggtgagtccagcaggctttggggggaacattccagcttcccagggctctatcatttaaaatgcaacgctcctcaaccaaggtaatcactcctgggccagtttccctttcaggattcaaagtcccaaaattgaacactcaaagaaaataatgacaaggacctagaaggtccttacacatgtctaattcaaactgaacctttcctcaaaggaggaccatcataggaagaagtgttagggtcagggagcaagctatgttactctcttgaaaacacgaaattatggacagcataaaagatttgatttctgaaattcacacagcaggtcactgacagggatgagagcctagaaggtatggtggtagctagacttcgatccagcacacacatttattttagctacatccatctccatcttctcagatgcccgttggagatagctgcctggttagtcttggggtgtagtaatgagccattacaagtataaattactttcttagaatgaagactccaaaaagagatcctgaatttactggcccaagggaggagactgcatcattagttaataagcaggagcaacaaggagagacattggcatagttcagcaacaggggcactggaatcgtggccgacgtgtttgctgttatgttctctttcagtccctttttgtgtgccatcaaaaactctgggatttgattagaaattgcttaagttttagttttaggggaaagaggttagaggaataatagctaaagcgtttcttttttttttttttttttttttttttgagacagtgcagtggcgtgatctcggctcactgcaacctccacctcccgggttcaagtgattctcccacctcaggctcccaagtagctgggattacaggcacacaccaccatgctcagctaatttttttagtagagatggggtttcaccatgttggccaggctggtctcgaactcctgacctcaagtgatccacctgccttagcctcccaaagtcctgggattataggcgtgagccacagcacccggcccaaaggtttctttttgaagtgattaagatgttctaaacttactgtgtaaaatgattgttgaaatgttcccaaactgtgtgagggttgcacatgcctgtgaatatactagcatccattgaactgtacaatgtagtttttatttatttatttatttacttattttttatttttttgagatggagtctcgctctgtctcccagagcctgctttccatgctggagtgcagtggcacaatctcagctcactgcaacctccacctcctgggttcaagccattctcctgcctcagcctcccaagtagctgggattacgagcacacaccaccatgcctggataatttttttgtatttttagtagagacggggtttcaccatgttggctaggctggtctcgaactcctggcctcaagtgatccacccgcctcggcctcccgaagtgctgggattgcaggcgtaagccaccgcgcccagtctgaactgtacaatttaaaagggtgaattgtacaacatatgaataatatcttaataaagctgtttttaattctggcatttaggaacatgaggagcacataagacactgatcaagaacactaatcataagtacctggaggggcaacaaaggcaatgagacaggcggcggctttcatttcttcttttctacttttgatagaatcctgagcccaacaatctttcactttccccttaacgcctattagaaaaaaaaaacagcagctcaaatgtttcctgaccttcaggctcatcaaggtttgggggctatgatgaattgagaagcctttccccaaacattagggacagaagcccacactccattctagctgagagttgccagatcggggaataggccaggtactgagaaagtttttttgtaacaagatggaaatctagacgtgtgcacgcctgtgtgcctgtgtaacatcttaaattttaaacattgtcaactgattcactttttaaagatcggagctgggcatggtggctcacacctataatcccagcgactccagaggatgacacaggaggattgcttgagcccagaaatttgaggtgacggcaggccatgatcatgccactgtactccagcctgggcaacagactctgtctctttttaaaaaaaaaacaaaaaaaccccacaaagactgggcaagacaacagtgcacagaagagcaagcaaacatcttgggggcctcctattacctgtaaactctctatttgcaacctctcatcttggaccccagtctccaagccttagacacattgcctcacctggtgaatgacattgtgaataagagatcagcttttagctttgttgtggttatcttaaaaagcaacagcccaaagggcggaacaacccaatatccatcaacaggtgaatgaatatacaaaatgtgatattgtccattacaacagaatattattcagtcttaaagaaatgaagtgctggacatgccataacatggatggactgtgagcatatcatgttaagtgaaagaagccagacacaaaagtccatatattacatgatgccttttcttttgagatggagtctcgcactgtcacccacgctggagtgcagtggtgcgatcttggctcgctgcaatctccgcctcccaggttcaagtgattctcctccctcagcctcctgagcagctgggaccacaggcacccaccaccatgcctggctaatttttgtatttttagtagagtcggggtttccccgtgttggccaggctggtctcgaactcctgacctcaggtgatccacctgcctcggcctcccaaagtgctaggattacaggtatgagccaccacaccctgctgcatggttccatttatatgaaaaatctagaataggtaaatccacagagacagaaagcacatcagtggttgccaggggctgggggaaggtgggatgaggagtaacttcttaaatggggacaagggtctccttggggggtgatgaaaatgtgttggaagtaggtagaggtgatggttataccatattgtcaatctactaaatgccacagaattgtatactttaaaatagttaactttacattatgtaaattttggtctaaaaaaaggcaacaacatctgggataagaaaatcagatatgtgaccaagcgtggtggctcacacctgtaatcccagcactttgagaggccaaagtgggagggttacttgaggtcaggagtttaagaccagccttaagaccagcctggccaacatggtgaaaccccatctcaactaaaaatacaaaattagctgggcgtggtggcatgaccttgcaatcccagctactcgggaggctggggcaggagaattgcttgaacccaggaggcagaggttgcagtgagctgagatcacaccattgcactccagcctgggcaacagagcaagacttcatctcaaaaggaaaaagaaaagaagaaaagaagatatgtggggagaatttcacagttaccctaatgagtaataggttctacctgagacaagggctctccagagcgtcaacactggagtggagttctctagccttttagagagggcacaggacacgtacaagtgaagacatatggcagaaagagcacgtaatgctcaggaactggcaagaatttggtgggaggtaaatttatgtgaaaatggaacctctcaaagttaatatatattttggatgcctaggagagcttcaccatggtaatctgagagagcatcacttcccaaaacaatgctttacccctcaggaaaaatgcttgttcataaataaaacaatgctatgctcatttataataggagtctctccatttccagaagtccaccatttcccattcagatttcaaatgcagaatctttgacctgtgactctgcaaaaactagcatcaaagtagagtacaggggaatcatccgtttgcaattattaacttattttcctcttatttacaccacctggtatcacatttactttttcttttacttttttttttttttttgaggcaggtcttactgggtcgctcaggctagagtgcagtggtgcaatcacagctcactgcagcctcaaattcctggactcagcagtcgtcccacctcagcctccctaatagctaggaccacaggcatccacctggcttaatcttttttttttctttttttttttttttaagacagagtttcgctcttgttgcccaggctggagtgcaatggcatgatctcagctcaccgcaacctccgcctcctgggttcaagcaattcttctgccccagcctcccatgtagctaggattacaggcatgcgacaccatgcacgccgaattttgtatttttagtagagacggggtttctctatgttggccaggctggtctcgaactcccaacctcaggtgatccgcccacctcagcctcccaaagtgctgggattacaggcatgagccaccgcgcctggccaacttttgtattttttgtagagacagggcctcgctatgttattcaggctggtctcaaactcctgagctcaggcaatctgcctgccttggcctcccagtgagccacagcactcgaccccttatttcttcttgtgaaactgaaatggcatctgaaccttagttaggtttactaacgtcctcatccaatttagaatcaatgcaaacaatttgggacatatatatatatatatatatatatatatatatatatatatatattttttttttttttttttttttttttttttttttgagacggagtctggctctgtcgcccaggctggagtccggtggcgcgattttggctcactgcaagtccgcctcccaggttcacgccattctcctgcctcagcctcccgagtagctgggactacaggcgcccgcgaccacgccaggctaattttttttttgtatttttagtagagacggggtttcaccgtgttagccagaagggtctcgatctcctgacctcgtgatccgcccaccttggcctcccaaagtgctgggattacaggcgtgagccgggacatacatttttataaaaacattaaataattttttaatgtttttataaaatgaaagcactgaataataccttcagtatttaacaatgaaagcactgaataataccttcagtagggaggcccctggaagatcgctttagaaatacctgaaacactgatacacctgtacatccctgccaagggaatcgcttagaaaatcatttttctcgggaggccgaggcaggtggatcacctgaggtcggaagttaaagaccagcctgaccaacatggtgaaagcccatctctactaaaaatacaaaaattagctggacacagctgggcacggtggctcacgcctgtaatcccagcactttgggaggctgaggcgggtggatcacgaggtcaggagatcgagaccatcctggctaacacggtgaaaccccgtctctactaaaaatacaaaaacaaaattagctgggcgtggtggcgggcacctgtagtcccagctactcgggaggctgaggcaggagaatggcgcgaacctgggaggcagagcttgcagtgagccgagatcgcgccactacactccagcctgggtgaccaagcgagactctgtctcaaaaaaaaaaaaaaaaattagccggacgtggtggtgggtgcctgtaatcccagctactcaggaggctgagaggcaggagaatcgattgaacccaggaggcagaggttgcagtgagctgagattgcgccattgcactccagcctgggaaacagagcaagaccccatctcaaaaaacaaacaaaaaaaagaaagaaagaaagaaaagaaaatcatttttctcttctctacccccacccccgcttccacccacttcaaatatgaaaatctccacgctgccctgtttcctccaccagcactgtataggaataagaaagacaacagaaagcatattctgctatggtcaggaatatttctcttaatttgagggtacacacctgaggccattgcacactgcttctcagactggctctttctgagatgttttgtaaaacagcatgttccagtgtctttcacatcttttgtactgagatagcaaatctgcaaggagtgacattggaccaagataggaaaagtcaaggccttctggtacgacagtcttccagaattgacgacacagcttggtctcgaaagctctcattatacggctacacgtcttactggggaggagcatataaactgtcaaagctactcctctgcatgacattcaaggcctcgcctaaccggacctcaaccctatattctcttctctccctctatttcacttcattcgtggtcaaaccgagccactctcttgtctctgttccctatatgcaacctgatatatcagtctcaatgcctttgctcatgctatcctcatagcccagaatattcttgctctgaattccatggacccaaatccttgtttctcccggccacctccttcaagaagccctcctgactgtctccctcctttccactccaatttctttctgtatctcttttgtaagtactatcactctctaccttgattttttacctagtagtacttatcattttctatggtttattattttatttcatgggctcctttaagagcacctcgaggttgaagactgagtattactgtatgattaatctttgtattctatcttttttggcaggcaccacagattgccacgcaatagacattcctctcttctttgctaagagagctccaaggtctcgtagctaacagatggactgcttggcttcaaagctcttgaaccttaccactatgctatcaagcaccccgtgtgcttaacactatgcattcttcagcttttcttggaggaggaaataatcagttgagacaattatctccataattctggcctgggaagggggaatagccatcattaaagaaacaaggaagggctgggcatggtggctcatgcctgtattcccagcactttgggaggctgaggcagcagatcacttgaggtcatgagttcgagaccagcctgaccaacaaggtgaaacccatctctaccaaaaatacaaaaattagccaggcttggtggcaggtgcctgtaattccagctactcgggaggctgaggcaagacaactgcttgaacccgggaggtggaggttgcagtgagccgagattgcaccactgcattccagcctgggcgacagagcaagactatctcaaaaaaagagaaaaggatagaaaagaaaagaaacagggaaaagttatgatttgtttttgcaaaagaaatggaaatcaccctatcaattctttatcatttatgtttaaaagatcaggccgggtgctgtggctcatgcctgtaatcctagcactttgggaggctgagaaaggaggatcacttgaggtcagaagttcaagaccagcctggccaacatggcgaaaccctaaacctttgtatatttagtctcttctaaaaatacaaaaattagccaggcatggtggcgtgtgcctataatcccagctacttgggaggctgaggcaggagaattgcttgaacccgggaggcagagcttgcagtgagctgagatctcatcactgttctccaggctgggcaacagagtgaaacttcgtcccccctgccaaaaaaaaaaaaaagagatgttatttgctcaattactttttgctggtcttcatgtatctatctgcagccagtgtggacgcagcctctctgcacgcagtcagtgtttgataagctagcattctaagccacagaagacaaggaaagctgcaagggaatgcaatgtgcctaatcagagacatgggcaaagcatgctgctaagatgagaactttcaggagcagggacgtgactatccttggagctgttctttctgtcacaggacaaatggaatttgctggttttgtcgacatgaggtgggaaaaggaagagcaagaggaaagaagcttaaagcagaggaataagataacatcattccgtggatagaggtgggaggagaaaggtggatcattcctgatctcctgaggcaagagaaaaagacaggagaattcttaggtttaagggggggaagaggtcttttattcacttcctggtgcaggcacatgtacctatatattgctctttctgtagccagattatttactcagtgtagtgtgtgtgcctatgctacacaagaggttagcaaccattttgtaaagggtcagacgggaaaaattttaggctttttgagccatacagtttgagtggctactactcaaatccgccatgttgagcaaaacagtcataaataggtctttacactgtgttccaataacattgtatttatggacaatgaaatttgactttcatctaatgtcccaagtggcccaaaagattaatcttcttttaatcttcctccctaaccatcaagaatgcaaagccccacgccttgtgtatgagtacacaccatatgtagcacaggaaaaaggacgtccttgggaaggataatcactgcattcaggggagtggccacccctgagaagagagagagagaatcaagttgaggggcacgaggggcttcagttatctctccagtggtttattcctcatgttggtcccagatacagaggtgtttgttgtacctttcagtaggtcagaaataaaacaaatttttaaatattaagtatttaagtatttaaagttttaatttatcggccgggcgcgatggctcacgcctgtaatcccagcactttaggaggccgaggcaggcagatcatgaggtcaggagattgacaccatcctggctaacatggtgaaaccctatctctactaaaaacacaaaaaattagctggccgtggtggcacgcgcctgtagtcccggctacttgggagactgaggcaggagaatcacttgaacccaggaggcggaggttgcagtgagccgagatcgtgccactgcactccagcctgggtgacagagcgagattccatctcaaaaaaaaaaatagttttagtttatcaaaatacttcaataaataaatatttataggctgagggcagtggctcacacctgtaatcccaacactttgggaggctgaggggagcggatcacttgagatcaggagtgtgagaccagcctggccaacatggcaaaaccccgtctctactaaaaatacaaaaattagccaggcctgtaatcccagctactctggaggctgaggcaggagaatggcttgaacccaggaggcggaggttgcagtgaggcgagatcacgccactgcactccagcctgggtgacagagaaagactccatctcaaataaataaatgaataaatatttatatattcatataggtattaaatatgtattcatttaaatgaatactttttgaaataatttgataaactggaaattttaaataaaacaaaacaatgcacataaatgtgcccaagttcattaccatttttttgcagaaatgattatgttagtaaaaggcattaaataaataagcaaacaaacaatagcacctgcccatgaaaaggctcttatttcagtttttgaatcaccatgaaaaattttcctgagcatctagccagaaggagcagacactggcaaaaatgtattcacctctctaatcttaagtctcttgatttcatttctgcattaaagcattttctgttttctaaaacaagatcttttggtcaatttagcataccaactgctagcctaactccacaaaacggaatctttttaaggcagggagctatattaagtctccaacattcactttctgaaaattctttagtgtattattgcatagcagagtagtgtgacaaggatcaaaagattagaaacaatttcaattaactccttctactaatatacagaggactgaccactgaattttgccgcaatgtctaatgggaaataaagtgcgcacacaggagatttaccattgaccccaatcacagaactttatttatttatttatttattttgagatggggtctcagtctgtcacccaggctgaagtgcagttgtgtgatctcagctcactgcaacctccacctaccaggctcaagccatcctcccaccacagcctcctgagtagctgggaccacaggtgcacaccaccatgcccagctagtctttgtattgttttgtagagagagggttttgccatgttgcccaggctggtctcaaactttcctgagcttaagcaatctgcccacctcaggctcccaaagtgctgggattacaggcatgagccactgcgcccggccccaatcatagaactttaaaatgatgctttgtctcaaaaaaaaagaagagacaaataaataaataggtgaatttttaaaaataaaatgctgctttaaagaataaaaacatcgcaaatgctttgcaggaatgaaagtctgaaaatgatgtaatatagtaagagtacaaattaagctatttttaaaaaatcctttgatttagggtttctacattctatattctatagtgtccatctgtcctctgctcatatgtgtttaagccataaatgaattatcagaaagtcttttattcttgtaaaaccaaaaaaaaaaaaaaaaaagagttggggaggaggaatctgtcgtaatttattcatcatccttgacttcaataaataattagtactggtaaacattattctataattattagaaagagaagtccctggccaggcatagtggctcatacctgtaatcccagcacttgaggaggccaaggtgggcagatcacttgaggtcaggagttcaagaccagcccggccaacatgatgaagccccaactctactaaaagcaaatacaaaattagctaggtgtggtggcacacccctgtaatcccagctacataggaggttgaggcaagagaatggcttgaacccaggaggcggaggttgcagtgggccgagatcacaccactggactccagcctgggcgatagaacaagactccgtctcaaaaaaaaaaaaaaagaaagagaagtccctaaagttcaaatgccacaaaatagagaaaataagttcagcaggattttcaaatccaaataggtacttacacttaccacccccaacccaggaaaatggaaacccatttaggttgatccttagtgtggcagatttaaaatgtctgtaaactctctgacactcctctcattgagaagtgggatccactctttctccacttgaacctgagtgggctctgtgcctgcttcaacccagaagtgacactcttccagcttccaaacccaggcctggtagctttgctgtcctatctcttgggacactcacgcttgggacactttgaaatgtaagaagtccaaccacccagcaggagaggccttatggagaggccctgaaacgttcctgccaaggtgtcaggcatgtgagcaaagccatcttaaatcatcaagccttcagatgagaatacagaaatgaattagaaaaaaaaaaaaaatcctcaagccagactagccacaagttgaatactaccaactaaccccaggtaatgcacatgtagcagaatctcccagctaagctctgcccaaatctggtccaaatcatgagatagtaggcactcagtgaatatagggtggtttgttgtacatcaagagataactgagcccttggcatcattctagaaactacacactaatatacccctacactttaaatttttggatgagtgcctttcccacgccaaaggaggaattttttttttcttttcctgagacaaggcctcactctgttgcccaggctggagtccactggcgccatcatagctcactgcggccttgacctcctgggctcaaagtgatcctcccacctcagcctcctgagcagctgggactacagccataatacctggctaatttttttatgaatttttttttttttgtagagacagggtgttgctgtggtgaccaggctggtctggaatgtgtggtctcaaacaatcctcctgtctctgcctccaaaagtgttggcgttacaggtataagccaccacaactggcctaaagaagggatcttaattgatactattcttgaaagcagaggccgggcgcggtggctcaagcctgtaatcccagcactttgggaggccaaggcgggcggatcacgaggtcaggagattgagaccatgctggctaacgtggtgaaaccccgtctctactaaaaatacaaaaaattagccgggtgtggtggcgggcgcctgtagtcccagctactcgggaggctgaggcaggagaatggcgtgaacccgggaggcggagcttgcagtgagcggagatcgctccactgcactccagcctgggcgacagagcgaggctccgtctcaaaaaaaaagaaaagcaagcagaagtaggctttatagatgaaagttacaagaaagaagatttcaaggccggacgcagtggctcatgctcacgcctgtaatcccagcactttgggaggccaaggcgggctgatcacctgaggtcgggagttcaagaccagcctgaccaacatggagaaacccgtctctactgaaaatacaaaattagccaggcgtggtgccaggcacctgtaatctcagctactcaggaggctgagggaggagaatcgcttgaacccgggaggcggagtttgcggtaagccaagatcgcgccactgcactctagcctaggcaacaagagtgaaactccgtctcaaaaaaaaaaaaaaaaagaaagaagaacataaaaaagatcttcctagtaagcctttccagtcacagcctcaagtgcctcacggaaatgatgatgtaaccatcaccgtaagaattcaaggccaggacggaagcaatgaagaagcatagcaactgaaccctccaaataccaaatcaggaagacctgaatctggatctgctttgctataattagctgtgtgttttagggcaagttgcttagcctttctgagtctacttgctcaactgtaaaatagagacactggtaacagcaatctcagagaactataaatgagtgcctggcccaagggaagttcttggtgcacatgcttgtcagatcatgactatcgctaatgttggagaggcatttctacattggatggtgtgtcaaaccagaaagccccgctggccctgtccagataaaaacatgctggatcattccatgaccactcatggaaagttcatgtgtgcagaaaactacctgaacgcaacggaaaagatttcaatgacatctcaatcaagtcaatggcattctctttttgttagcttgaggttaatttgtacttaagagccttaattatttaagcagaaaagcagcaaaagaacaatggatttaaactggcatgccaaaaaagcttcgcttgcttgtttgttggcttgacgtaattagttacaaggcttccattgtggatttatcatgtatactgtttgccactcttcccgcactggcctccttcctctgctctctgttcctggaaactacgagtccaactgccaaccccaggtggccccaagttgtggtgaaaagaacaggccttaaaggaaattgtttcagttcagccacttactagcccttcaatttaggggaaattaagaaatctctctgggtcgggcgtggtggctcacgcctgtaaccccagcactttgggaggccaatgtgggtggagagcttgaggttaggagtttgaaaccagcctggccaacatggtgaaactctgtctctactaaaaatagaaaaattagccaagtgtggtggtcggcacctgtaatcccagctactcaggggctgaggcaggagaatcgcttgagcccgggaggtggaggttgcagtgagtggagattgtaccactgcaccactgcactccagcctgggtgacagagcaagactccatcgagaaaaagaaaaagaaaaaaaaaagatacttcactgtaccttccatttttctcctatggagactgggaataattaatgaacctcatagagatgttctaaagaggaaacagaatgactccatatggtttgaatgttataaaacaaaatgcaattgttagtagttattacttttagagccaaaacgtagaatatcggccgggcgcggtcgctcacgcctgtaatcccagcactttgggaggccgaggcgggcagatcatgaggtcaagatatcgagaccatcctggccaacatggtgaaaccccgtctctactaaaaatacaaaaattagctgggcatggtggcgcacgcctgtagtcccagctacttgggaggctgaggcaggaaaatgacttgaactcaggaggcggaggttgcagtgagctgagatcacaccactgcactccagcctggcgacagagtgagaatccgtttaaaaaaaaaaaaaaaaaaaggaatatcataaatctcaagacaactagccaaatgggcaattgagagaagcagctcagaatcttagattcattgtttatttctctgtttatttttttattaagtcagctctttatttcttcctgaaacaggaaaagtttttatttttgcaaatcacttttcttcccattttttaaaatataaacttttcactgaagtatcatatataaatagaaaattcacaagttaagagagtaccccaggccaggtgtgatggtccaccatgcctgtaatcccagcactttgggaggctgaagcatgtgattgcttgagcccaggagttcaaggctggcctgagcaatatagtcagatcccatctttaaaaaaaaattttttttgaagagtactcctcagtcaactttaacaaactgaacatagtacttatatagtcagcaccccagaagtcctacatatagtcatcgcccaccaaaggttgactgctctcctgatttctaacactagattcattttgtctgtttttgaactttatataaaagagattttgcaggatacaccctgttagcttctttcactgaacatgggtttgtggctttaagcacatttttgcataccataatagttgtttgttctcattttatgtagtatcccattcaatgaataagccacaattttttaattcatctactattaatggatatctgagttgcttccagtatggggatatttttaatggtgctattaagggcattgttaaacttttcctttggtgaacatatgtataaatttctgttgagtatataacctaggagtggaatcactgagttataatgtacatatatttttagatttagtgactcctctttggcactaggcttcttctcctctcctccctcctctcctttcccctcccctcctctcctcttctctcctctctctccctctctctctcttttttttgagatagggtctcatcctgtcacccaggcttgagtgcaatggcatgaccttggctcactgcagcctcgacctccaggctcaagtgctactcccacctcagcctcacaagtagctgggatgacaggagcacaccaccacacccagctaatttttgtattttttgtagagacggggtttcaccatgttgcccaggctggtctcgagctcctgagctcaagtaatctgcctgcctcggcctcccaaaattctgggattacaggcgtgagccacactcccagccggcaccaggcatttcaatcagtgctgattttatgttcctgtccctgactccaggatctcattccttcattcagtctccacacaaccaaccacacccagcatagtgaaaaacagcactgatcatgttcatttcaaaacatgttttgggaatgctgcgatccataacacctaccatcacattcaaggtcttcaccctttggccctaaccaaccatttatccattcaacaaataatgtccccaaccttgagacacctcacagtctggtagggacaaactaaacaagtgtctgtaatattacacaggacctggcagagccaagttctggagggatccagaagatctgagatgctttaagagaagttatttgagctggtcctagcaaaggatggatggaaaggaggaaagacagagtaacaacatgctgcaatgaaaaagcatgatgggctgggtgtggaggctcacacctgtaatcccaacactttgggaggctaaggcaggaggatcccttgaagccaggagtttaaaaccagcctgggcaacatagcaaaactccatgtctaaaaaattgttttaaaaattagccaggcatggtggtacctgcctgtagtctcagctacttgggaggctgaggagggaggattgcttgagcctgggagttaaaggctgcagtgagtggtgattgtgccactgtactccagcctggacaacaaagcaagaccttgtctctctaaaaaataaaaaataaaaaaaaataagcatgatgagtccagtccaggaatgagaaagacacatttcacgattgccacatggctctttgttgttgttgttgttgttgagacggagtctcgctctgtcgcccaggctggagtacagtggtgcaatctcagctcactgcaacctctgcctccggggttcaagcaattctcctgcctcagcctcctgagttgctgggactacaagtgcacaccaccacgcctgactaatttttgtatttttagtagagacggggtttcaccatattggccaggctggcctcgaactcctgacctcgtgatccacccacctcagcctcccaaagtgctgggattacagacttgagccaccgcacctggtcttttgttgttgttgttgtcgtggttgttaaggagtttcgctcttgttgccccgacgggagtgcaatggcgcaatcttggctcactgcaacctccgcctcccaggtttaagcaattctcctgcctcaggcccccaagtagctgggattacaggcacccgccaccgcgcccagctaatttttttgtatttttagtagagacggggtttcaccatattggccaggctggtcttcaactcctgacctcaggtgatctgcccgccttggcctcccaaagtgctgggattacaggcgtgaaccactctgcccggcgcgccacatggctcttacaaaagtgcatgagccagctctggggctggagcacagactgaaccccagttttgaagggcctagtatagtgttcaaacctcattctgtaagccctgatttctccatatgtataccacacactgctgcttttaggtggcaaatgagtggaggcatttcattttcaaggtttggataatttatatgcatattagaaaaatactggtcttcggccgggcacggtggctcacgcctgtaatcttagcactttgagaggccaaggcgggcagatcacctgaggttaggagtttgagaccagcctggccaacatggtgaaaccccgtctctactaaaaatacaaaaattagccaggcgaggtggcacacacttgtaatcccagctacttgggaggctgaggaaggagaatcacttgaacccgagaggtggaggttgcagtgagcccagatcgcaccactgcactccagcctgagcaaggggagcgagactccatcttaaaaaaaaagaaagaaaaatacgggttttccatttaagaaatgagatagtgttccactttaagtaaatggattttagtaaaacaaaagtgagttgatttaaagaaaaatattacccagcactttgggaggctgaggcaggcggatcacttgaggtcaggaattcgagaccagcctggccaccacggtgaaagcctttctctacttaaaaaaaaaaaaacagccgggtgtggtggtgcacgcctgcaatcccagctactcaggaggctgaggcaggagagtctcttaaacccaggaggtagaggttgcagtgagccaagatcacgttactgcactccagcctgggtgacacagtgagacgtcatctcaaaaaaaaaacaaaaaagaaagaaagaaagaaaaagaaaaatattaaatgatgatgtaggtgatatatagatatggggaaattgaaaaggtagtagggaaatgattgttaccgagaaactactgtagagaatcagggaacttctgggaaatgtggtctcggtaagaaaaaaaagaaaagaaaaacggtggactagtggcagtttttaacaagtgaatgacatggtcagatctgtcttccagatggacagctactgacagcagaggacacacaatctctggcctcatccatcactctctcctgcaccctctttgccctttagccccacctggacagtttcaccgacggcccgcctggccccaagcccctgctctgcagcacagcttggtggttgagagatgaactctgaagccacactgcctggatttggtctctggctctccacttgctggctggcaacctgggcaaattgctttacctctttgtgcctcatttgccatctagtagggttgtgatgaggactgaggaagttactatttgtaaaggacttgaaatgtgcatggcattcagtaagtactgagatgtaagtactaacatgaacatgtgttacaagcctgagcaacacagtgacacctcctctctactaaaaacaaaaacaaaaataagttagccaggcgtggagaggctgaggtgggaggatcacttgagaccaggagatcgaggctgcagtgaactattattgtgtcactctactccagcctgggcaactgagcaagaccctgtcagaaaaaaagcccgcaaacatatgtgttactttaaaatgatgtgttttatcttccgtaaatcacaacatctcttctacgctgtgcaaaaatctatttattcaaagtccagctgaacccaaacatccatcaactgatgaatggatgaacaaaatctggtatgtccgtacaatggactattatattactcagccataaaaaggaatgaagtattgatagatgccacaacatggatggatcctgaaaacatatatgctaagagaaataagccagacatgagaggccacatatcgtatggttctatttatgtgagatgtccagacaggcaaatctatagtcaaaaagttgattactggttgccaggggatgggagagagagaaatgagaagtgattgcttaataggtttggactttctttctgggataatgaaaatattctggaatagggcggagcatggtgattcatgcctgtaatcccagcactttaagaggctgtggcaggaggatcacttgagcccaggagtttgagaccagcctgtacaacacagtgggactccatctctacaaaaaattttaaaattatccaggtatggtggcacacgcctctaattctagctattcaggaggctgcattgggaggattgcttgagcctgggagatcggggctgcagagagctgcggtcacatcactgcactctagcctgggccacagagtgagaccatgtctcaaagtaaaataagaaaaagaaaagaaaatattctggaatagatcatggtggtggttgcacaactttgtgaattactaaaagccactgcattttctactttaaaatggcgaattttcagccaggcgcggtgtctcgtgcctgtaatcctagcactttgggaggttgaggcggaaagattgcctgtgttcaagagttgaagaccagcctgggcaacatggtgaaacttcatctctactaaaatacaaaaaattggccaggcatggcagcctacacctatagacccagctactcagcaggctgaggcagaattgcttaaaccagggaggtggaggttgcagtgagctgagatcacaccactgcactccagcctgggcaacagagcgaaactccatctccaaaaaaaaaaggtgaattttctaatttaaaatggtgaatttcgcagtacgctaattatatctcagaaaaaaaaaatctagctaaaagatcacccttcttccccaactgtccctcctgtgggctccctgttcaatatcacatgccatgttatagtacagtgagttggacacaagtgagttgtccccacatgagtgtgagcatctgagggcaggaagagtgtcctgttcacctacaactccccagaactcagcagagcgaccaataggtaccaagtagttgctccagtaaatgctcactgatataataagcagagcattatcatttgaggggaaggcagacttggagattaatttattttccaaaatgggcaggctctaaattaccaacctggtagcaaagaaacaactgcctctgctcaggggcccaatccatatcgagtattaagaccaagtacgaaatagcaataaaaagccctttcttttgtcaatgagagtgaaacaagcttagacttggaactctttttctatcctgtcaactaggcttgatgatgctggacaaactgcaaatcctgaacttagagactgttgcagcaataaccattttgactgtgataatatcattctgctcaagttggtgttagtaaggcaagtacaatcctaaaattctggcatgaaaggcacactctgggtgagcacatgttgtgaagtaaatgtaaatagcagaaatcccacaaacatggaaccaatgaatgaagttaaatcttatatgtacattccttagagttggcccactcatcctgctgtcattgctgatttggaaaaacgagatgacacgaaacatgtgagctctctgcagtgtttggctatgtctccatacctcttcttttatttatttatttatttatttatttgatagagtttcactcttgtcgcccaggctggagtgcggtggcatgatctcagctcactgcagctccgcctaccgggttcaagtgattctcctgcctcagcctcctgagtagctgggattataggtgcccaccaccacgtccagctatttttttgtatttttagtagaaatggggtttagccatgttgaccaggctggtcttaaactcccgaccgtgattcacccacctcagcctcccaaagtgctgggattacaggtatgagccaccatgcctggcctgctaattttttatttttatttttattggttttttttttttgagactgagactcactctatggcccacattggagtgcagtgccacaatcttggctcacggtaacctccgcctcccaggttcaagtgattcttgtgcctcagcctctagagtaagtgggattacaggcacccgccaccacgcccggctaatttttgtatttttagtagagacagggtttcaccatgttggccaggctggtctcgaactcctgacctcaagtgatctgcccgactcagcctcccaaagtgctgggattacaggcgtgagtcactgcgcccagccatgacctttttcttcttttttagcttccatttttctctgctttctataaattatatgctttgcgcatgagacaaagtccttgccatctggtttcttcccgcctcttcagcctcatctctctctaggttccggaatccctctccaaatggtaactaactacctgcttttcatatctctggatctcatttaaggctcattcaagccaggcgctgtggctcacacctgtaatcccagcattttgggaggctgaggagggcagatcacctgaggtcaggagttcaagaccagcctgaccaacatggagaaactgtctctactaaaaatacaaaattagccgggtgtggtgccgcatgcctgtaatcccagctattcaggaggctgaggcaggagaattgcttgaaccgggaggcggaggttgcagtgacccgagatcacgccactgcactccagcctgggtgccaaaagtgaaactctgtctcaaaataaaaacaaacaaacaaacaaacaaaaaaacctcatttaagaatcatctctaattctagagccaaatcacctgggttcaactccgagttctgcccttactagctacataaccctaggcaagttatttaacctttctgtgcctaggtcttctgtgtatggggatcataattgtaagtacttcatagttttcttatgcagattcaatgagttcatcttcgtaaagtgtttagaacgggaccaagcacggccaggcgcggtggctcatgcctgtaatcccagcactttgggaggccgaggcaggcagatcacaaggtcaggagatggagaccacggtgaaactccgtctctactaaaaatacaaaaaattagccaggctcggtggcgggtgcctgtagtcccagctactcaggaggctgaggccagcaaatggcgtgaacccgggcggtggagcttgcagtgagccgagatcgcgccactgcactccagcctggggcgacagagtgagactccatctcaaaaaaaaaaaaaaaaaaaaagaacaggaccaagcacataacacatgctatgtgacatggtttggctgtgttcccattcaaatctcaacttgaattgtatctcccagaattcccatgtggtgtgggaggaacccaggggggaggtaattgaatcatgggggccggtcttttccagactattctcgtgatagtgaataagtgtcaccagatctgaggggtttatgaggggtttctgctttcacttcttcctcattctctcttgctgctgccatgtaagaagtgcctttcaccctcccccatgattatgagagaactccccagccatggggaactgttaagtccaattaaacctttttcttcccagtctcgggtatgtttttatcagcagcatgaaaacagactaatacactatgtaaatattaagtatgttaaaagtcttatctttatgaggagtcccctaaacgtttccctcatcccctgctgtgcctcctcaggttaaactgatgctaccgattcctatcatagcatctagaaaatttcatgggactcatttttaatgcttcagtctctctaggtaaatgtaggcacaaaataaatggttttcaatgaatcaatggatggataaatgaatatctctattctagaaagcacaaaagagtattttattttatttttgcttacgtgtctgatttagtctgtgagcttctcaacaacccagaatacttctgatacattttgtatctccaatgcctgacacagaacctgtatccactcaatgaataaatggctggagttgttgctactcaaaagaaaacaacaacaaaaaacccacataggccgggcacggtggctcacgcctgtaatcccaacactttggaaggccacaaggcaggcagatcacctgaggtcagtagttcgaggctaacatggagaaaccctgcctctactaaaaatacaaaaaaaaaaaaattagctgggtatcgtggcgcatgcctgtaatcccagctaccaggaggctgaggcaggagaatcgcttgaacccgggaggcagaggttgcggtgagccgagatcgcaccattgcactccagcctgggcaacaagagcaaaactctgtctcaaaaaaaacaaaaacaaaacaaaacaaaaaaaaccacccacatagaatcatcaaaatgagttttggaagcaaacttgaaatcactattcaagacttgggcaaaaccaaagagcatctgagattaaactgggacatcttatccaagatatcattgattatatatatataatgtatctccaataagatacatgagaggtgtaataaaataatcaagcgttgagtcttggccttccacgcaagactcaggcctcttcagaacagaaggattaagatggaaatggaatagaattcaaatgttaaaagaatgaagggtcaagagcgttggaatgaaggtaaatgggccacctgtagaagtctgaaagtgagctttggagggaagaaaagtaaatactgctttaacaagaagtcctggggaatctgaatgaattagatcctgatcatggatccataacatgtggatgtggagaattaatggtatctagggtccgtatctaactgatattcaagaagtatagttagatggccgggtgcagtggctcacgcctgtaatcccagcactttggaaggccgatgtgggcagatcacttgaggtcaggagttcaagaacagcctctactaaaaacacacacaaaaaatagccacgtgtagtggcacatgcttgcaatcccagctacttgggaggctgaggcaagagaatagcttgaacccaggaggcggaggttgcagtgaaccaagatcgcaccactgcacttgcactccagcctgggcaagagagccagactctgtctctcaaaaaagaagaagtatagctagaaattctaagaatgactttgtctaaaatatattctctgaagtctgcagaaactaggatgagcagttctttaatctgatccaacagggcatttgtaggacttttgtgaccttaaatgaactgaaataacacaaaaggtcatcagagaatgtccaagcttctcagtacacatcattttcccatttattaaatttgaaggtatcttatattcagcaaaaatgagagctcattcagctgcattttatttccactacaaagaagtcaaacctagaacccatgtcaatttgcagagggatcttcattcacctatgatcttcatcccctaggcttttgtttcatttcctttggttgtaattaatttattatggaaacttaggtaaactcagcttctctcagccaggaacaactgcaaacacatttatttatctttcttccccaaatctacaagacatcaaatattgactaaaaggtttcttcaaaggaaagtcagcctggtacacggagctcatttctagccatccttgaatgtttgctgttttcccaaagctgctgacagtccagctatacaccagcatgtgttcatttaatataagtgtctcgccatgaagctgaaagcactgtacaatgatttttattttttttgctttaaatgaagtcaagatacagtcttaataaaacataggacaacttcattttaaccaaacctaaacctttaaacttcaggcatctttaggtctgaaaagattctactaacaactttctcaaagttcagctttgtccaaaatatataaatatcaagaagtccctcaataaaaaaaaagtataccaaaactctggggatattctaatgacattagtagcctcgaaagaaaaattcttagaatctgagaaggaaacagtgaagtgactgaatccacaagaaagggaaaaataaactacgaaatgacttttctagcaggctgctgttaaaacacttaacattcctaagaacagagttcagttcaactttttactgaccttctcccctcataccttcttagaccctgcatcatcagaagacagatgagtttaactcattggtgataaaaaactaaagaaaggaatgctgttcatggtgtgtaagacagtagtaacaggccaggtatggtgactcatgcttgtaatcccagcactttgggaggccaaggcaggaggattgcttgaaccaggagttcaagaccagcctggacaacatagtgagatcccatgtcttaaaaaataaaacttaaaaaaaaaaaaaaggacagtagtgactgtggagaacagtctagaattgggtttctcagcctcagccctatggacattttgggctggataattctttgttttgagtggttctcctgggcattgtaggatgtccagcagtacacctggcctttacctactagatgccagaagctcccaatccccatccccactactgcctcccacattgtgacaaccaaaaacatctccagacattaccaaatgttccttggaagacaaaatctagaaccaccagtctggaaccatcctatatactagcaatattcactatctcagaagggatctgagagttaagaatcaaatctgtaagaactttgtaagatttggaacgagccatctaacccagcattatttccttcctgcgacttaaagccaagtaaccatcccccatccacccaacccccatcttcccttcaacatcaaatgaaccagcagccttttagtgacttgaaccatgaaagtaaaaagaattagagaaaattgcagctgtgtaaaacataagtcaaagcctagtccaaaatctcccctcccttctatctaattttaaaagaaaggaaagtgaaaggcagtgaggagaagggccatggccagggtcaattgtctgaggtgatataagccaagaacagatcttgtagaagactgggtcctggtccaaagacctggtttttccaaacctgacctcctttgggaagctttacaagagtcttggccaggggcagtggctcacacctgtaattacaacactctgagaggccaaaggggtaggaacgcttgagcccagaagtttgagacaaacctgggcaaaagaatgagacccccatctctacaaaaaaaaaaaaaattaactgagctggcatacacttgcagtcccagctactgaggaggctaagatggaaagatcacttgagcctagaaggccaaggctgcagtgagccttgatcataccactgcactccagcctgagcaacatggtaaaaaggacactgtcacacacacatacacaaaagagtctcaattctgaccaccatttaccttgggcaagttactagatagcgcctcatttctacacatgtcaaatgaggataattgtaaaacctacttctcacgggtggtttgttggttaaataaaatcatggccaggtacagtgactcacacttgtaatcccagcactttgggaggctgaggcagaaggatcgtttgaacacaggaggttgaagctgcagtgaggtatgatcacaccactgaactccagtctgagcaacagagcaaaaccctgtctcaaaaaaataataataataaaaataagaaaccatgcatggcatacagtgggtgctcaataaatgttagtcatggctgggtgggcgtggtggctcacttgagctcaagagttcaagacctgcctgggcaacatggtgaaaccctgtctctacaaaatatacaaaaaaaaattggccaggcatgagggtgtgcacctgtggtcccagctacttgggaagccgaggtgagagactctcttgaacccaggaggtcaaggctgcagtgagcttagatcactccactgcactacagcctggatgacaaaagtaagtactgttccaggtacaccttatacagctcttcaccaaagttgctttcttattaaaaacagaatttagccagatatggtggctcacacctgtaattccagcacttttggaggccaaagcaggtggatcacctgaggtcaggagttcaagaccagcctggctaacatggtgaaaccccatctctactaaaaatacaaaaattagctgggcataatggtacatgcctgtaatcccagctactagggaggctgaggcaggagaatcgcttgaacctgggaggtggaagttgcagtgagccaagatcacgccactgcactccagcctgggcaacagagtgagactctgtctcaaaattaattaattaactaattaattgtgaaaacttcaggcgcttcatatccttttggaaactgaaccatcttatgcaaaacgaataaccacaccatctgtggctcaattaagcaataataaatacaattacacctcatgggctccactggtgttgacatgatattggagaataaaatgctacagtcactgacagtttctatagccacggttgcaaaacattatctgtcatagcttcttctacctccatccaattctaaagcttcatgactttttaaaacatcacttcttggctgggtgcggtggctcacgcttgtaatcccagcactttgggaggccgaggcgggcggatcacgaggtcaggagatcgagaccatcctggctaacatgggtgaaaccccgtctctactaaaaacacaaaaaaattagccgggcatggtggcgggcgcctgtagtcccagctactctggaggctgaggcaggagaatggcgtgaacccgggaggcggagcttgcagtgagccgagatcgcgccactgcactccagcctgggcgacagagcgagactctgtctcaaaaaaaaaaaaaagaaaaaaaaaaaatcacttctttggtcattgcttgagaccaaaatcattttattcctatgagtttgcaagtatatgcgcaatcattttttttagaataatctctgcttgggaggttgtagtgtggcgctaaaaacaaacggataaagcttccaccgctataagctccaaaagccctgtgtgttgctcaccctcatatccccagttcgctttaggtactagaaactcaaaaactcagtttgctagagatacaaatcagcctttcattatgtggtttaaaatgtgcctgtatcagctttctaatttccacccacataatatgcagaagaaacacagcagaccctttttacaaagcttacaaaagttaggtaagagacacacaagaaatacatttacgtgttctaatggatccatttttacagtgtcaatatttacagcatgaatttgcatgtctctcagtggttataactcacaaggaaatccactgtttcatcttatattttcttttctttttttttttttttttttgagacagagtcttgctctgtcgcccaggctggagtgcagtggcgcgatcttggctcactgcaacctccgcctcccagattcaagcaattctcctgcctcagcctcccgagtagctaggattacaggcgcccgccactgcggccagctaatttttgtatttttagtagagacaggatttcaccatgttggccaggctggtctcaaactcctgacctcaggtgatccacccgcctcggcctcccaaagtgctgggattacaggcgtgagacactgcgcctggcctcatcttacattttcttttatctttctcttacttgttatgtgggatgaatctctgttcacacaaatttttgttttcactattaaatatatatggcatttaaggccaggtgtgatggctcacacttgtaatcccaacactttagaaggccgaggcaggcggatcacaaggtcaggagatggagaccatcctgtccaacatggtgaaaccccatctctactaaaaatacaaaaaaattagctgggcatagtggtgcgtgcctgtagtctcagctactcgggaggctgaggcaggagaatcgcttgaacctgggaggcagaggttgcagtgagccaagatcgtgccactgcactccagcctggtgacagagtgagactccatctcaaaataataaataaatatggcatttaatattgtaaattaagtacatatacatgctaaatatattaaatatattcagtgttaagtataaatatatacatgtactttatatttatactaatgtgattgaatattaaatatataatataaatattaaaattttggtaaatatatatgattaatttgagttataagtttgatgactgaaactatacttaagtcttttttttaatgtttgcccccaaccccctttccccattacagtttcctatacaccctagatactcgattagcattattttgtcatttgtggtataaaagtaaagatcacatactttatatttgccaatatggacataaagagaaacactgaaatacaaaacagttgtctaaaagaatgtgaagggccaggcatggtggttcacaccataatcccagtactttgggaggctgaggcaagctgattgcttgagcccaggagtttgagaccagcctgggctacattgcgaaaccctgtctctacaaaaaatacaaaaaattagccaagcatggtgatgcacacccgtaatcccagctacttgtgaagctgaggtgggaggatcacctgagcccagggaggtcaaggctacagggaaacatgattgtaccacactccagcctaggcaacagagcaagaccctcaaaaaaaaagaaaaaagaaaataaaagaaaagaaaaaatgctaggcagccaggcatgtgatgtgcctgtagtcccagttacccaggaggctgaggcaggaggattgattgcttgagcccaagattttacagtgagcaatgtcacgccactgcactgcagtctggtgacagagtggcaccttgtctctaaaaataaaataaaataagaaatacttttccgaaaaatgaatgctaggcactagaggtgtctcctgcttttgctagaggcactggatataaaagggggaaacttctagctgggggtagtggctcacacctgtaattccagcactttggaaggccgaggtgggcagatcacgaggtcaggaggtcgagaccagcctgaccaacatggtgaaaccccgtctctactaaaaatacaaaaataagccaggcatggtggcgcgcgcctgtaatcccagctactcgggaggctgaggcaggaaagttgcttgaacctgggaggtagaggttgcagtcagccatgatcaagccactgcactccagcctaggcaacagagcgagactccatctcaaaaaaaaaaaaaaaaaaaaaaaaaagggaaacttccagcatctccttgggatgtttgaacaggaatctcagtaaacacacccaaaattgaactcctgatctcctctacctgcctcaaacttgttttcccccagtctctgccatcacagccagcaacacagatcagaaccccccatcctcagtccttcctccaggccatcaccacatcttgctatttctgctggccactgccggcctcagactcagaccataacagaggcaggtagatacacagaagacatcccatgcaggccactggctctctccaccaacaccaacacccccaaaaatcaacccctggacaggcgcagtggctcacacctgtaatgtcaacattttgggaggccaagatggatggattatttgagcccagaaattcaagaccggcctgggcaaaagagtgagaccctgtctctacaaaaaaatcaaagaattagctgagtatgattgtgtgcctgtagtcccagcttcttgggaggctgaggcaggaggatcacttgagcccaagactttaagactgcagtgagccatgattgcaccactgcactccagcctgggtcagggttgtcttttaagaagtcgtctttaatggctttctcttaggcctggagtaacaaaatgcaaactcttttccatggtctttagtgacccacatgctctgagtctcagtaatccccataaccctaccttgtgcccatctcctccttgctgggcactttgcactgttgcaaggtcggccttctttaagtccctcaacatgccaagcgttcccagccttaggaccttcatgaacgctactccatctagcgaagatggacatctccctgcccatcaaacaccttcagccccacctccctggaggagccttctctgatgacctcacctatgggattcccacctactattgtgtagtacctgtgggttcctggttccttcagaacactaaatctcatctccacccaacaaagaaagtcccagagggcggagaatctttattcaccactgggtacttcgtatccagtgtccagcacacagtagctgctcaaacagcagttaagtctgtatctaggccaaacacggtgtctcacgcctgtaatcccaacacttcgggaggccgaggccgcggatcacttgagatcaggagtttgagtccagcctggccaacacggtgaaaccctgtctctaccaaaaatacaaaaatttgccaggcctcatagctcatgcctgtaatccagctactcgggaggctgaggcaggagaatcgcttaaaccagggaggcggagtttgcagtgagccaagatcacaccattgcactccagcctgggcgatagagtgagactcagtatgaaaaaaaaaaaaaaaaaaaaaaaaactctgggccgggcacagtggctcacacctgtaatcccagcactttgggaggtcaaggcgggcggatcacgaggtcaggagttcgagaccagcctggccaacatggtgaaacccgtttctactaaaaatacaaaaattagccaggcatggtggcaggcgcctgtaatcccagctagccaggaggctgaggcaggagaatggcttgagcctgggaggtggaggttgcagtgagccgagatcatgccatggcactccagcctgggcgataacagcaagactccatctcaaaaaaaaacaaaaagtctgtatctgggcaagaaaaataagtcctttcaatgtgtctagtttataaacccatttaattcatatttactggttctatattttagtaaataattaccaccagctccctctatatagtatattaccaaagacaagtctaatttaacatttatatgctattcattttttcttttctttaaaaaattttttttaatagagaagggttttcgccatgttgcccaggctgctttttaactcctgggctcaagcaatccacccacctcagtctcccaaagtgctgggattacaggcgtgagccactgcacccggcccccctattcatttctaatgtcccattcagtgcatatgataagaaataagatgatttgcagaaagaactatgaacattagctctttgtttattaggcataatttgtctgtgtattttttgaactcctcaacaaattgtgatgatgtcttccaaatcaatttagaaggaaacaaacaaaaaaaaaaaacccaaaatccaaataattctaaatcagccacaaaccatgactgacaatagtcagaaataactaaatccaggctcttcatctaccctcagcagactttatgtactattgccttttttttactgcaaagaaccttcctggagtctgtactaccttcaagatggttttagggtccccaagcctagtagccacaggattctaacagcaactgaggaagcctttttcagtgaattatggatctaaacaaggcaaatgaacgcagagagggaactgtgcctccaaaggccacgaaaagcaattttgccaaacctaggtaattgtccaaaggagagaacgaagccagggctagcaaacaaacatgacagatcagagaattgttttgccactttgtaaaggcaagatcaagtatttgtacaaaggttctggggaaaaattaaagactcaaacaatgactctagcacttccgtttcatgccaggtcaagacaaaaatacctaattgagctctgcagctgagaacaatctaaatggaatcctgtagcagcaattggcacttgtggaaacctcaaaggtgaaaagagatagttaagaaaatttgtcttgacagttactttcagaaaatcattaattataattaaatgacagtagaaaaggtgataaacaatatagtaacataagtcagtcaagtgtaattatctgtagggcatgcgattcacaaaatggttcaaacagagggctacacatttagatgtaaatcacaaaaagattgccaaagaggaggctttgatttggaaacagggaagctctgaaatggggaagtgctgaaacgattgcgacatccccacatttggccctgccttgcacgttacttagtcatcagcctccatcaaggacttgtggtggcagagaaaataaaccacagaaaacatggcagcctcctgggagaggtctgggagaaaacccatgctcattcagaaaggtatgttcgtggttgtatttcgagtaaaacgcattcagtcacgcttgaaatgtgtaaaagcctgtgtgtcttattcatttattcaacaagtatttatggagcacctactctgtggcagacgctcctctaatgtgcttgggatacaccaatgaatgaagtagacattctagtcagggagagacagataataggtcacacaattacatagtatgctacaaagcgataaataccagagagaaagcagggtagtgagacagaggatgcgggcaggaaggaggaattgctgttttaacctggaggaggcagagcaaagacttgaaggaggtgaaggagtgaagcatggagatgtctggggatgatggttcaggcatcggggcagccagtgcaaaggccctgtggtatgaatgtgctgggcacaccccatcaagaaaaggagtgtggttaaagcagaggaagtaaggatgtgtgtggtagcaggcgaggttaaagaggtgatgggactagaaataaagtcattcactggcttttgagtgagatagagaagctctagaaagttttcggcaggggactgacacgagctgacttctgttttaaaaaagtcactctggccaggtgaggtagctcacacctgcaatcccagcactttaggaggccaaggtaggcagctcgcttgaggccaggagttcgagaccagcctggccaacatggtgaaactccatctctactaaaaacacaaaaattagccaggcatggtggtgcatgtctgtaatcctagctactcaggaggctgaggcaggagaatcactggagcctggaaggcagaggttgcagtgagctgagatcgtgccactgcactccagcctgggtgacagagtgagactccatctcaaaaaataaaagagtcactctggatactgggttaagaaaggagtgtgcggggagagcggtgaggacaaaggtggaagcaggggagcagataagcagattctgcagacgtatccacccttccgtgactagctctagccaatggagaaagggcaagacctttcatacatgaccagggtgtatgagaacatgggtgttaccatttaatttcagggtctgtgtgcctcctgcagttcccaccggagaagtgactcctaggtttcaggctgggcttgtccgtatcatatgagctggcagtttctgtttactcattggcaaactgacatataccttgaggtagatgctggagcccacaatgtggagcaaaaagcaaaggaggtccctgggccaaactactgtttgcaccaaatgggaagggctaacttgttattggatttctctttgctctgcaaataggatttcactagaggcaattcttctaatacttcttcagccacctgtccttcctcatctcttttcttagtaactaagagtacactgtcagcccaccagaaaagccacactgctgtgattcattgatattcacctgatactgccctttcactcttggatttcttggttgaccctccgtattttttagaggtgagatctcactatgttacccaggctggagtgcagtggctagtcacaggcgcaatcataacgtactaaagccttgagcgcctgtcatccagcgacgctcctgcctcagcctcccaagtagctgggaccacaggcatgaaccaccacgctcagctcttcactctccctaattttgagaaaacatacttttttccttctagtaatgacctaataagttttttctaattacgaaaaaatgcacttttttcctcctcatcattgcttattggcaactctcagccttttaaaggatattaaatagcagacaaagaggtataaacttgtttgtttgtttgtttgtttgtttgttttttagatggagtcttgccctgtcaaggctggagtgcagtgacgcaatctcggctcactgctacctccgcctcccgatctcaagggatcctcccacctcagcctccctggtagctgggattacaggcgtgtaccaccacgcctggctaatttttgtattttttgtagagatggggttttgccatgttgcctagattgttctcaaactcctgggctcaagtgatctgcatgccttggtctccaaaagtgctgggattacggtgtgagtgaccaagcctggcccagattaatttatttaatccttataataaccctgtgaggtaggcattttacagttggggaaactgagtcacagagttttcttttttagttagcctgcctaaagtcacatgtaagtggcagaactaagattggaaccaaggcagcccatgctcctagccactctgctatggagtgtgaatttagtatgaatagccatcctttccctaaaatctgcatctttactctagataaacccctttttttctcaccacatgaccaaacgttgctgattaccctgataacaaactagcccacagtgctgagctctcctccatgccagcatgctgcagccttttataatctaactaaattctaaggtaaagccataaccacctcattcttccctggacatgtctaaaatagtaagatcatcctcatggagaaatagatcataggtattaactggtagtacataaaacaaaaacaacaaaaacattaggccattgcattttctgttaataagaagttgcagtgccccattaaattttctgtgtcaccaaagcctcccagttgtagttacacaaaggcaactttgtcttgagaaggctactgggaagatgggcctaatcttggcaagggcttggtgtaccaagaaccatgttattattttttaatcaaatgacaacacacaaaaagaaatattatttaagccatcttttcttttctttttctttttttttttttttttttttgttgttgttgcccaggctggagtgcagtggcgcgatcagctcactgcaacctctgcctcctgggttcaagcgattctcctgcctcagcctcccgagtagctgggactacaggcacccgccactatgcctggctaatttttgtacttttagtagagacagggtttcaccctattggccaggctgatctcgaactcctgaccttgtgatctacccgccttggcctcccaaagtgctgggattacagacatgagccaccgtgcccagcctaagccatctttttaaaagtcacagtgctattatcatcaccaacttggaaccctcgtttttgaaacacaaatggtttacctgagcttacaaggctcaaatacacattttcagaataggaattaaattgatctaagagaaacaacacctgaaaaaaccctgtccattttgtacttctgtactttttgtttttcttggggcacgtgaaatgctttacaaacatgattgagccaggtctcagtgctctgaaaggtagatactttttattataatattaatatgctgacatttccttggtcaggtacaggcgtcctgttcctgtttcagctgcacaatgccctgcattcattgtacactcacccactgcccattggtacatatacttaactcttgctcacccacatgtggattatccatagcgtctgggaacgggttgtcttccaccccagctggtggatactcagggaatatgagcaaaactgacaattcattgaagcaaggcacaatcaggaggctcattcagcgtacacccaccaggaacccactgtggtcttcgtgcagggccaccatgttcatgagaaccacaaatatatagcatccccaaagacaaatatcgtgatttggggagactggatgttgttttcttgattaatgtggctgagtgtaatctataaataaagcatacattttgcagaaccagaaatctcctgagaccaaaagattgatattttcctaaaacacaaagggttttcagggttacactagcactctgtcttctcccgatgtcatctccctgaaatggccttcagaaaagcagagattgtgcttttgatttctaaaatgactccactctaaaagctttgatagggtgcaccaaaagagctactatagtcacaatcacttttacgtgatcagcttatttatgtattttactttacaaacacataaaccatatgcatctagacacacccacaaatcgttgtttacataaactaagttcctatgatgacaaaaatggaagattcataacaaccaaaaaagatgctcctgttaaatatgcaagttacataaactgagctgtaattgttttgttttgttttttcaggtgtacttaaaccacacagaaagtagaggaaaggcagacagtgggagtatggttgaagggtttgtgccttttgtaatcagtttacttttggttttaccaagagatgatatcttgaattcattcaaactagtgtctattgcagtacactaggaacatttgaattacaaaaggagaggaggagcctccacttcccacagttgctagtttacctgcaatcctttgagggcagtggtaatctccatgtgagctttctggtaaattccacactaggaccacattcagaacttacctgtttcttggccgtttattcctctagacactctctccctttctactttcgctggaaaatgaaagttttcctcccccacacctttttcagagcaaaagatacgagaaccttaaaagcaggtggtcattgacttcaaggggacgagatcgccctccccactgcctctccccatacagacgctcacagaatagacggggaagcaactatgagagaaacagaagcaatcagaactccagctcagacgacctcaggagttttaccaacaggatgattcaggaccacacacaaaaaatggcagggtgccatttcccccgaatctctcccgcataagatggaaacaacaacttgaggtggcaactgagcaattagttactgatcatttctatgacaattctctgaaggctccaaaggcctcctatcttgaaacccaggtcatctctgcattgctattattgaaaatctttatccagttgctctttgaagccactacttggagcagtaatgttgggaccaacacacaccttttatgatattaaaccagaaaatcagcatcatcattaagacacagagactgttcccaagagggaaagaaaatatatctcctaatcaggccagtagctgaaacactgcaatataacctgtagcttggaatcacggtgacaagcacttaaagctgcatttaatgtcttcattgtaacttcatcaaagtttggcacacaaattctacctttattctaagcataccctttttctaagtctcatgaatcccaaacttaaaccctcttcagagttttttttccccagaattatgtatcttctgggattacctaatcacagtttcacttgagcctgggtccaattttaagaaaatctccctcccttcacgcttatatccactcccctgaccttttctgaaaaatcaagagacttaagatgtggaggcggaaacttactgaaatagccaaatgcttttctatagcaatgaaagctcagtcatttgggacatgatttaatcttgagcttcagagcagaatttgaaaagcaaattaaatccttttgtaagaaaataatttcatcttaacccaatcttttaaaaaatcattacctagaacagtaaaccaaatagtctaatatgaatgttcttatcatgtgaggaaaaaaatgagtagtctttaacactagttagagcaagtctatagaacacgtgtccagaagcatgtagttcccttgctttctgtctttatttcatcctcagtatcactactgctttgggcagaattctttcaaaatttaatttaaagcagcacagtgggggaatcaaaaataaatatgttgactattaaaaatatagagattggtaaaaaaaatgatgatgatgaattctcaatcctacaaacttctgtaaacgcaaaaaccaagaggaagataataaatctttaataattgattgatattcagaatatcttgatctaattaatttaaagcatggcctacctagccaggtaaaggacggcacagctaggcttatttcttcatttgacacatactgaaagttaataatgaagctaggtgcttgggaaatttctgagaccccatccttccagcatgcaataattaagtcaaagaggccaacagtgtgtatatcagaacaaggtgaagggtaaagcagaccagaaaaaaatattaaaaaccaaaccatctcctcctttctttttttccttctgttttcctttcagactgggttgattttagttccctccaagacttcaagtcattgatctaacaaagatcattgtttaaattaatagcaacacaaactcccacaaagtgatctcttcttatgctctaggttgagtactttggtttatctagaggttgtgtgttacgccgctgaccacctttcaccttttagaatcggcacctgcaattctcaaatgctctggatctaattgccaaccttttgagctcaaaacttcggcaactccttcatgttgggttgtcaaccctttgctttccctcccctgagaaattcgtatgaccttgccttaaaacttttaaagaatacattttaaaatctatattcctgctaaagaaaacagtgagtcattaaaataccaccagataaaaaaaaaaggtttgatttttagttcaggtcggtaatggcctgtaagtaccttgaagatggtatcttcctatcacttatgccttgggacagtacccaagagtggctgaacttttacctaattaaaaaatgagtcatttatttgaaaaattccacttccatttattttatctgatttcttaaatatccggtcaactgctaatttgtcagatgtcataattcgtcagtcctacccttttctacaggctgaatttttaatttgaaacaactacacctctaccgagtgttactttcagacgtaaattactgcaggaagacccccctctgccttggttaacacttaaatgagatgcctcctgtccaggacgcttcctcagtctcactgtaataatctgagtctaaagtcacctgtgcttctgggcggtccaatcatgtattttcaagagtgaaaaaaaaaaatcagtttcttttatgggaaaagattcatcactacaggaaacacgatgggactgactgtatatgattatctgccttcccagaggttgacccttttaaaaccgttttataaaccctttatttcccactaaatataccaagagacagaagatgagtgatagcatgagggataagagctaaagagagaagaataagaaaaaaatatacacttcaaaaattgggacccaaatgtaagattaagggacaatagttagaaggactaccaaaaaccaccttacctttccttgttaagtttttggagccgcccacttcagaaattaacaccattcacagcccaggagcaacttaacacagctaggaagtcacctacaacatcttctcgtccgccttctttttaatgtaaaaccaaaataaggagtgtccagcgactccccaccgcgccgcttaaagcaacagagcgttttaggcttaactcccaggctctgggaattccagtgggtcagaattgcttaaccttggagacttgcagagagaaagtctccaggaggaccgctccccaaaccctggtttctctctatcccaagctgcacattccacagtggaaagcgggagcggcgacccgaaggcagcgaagttctctcgggctcagctcccgaggccgggagcgcgcggcggttccacccgcagagcggcgccgcgtcccggctgcgtggggcgctgcgcacgggagcgctcagcgtctagtctgc

SEQ ID NO: 971 - DNA, 92719 bp, Homo sapiens
cacaatttaaaataaggtcttgcgattgctttaaagaaagctttatttactacatacatcctaagaatgtactgtaaatggagcaagatctaaataaaagcttttcaaatataaagcagctaaagttaactaaaccactagcaatgtttgaaaacagaactctaaaactttttttttacatttatatagtttgttcttaacactaaaaaaaaaaaaagttcacatttcaagttataaacttacctcagtagtgtacatgaaatggttttgaaacaataggaacagataagtcccagataggaggctcactgatacttaattggccatgtcaccaatgtttgtttttaagggagtttggtggttgccatgttatcatttttttttattctttctttctttttctttctttctttctttctttctttctttctttctttctttctttctttctttctttcttttctttcttttctttcttcctcttcttcttcttttttgcaaataatttacaggcatatgtaaaatacagtaagaatactgggtcatagtttcatccagtgaaactctgtgacaatccttcactagaaggagagtacttttttcacacagtcaggggatgaggatctgatccgaattacattttgtcgagtcactcattcccacagatttgagtttgaatgcagcttgtggggtacatcatcaggaacattgcacaattattttatgtcatttaaaagaatgatggaaaggaatgttagcggtgcttaaaggcctcagtaggcactcaataattttatagaatagttaaataaatattgcttacacataaaaactcatctcatttcaagatgagggggaaaaaggcatttgggaatctcttaatttaaaacaaaacaaaagtacttgctaagggcatgatcctcttatgaatccacaagaattcagccatcaacaaaaatcccgtgagtggaaaattgtatggatctctaacatgacataaaaacgcaactgcgttttacttgctaccttattgcacacctcacttccttgattgagcctttaaaaaacaattccaagttgatatttttttttaaaaagtagatgacaatcttaacattttactgtattttacattcactctgctaaacaaaagcctttaaacaggcacaaaacactgcaacaatacattaacttcctaataaaacaaacctttttaataacattgaaataaaatggtttcattttgcattaaactacataccatgaacttctccaacataaaaggactaaaaacaagcattagaagatatttacaaactatctttaaacttctacaggtctctcctcctcctcctggatgtgcacaccccaatccagttcacccatcaagtgcacagcaaaggaagagaggcccatttaataaacataatgtttccaacacccttgaggaccatggacagttttgcaagaaacatggtaaggcaactagaagcataactttctgctgaaaagagtctctgggggtcttgtctacgataacatacattctttgtccctacaaactcatacttcaaaaatgaataaaagcattagaaatggcattaaagttttacattgggcaattaaatagctatgcaaaggtgtcttatgcaactcgattaaaaccttgtgcttactctgctactgaaaatagcacacgtagaagacaatacttccccaaccaaacaaaaaaaaaaacaaaaaacaacgaaacaacaaaccccaacaaaaacccaggaagaagtataaaagccaccagctcctctatcagagctacttatcagtcctaggcttgccaaacattgcggtgggattgggaatctggggaggaggggacagggtgagagatgtgggagtgggggcatgtttaaggctaaggcacatggagaatgagccccggctaacggtggcaaaggagagctttccagtgtttggactcagaagtgcggcaagtcttttcaatgttggcttaaggagagatccagtgtttaatttcttttaaaaaatagtaccgccatgatgatacatggtaacaccatcaacccttaatgccagcagaaatacagaggttttactcattttaaaattgcactttccagtataacctttaaaataatgctttatgtagtatttttaagcactactgtttgtatctttaaatattgtatatatttttcaaaatagttccctagctcctcaagtgtgcttttttaatatatagttgatatattattgaaggtactacaaaatagaaatctctggagtgcagaagttaagaaaataaccttcatactgaaaatatatccttaaaaaaacaacaacaaaaacctctatacaaatgtagtacagcatacaaatttttaaaagatggaatgaaggcacgaaccattgcaagtcttttggaaatgtatgaacgtaggcatgctaagttgaaaatagtcttaaaaaactagtgaaaacttcatgtatataaaataattcagaaataaatctgctaacattcttcactttcaggttgcatgtgtgaatccaacatgttccttcttcataaatagtcaagcgttccttcagtggtgtttgtgtggtctgtcttcgtgctggtcaccagcctcagtatgtctggtagacgtcggggatggggacctgaatggcagcagcagggaaggcctgaggtatgtagcctgcgtatcctccatacatggcggccgcggctgccgcgttcttctgtagtgtggcgatcgtggctgtagctggagcagcaaatggcacgtaactggccccgtagatcccggcagtaggaattctctgaacgtttggagccaccgtgtatactggagttattgggcggccctgaggagaagagacaaaaaggagccttcctgaacacgtgtatgtacctatcatccattcattcaacaagcctctcccagaagacgggaatacaaagacacaaaagcaagggagagaaaggcagaggggcgggcaaacagcaattattgtaagcaagtgggagaagagccactgaagaggtaaggtggagctgcatcctcaaactcagtgatgccaccttgtgaaagtgagaggcctggaaggctgagggaaaggtgaaatacagttgcccctcagtatcctcacaggtgattggctctaggacctccgtggataccaaaatcctcagatgctcgagtccctgagagaaaatggcgtatttgcatttaacctatgcacatcctcctgtatactgtaaaaaaattttttttcatagagacaaggtctcactatgttgcccagggctggtcttgaactcctggcctcaagcaatcctcctgtctcagcctcccaaagtcttgggacccatacactttaaaaataatctctagatcacttataatacctaatatgatgcaaatgttatgtaaatagttgttatatcgtattttgacatttgtatttttttattgttgtattgttattttttattgtctttattcaagccacggttggttgaatccagatgcagaaactgcggataaggaggaccttctctgtactgtattccggaatcttctacttaccattccactcaatcagtctatgccccagagtgagctagagaaggcagcggagaatctaccatccacacaattgatttcacagtaattaaaaatcagtgtttttccttaaacatggcctctagatacatgccagctgcctcaactcatacttaactgatggaatatgatctgtctcagagacagagagaggaacagactgtgtcaacttagagaaaccaaatatactgatctccaaagggacagcttcttaagctgtgaccttaaaaaattgtgaccatacacaattttcagccaatgtgatggtttccatcacctcccacctaagagatgacaccattaatgtatacaaattgttgtagaagcttagagaaagaaccaactaatggggaagttggagaaaatgtctcagcagcggggatattcgagctgagttttgaaggataaagagcagtttccaaatgaggaagaagtgggcaaggacaagctaagtaaagttgcctgaactgttgacggccaccactggctctagaaaagcccctgctacttccttctgtctacttgaaagtgcaacataagatgttttcagaacaaacaggagtatgaatgggaagactgtggttcagtatttcccaaagtgtttgccatggaactagttctgtgagatgcttcattgaaaagagattctgaataaaataaaacattcatttaacaaaatatttggtgcacctcatgagccatagaatgcctggtagtaaatgctggtatggtctccctatatgttaatacatcttcaaaataaacaattcagcatatgtgaaatggtgaattaaaataattatttcttcctggatttttataaaggaattagctctaatttctgttacaaaatttgcaaatcagagttccaaaattgtgctcaaaggaacttaggaacttctagcctaagattactttttaaaactataatcaaatagtaattataatttataataattttaatttataattataatgataattataacaattaataactcagaggctgggtgaggtggctcatgcctgtaatcctagcactttgggaggttgaggtaggaggatggcttgaggccaggagttcgagaccagcctgggcaacatggcgaaaccttgtctctgcaaaagatacaaaacttagccagccatggcggtgcgtactcctgtagttccagctactcaagaggctgaggtgcaaggatcacctgagcctgggaattcaaagctgcagtgagctgggatcataccactgcactccagcctgggcaatggaagtgagaccttgtctcaaacaaaacaaaacaaaacaaaacaaaacaaaacaaaacaaacccccaaactcaggcactattctaagtgccttatttgtatgacagtattgaatcatcacagccaccagtagagttggtactatgattatatggagttgtgtggaagtgttaaatgacctgcacaaagtgacacagcttttaagcaatgcaatgtgtgactctggagcctgcacttttagccttacgttaacttgcttcttacaaccctaaacaatgagtgtctcatcagtgacattttacaaccagggagaggagctccagaactggaaagactgtggttcacagcaagacacaagtcaccttttccacatgtgtggacgtaggtttaataaccagtgcaaaaagggagaggaaatggcagggaaggcaacatgtgagagagacctttccatgtgctacaggacggcccaacacctgggttcaggctgcccactccaacaccaagttttgcacatagacatgcactggcttacggcctggaatcaagagtaggtccccaaacccatggcttctcttttcattcatgtgatgtcccttttatgatagcattcaccacactataaggacaaagcatgcagagatcaggcatctgatctcccaatcccaattctactcccggccagcaattctgtctccttgctgggccttaattttcttatctgtaaaatgagaatatatggggaagcacttggttttgctttccatggtttcagttacccgcggtcaactgaagtctgaaaatattaaactgaaaatttcagaaatgaataactcataagttttaaattgtgcacccttctgagtagctccatgaaatctcatgtcatccctctccatcctgcccgggacaccaatcatccctttgtccaggaaaacgacactgtctgtgctccatgcccatgtcacttaatagccatctgggttatcagattgaccgtcaaggaacccttattttacttaatatcagccccaaagtgcaagagtagtaatgctggcaatttggatatgccaacgaggagcactaaaggccttcctgtaaatgaaaaggggaaagttctctacttaataaggaaagaaaaaaaatcctatgctgaggttgctaagaactacagtaagaaagaaattttctatctgtgaaattgtgaagaaggaaaaaaaaattcgttcatagtatattattagtttggtaatatctgtgtttcaggcatccactgggggtcttggaatgtatcccccaaggataaggggggaccagtatacaattgcattaatacagcatcatcaaagagcaggaataaagaaaaatgcaatgatggtagtgggagaaacatttacccatccctaaaaagtgcctctagcaggagaatcgcttgaaccctggaagcggaagttgcagtgagctgagatcccgccactgcactccagcttgggtgacaaagtgagactccatctcaaaaaaaaaaaaaaaaaaaaaaaaaaaaagtgcctctaattcaggtgaagagtccctgcagtcttccctcctgtcaaggaggagcagttatccttgctctaactataccaagaggtgttgttaaattggctaaataggaacacccctgagcgcctacaaggtaggggaggatgatcgaaggtaggggaggataagcaaagactgcaaataagaaccctgatggtggccgggcgcggtggctcacgcctgtaatcccagcactttgggaggctgaggagggcggatcatgaagtcaggagatcaagaccatcctggctaacaggtgaaaccccgtctccactaaaaaaatacaaaaaattagccaggcatggtggcacgtgcctgtagtcctagctactcaggaggctgaggccggagaatcgcctgaacctgggaggcggaggttgcagtaagccgagatcacgccactacactccagcctgggcgacagagcgagacaccgtcgcaaaaaacaaacaaacaaacaaacaaacaaacaaacaaaaaaagacaaaaacaaacaaaaaaaaaaccctgatggcaacagccagtgcggactgataggagacagaaatagtcaggacatgattatggtgcctggaatttggacctgaccagaactcacagtgcacatgaaagacaagtgttcatgaatttcttactaaaggagaattagaaattattatcagaattccactaagtactgctgctacgctatagtaaatatttaccgtcagtccacaagtattataactatacttagttgttattctacagtgtcatttacaaccaattcctctttttgtctttcagagatcccaagttaaagaatacttaatgacatactgaaagataaataagcttcaattagtctgccctttctgaataatgcagtcaagactagtgttcagagtgggcaaaagcaagtaaacagcatcctactgtggagggtcacaggcctggctctgtttcagaatcattgaggagctgtgcaaaatatcaattctaggactccagcccagtttgaccgaattggaatcttcagggattagagtctaagaatctctgttttttaaaaaatgtaggcaacggctcatgcctgtaatcccagcacttggggagcttgaggtgggaggatcgcttgagcccaggagttcaataccagcttgggcaacatagcaagactttgtccctacaaataaaaaagttagccgggcatggtggtgcgtgtttgtggtcccaactacttgggaggctgaggtgggaggattgcttgaaccagggaggttgaggttgcagtgagccatgcactccagcctgggtgacagagtgagactgtctcaaaaaaatcaaaaatcaaaaatcaaaaaaagtggcctggataattctttttcaattggataagggatcctgggcctgagtacttgtgatcggtattcatgattcactgcctcacagaaaacagctttaacaagattttcttctgttaaatggatgtcctccctatgtcctataaggtgaagatacaaagaaacaggacacagtctttggtctgtaggagcttcattttccttgggagatagaacacactggcagccataggccaagtaatgatgtagtaatcaggagtacaagagagaaaatttcatggccgggcgcggtggctcacgcctgtaatcccagcactttgggaggccaaggtgggcggatcacgaggtcaggagattgagactatcctggctgacacggtgaaaccccgtctctactaaaaatacaaaaaattagccgggcatggtggcgtgcgcctgtagtcccagctactcgggaggctgaggcaggagaatggcgtgaacctgggaggcggagcttgcagtgagccgagatggcgccactgcgctccagcctgggcgacagagcgagactccgtctaaaaaaaaaaaaaaaagagagagaaaatttatctaggaggtggatgggaaagattctatggaagagatgagaataaagaaaccaggatacactatgaaaaaggtggggaaggaggccaacatggtaagatgagtttgggaagagataggggaacagtgggagatatggttggaagagaggattatgggcatattttgtaaatttatttttgagacagggtctcactctgttgcccaggctggagtgcagtagtgcaatcacagatcactgcagccttgacctcaaggctggtcaagtggtcctcctgcctcagcctccccagtagctgggactacaggcatatgccaccatgccaggctaatttaaaaaaaaaaaattgtagagacagtgtctcaccatgttgcccaggctggtcctgaactcctggcctcaagtgatcctcccatcttggcctccctatgtgctgggattacaggcatgagccactgtacccagcacaaaattttacgtatctatacagatgttctttctctctctctctctctttacacacacacacacacacacacacacacacacacacacacgggggttaacatttttttaaaaaatcttcattgagctgcagtttgaaatgtgaaaatgtgaaatcactccctggactttgtgtgtcagctctttaacaatatgagctaaaaattatccagtgctattttaaaaaaatatatgcacaatattatgacactgtgaaaaattacacataatttttgcatattgattaccacccttaatacaatgatattattagggtagtacaattaattaaaaatttttttttctgtcatgcttcaaattcaaaatgctttgtgtcacccaaccatagctgtaacagagagccaggcacacagtaaattctcagtgctgaatactaaatgaatccatgttaaagagaggcttcacacacaaatgacaatgcctgcaataagaactctacctggaaaggtggtggcgtcgacacagtgggaatgacagcggctgcggcggctgcggccgcggctgcggcggcagcagcactggctgggtctggctgcacagcaatggggctgatcatgtgctccactgtgtggattttgccatcttcaatcattttaggggctggagctgctggaaacatggaatactgagccccaatggcagggatggctactgcaagagaagcaagaaggaaaaacaggtcaatcactttcagtcgctgagtggggtccagcacttgctctaagatattttttatttttatttttttaaaaacttttcttttttttgagacagggtctcactctgtggcccaggctggaatgcagtggtgcgatcaaggctcactgcagcctcaatctcttggcctcaagagatcctcccacctcagcctcctgagtagctgggactacaggtacaggccaccttgcccagctttttgtttttgctgttgtagagacagggtttcgccacgttgcccaggctggtcttgaactcctgagctcaagcgatccaactgccttggcctcccaaagtgctgggattacaggtgtgagccaccgcgcccagcctaagatattttttaaaaccacgtttagaggtcctgggcctctccatgctcactattgttctctcagtacaagccatgtacccagatgcctgctccctagaggaagggatgggtggtggcaggtaactccccctgcctgttgtggaagagacccctagagtaaggcttttgcaccaatattttctactatttctacagaaaaatcacagtttgaatgttattcttgatgtcctactgagcaagaaagggcctctgactatgggaaaacaggcttagacgaagaagtgagatcagaggcttgaagcctactgcctgtgagagttgggcctgcctgttccttcctactcacctcactcattaccagccgcactgcctttttttcactttcaccactatttaagaaacaggtgctgttgagggtttcattctgagaactcagacctgtgtacatcctccccaccctgtatttcagatttcaacattaccgattcaaggaaaaacacatggtaaaaaaaaatagcacattccccagtttcctcatgcccacgcaaagtagtgaagatgtggagtgattggcttttagtgggacctcccaattcaaagaatttctgcaagtaaagtccaaaattatgatttcaaccagagattcaaacagcagctattgaatgtcaaggtacagtaagaagagatcaaaaggaaaagatatcagcccttttgtgtgagtgtgtgtgtgtggggcgggggtgtgtgtgtgtgtgtgtgtgtgtgtgtgtgtgtgtgttgaaaggacaaacaaaaatatgaaatgtgtacacaaagaatctttctatttctggttttctccaactgtaggtacatttattctaaataggacagactcaatcaaaggtaaagagacaaatgattgtaagctaaacaatggtacagccattcgataaaatatacctaaaaccttaatcaaatcttttacctgcctttccaaccatatcttccactggtcttgtgcccagatacttcaccaccaccctggtgcctctcctaaaatacaatgttctcattttctggatgatcagaaatagacgccaatcgatggggcccagagagggttgtgagtttaagctacaaggggttgtatgaagtaaatgaattgttctggctatcagcccacaggaatttctacctcaggctccaggacacaactttacatagttaaagattatttaacagttcttttctcttgttaaaccttaagctaccgtaacttgccaaagggagttcccttctcaacaagtagaagcgacgactcccatatccaggctctattttattaagttacagagctgtgggatcagttttactttgcccacagtgccaatgacatttaaaaggcaatctagtctaaggagtcacttaactgcagaaattgcagaatttttacacaggcaaaaaaaaaaaaaaaaaaaaaaaaatcattactagaatcatcaaaagaaagttcaattggggaaatgctttttaactctatgaggccaatgtgtacctatgtcccaaatgcacagattccttgactctattttagctagggagagaagtgtacaatctcaaccagaagaaaatcagagtagctgggctccaaacagttcttcaacttcctcctgctgaagccaggaggggtctggaggagggtcgtgccaattacccacggactgagctttccatgtgtttggatgcttctgcagggtgctacgtgagtttgtgatagactcacacaatggagttaatgttttttgcaggttcggatcagaagaccggcctcacattagatggtcatgggcactaatgacattaataaacaggtttgtagggcctggaggtgaaggctaagttcagggtccctggcttgaaatacttgagcatccctactcccaatctactgatccaactagaggaggaaatgagtgctggaaatgagaaaccagggaattagctgcaaaaattttcagcaaaggccaggtgcagtggctcatgcctgtaatcccagcactttgggaggctcaggcgggtggctcacttgaggtcaggagttcgagaacagcctgggcaatgtggtgaaaccccatctctactaaatatacaaaaattagccaggcatggtggtgcgcgcctgtagttccagctactcgggaggttgaggcaggagaatcgcttaacccgggaggtggaggttgcagtgtgccgagatcatgccactgcactccagcccgggtgacacagcaagactccatctcaaacaacaacaaaactttcaccactgccttgtcctcaagcattcttatttgctcagaccatgacaagggacaaaaggtgctgcttactcctgaaggggaattttctgcccttccaaacaactctcagaatggggcaataagctctaccctccgacttcagatggtcggggcagaaataggcctgagtaaggaaaagacaggttttacctgatagaagatacagagagcctcatgttcttcctttcttccccctacaactctccttacttagccacagactgagacaaaacctaacaatgggtgacagccctttgaaaaccttactgcatggccaggcgcagtggctcactcctctaatcccagcactttgggaggccgagacgggtggatcataaggtcaggagatcgagaccatcctggctaacacggtgaaaccccatctctactaaaaatacaaaaaaaaaaaaaaaaaaaattagccgggcatggtggtgggcacctgtagtcccagctattctggaggctgagataggagaatggtgtgcacccaggaggcagagcttgcagtgagccaagatcatgccactgcactccagcctgggcgacagagcgagactctgtctcaaaaaaaaaaaaaaacaaacaaacaaacaaacaaaaaaaaaccttactcaggcaagtttgatttgaacatagtcaaagctacaccatcccctgaagttctagataaggaggtccagggggtcactttatttttgccttgtctctagctgcctaggagaagaggaacccctgtgcagatgtgagagcctgaaaaacgcttggattcacttcaaacagaagggctggggtttatgctgaatgggagcattctcaatctgcttcatactgacctgtaccaggtttaatggcaactgggttgacggtagggatttccaaattcggcaccagttcatatcctttttcttgctgctttcctttcccttcatgatatcggctatatataccacgaccagcagaatatcccccgaggtaggaacccctaggccctggggctctgttgccagctgcacctcgccctcggcctcttatgctgcctgcttgtaataacaacacaaaagatgatcagcaaccaacagtgacggtgctggaggcagacctcagccctcggttctcggcatttaactgccccagtcttaattgcaggtggctacacctttgctctttaataggctggtaaagatgcttccaacattctatttcagcctagatttgcatcctaagcatgtcttcttagtacaagaggcaaacttgcagggtgagtttctaggattgtatctgcaatttcagtaaagaaaaacattcatagactacccaccaccccctcccccccgccaaaaaaaaaactgtggccaggtgtggtgtcttatgcctgtaatcccagcactttgggaggctgaggcgagaggatggcttgagcccaggggttcaagaccagcctggggagcatggtgagaccctgtctcaaaaaaaaaaaaaaaaaatatatatatatatatatataaaatacatatatatatatataaaatacatatatatatataaaatacatatatatatatataatacatatatatatactattaaataattttttttaaagttagctttggaaggggatttgctggtccaccttcctcatttcatgcttgagaaaacaggccaggggagattaaagtgactaactaaagtcacagacccagttaatcagagaacaggacccagaacctatgtatcttattttccaggttatgctgggtgtcattatatcctaatcagtgataacaaaaaacaaaattaaaaatcacggactccaccaacatcttaagatttaatatcacaagcaggttttaacgtaagcaccaagagaatggtggactagcccctaacccggtggacctcggcaaggaagaattccagcacttgcatattcctgtgattttaccgctcaccccagaacgatctgtatttctatcagtgctgcataagtgacggccttcggtgccaggaaagaattagacccagaatgcaaacccaaaacgggggtgggagggccttcagcacctaccagctcagcaaatgccagccacggtatccctggtgccccctgcctaggaggcaacgttcttgggggccccacccaggagaagagcccccactaacctttcacaaagtagtccctgttgggcccaatgagcgcgttgtaggggtagccgtagtaggccagtgtgtaggggtcgcaggagtacacgtagctgggctgctgcgctgcctcagccgcgccgccgcccctggctgccttctggtagcgcgagtactgctccttgtccacgggcttggccagcgtgacctccaggcacgagccctccagctcagtgccgttgaggttgttcatggcatgcacggcatcctcgcggctggtgaagtgcacgaaggcgtagtcgcggatcttcttgacgcgctccacgcagccggggttgaactggccgaagctcttcttgatggtgtcctcggtggtctcgatcatgaggttgcgcacgtagaggatcttcacggtctccatcacgtcctcgtccacgtcgatctcaggttcggcccagtccacggcgatctggtggccccacagctggatgcggccaggcatgagcttgcggcgagccatggcagccgcgcggtggctctcgtactccacgaaggcgaagccgcggttcttcatcttgtcggccgcgctggcgtagacgatcacgtccagcacgccctcggtgaccttggcaatctcctccaggatttcctcgcgcttcttcatcttggggatcccgccgatgaagaggcggcagttgtccacgctgcagcacacgccgagcaggcggcccgggcggatctcgtagttgttgagctcacgcactgcgcgcttggcctcgtgcttgtggcagtacatgacgaaggcgtagccgcggttcttgccgtcaaagtccatcatgaggcgcagctcgtagatgcggcccacggcctcgaacacgggcaccagctcgtcctcgtacacgtcgcgcgggatcttgcccacgaagacctcgcagccacgctgcgggtgcgggccctcccagccgggcggtgggccgccgtacttgcgctgcccgttctcttgcaccatgctgtagcccgtgcgctccatcagcgccagcagtgctgcctcgttgggcgcgcccgccacgccctcgggcaccttggcggaggacccggcggccgagtcactgctcatggctgcggtggaatcctctgcggtcataatgtcaaaggcatccacagctggcggaaacctggggaagcagaaagaagcgtgagtggggaaccgctggatcttgcctcttttgggttgtgtttcgcagccttgcaagtatgcattaataggccacggggaaggggaggtggtttaaatgagaaataggatggaggcgttctggaaatgcagcagccctacatttgtctaaaatagtcaagttgtcttgcagcaaaaaccagaagtgagttaggagagaaaaaaaaaaatcagaatgagcaagtacttccatttcatcagtaccccgacagctttgaagttttgcgaagctgctctcatttttggtaaaaacctcacgttcttttgcttcattcctgcaccgttaactccacctgatttccttgttatatggaatttgacaaactccatgtatttctttggtgaacacagctttcttcttttcttttttaagggagtctttttaattgtaggaatggaaatacagtgaagattttaaattattaaagaaaacttttaggagctgtcattgtatagagagagctgtgtattaaagctttttacaaggaagaaatgaaatgtgcacattgccacgggcttggtccaggaactgtaataagagctaatctgattttgatggtggcattcaggtaaaattcttggtgtgaagcattcaaagatttggaatcagtccttgaagagctagactgacttcaagctgggggactgggaagcagcatctacctggtaaaccacactattgttttcagagaactgtcacctgcattctcttaattttcttaacctctgtatatggtacatggtattatcctcagtcccaatttggtcatggggaaataggcttaggttgagtaaactgccccatttcacacagcaagtgtcagcttgtaggcagacttgattccaagttttctggctccagattccctgttttttcttccaaaccaatgctgggcaatcgaattttctatgatgctagaaaagctgtcacttgccacatgtggctactgagcacttggaatggggctagtgtgactgaggagctggattttaaattttaattaaacagccacgtatcacagtgcaggtctgaactgtgccgccttcacttatatggccaagggctctgtggaagtgattctaaattatgcaataagattattacgatgagctgcagactatacttctgtaatgaaaggctccaattcgccttttaaaaaatgaaatctatttcattttttggactataaaagtattcagttaaatttatagaaagttaagaaaagtacataagaaattattcctaattttcctacccaatgatagcacaatgaaactttctcatctgttttctagatgttttcttgaggaggtgggagggggaagcctggcttccgcctaatttacatggtgctactttatgttataagcattcctctgtattcttaaaaatctttgtaaaaacatcatttttaatggccatataaggtttcatcaattaattagaacccggagtatcattcattttttaaaatttaggactaggagatgtatacaagaatattaagggaaatttcaaggataataaaaatgaatttgatcattgaaggaaaaaataaaactataatgaaacaaaataaatctgagctatttatttgccagatggccaaaatagtccttttgtggttaatttgctctaatatcaagcggcagtacagtttagcaggtaagtatgtggcttctggagccagactgcatatgtttgtttgtgaatctcagctctaatacttgctagtgttagctgctccatgcctcacctcagtttccctacctataaaatcagaatgataataatagtattaacctcattaagtttagaggagtgagttaatacatacacagcattttgaatggtgcctagaatattataaatgctcaagaaatgtcagttattaatttcatccaaacttttgagtaaaatcttagaccaattctttcaattttagagtaattcttaagataaacatcttcagttctttaaaaatatctgttacacgtggcttctattcttattatttttttcctcttcaagtgcttggaagctggtttgacgtctccagttatcatgaaatttttttgtagtatacttggaaaattagtttctgtagtttcaagttgaaaaacatttttttttctttttttaaaaatagagatggagggccaggcagagtggcttgtgcctgtaatcccagctcttagggaggcagaggtgggaggattacttgagcccaggagtttgaaacctgcctgggcaatatagaaagacctcgttctccacaaaaaaaggaaccaaaaaaaaaaagatcccaattaaaatagagatagagtctcactatgttaccccagctagtctcaaactcctgggctcaagtaatcctcctgcctcagcctcccaaagtgctaggattacaggcatgagccaccacacccaaccaagaaatttcaacattaaatctgaacatgaagacctttcccttcttccaaatggaagataaggatatatttttaagaggactatttgcataaacacccatgtagttacaatctgtgacctaggcaggaaatgccaggtacatatataaatacataggagacaattcaagatcttacctgttgtactgtatacaacattaactgactaaagtccaagggaatagaacttatctctctgctgagataggtggagttgccttcctgtcaccctaactgtgctttgaaactactattctacctacaaaaacagtcttacagtagtcaggctacggagtcattgccaattccaaccccaataatataagaaaaaatcctgtttgctttcagtctgaaatctgctggtgtcagtaacacaattatctctacatattttaaaatagcgatagcttatttcttacatcaatgagccaagaaaagcctttcttcacctatgctatcatcttctgtaataaacaaaccatgttagcgaccctgtttttatttttactttggcctctaggaagttcacgattgatttttttcactccaattttagtaactgtaggggacattacaacacactttcatgttcatctaatttgggttatagtttcattttttagttttcttctattttttcagttttcccagtgacatgaattgagctgtttgtattatttatcttattgttcacatgttcttataaaccatgttgtaattttggaggagacgaatcaatgcatacatacatgcatatatatctaattacagccagacattgattaatgcaatatccaaatttgctgtgtctcttacaccaactacaagtattgcataccaacaagtgagaaccacaatgagatactacttcacactcattaggatagttattataaaaacaacaaaaaacaggaaataagcattggcaaggacgtggagaaattgaaaccctcatgcagtgctggtaggaatataaaatggtacagccgctgtaaaaaacagtatggtggttcctcaaaaaattaaacatagaattaccatttgatccagcaattccacttctaggtatatacccaaaagactcaaatagatacttgtataatgatgttcacagcaacagtatttacagttgccaaaagatggaagcaacccaaatgttgatcaatggattatgataaacagaacgtggtatacatatacaatgcagtattattcagccttttttcttttgctttttttttagacagagtctcactctgtcacccaggctggcgtgcagtggtgcagtctctgctcactgcaacctccacctctcaggttcaaacaattcacctcagcctcccaagtaactgggactacaggcgcacaccaccacgcccagctaatttttgtatttttagtacaggtggggtttcaccatgttggccaggctggtcttgaactcctgacctcaggtgctctgcccgcctcggtctcccaaaatactgggattacacgtgtgagccaccgtgcccggcttattcagccttgaataaaattctgatacgtgctacaatatggaagaaccttgaagacattatgctaatagtgaaataagccagacacaaagggataaatattatatgattccacttatataaggtacctagagtagtcaaattcatagacagaaagtagactagtggttaccatgggctggagaaagggaggagtggggaattagtgcttcatgggtgtgggtgtcttaattagggataataaaggtctggagatggatggtggtgatggcagcacaacagtgtgaatatacttcctgccaatgaaccatacacttaaaaatggtaaaatgttatgtataatataccacagtaaaaacaaaatcctttaaaaaaaagaaaaggttcagagatgcaaaaaagacaaaaattagagttgataaaactaggatttcattagaggccattaaaaaatgatacactgggctgggcacagtggcttacacctgtaatcccagcactttgggaggctaaggtgggcggatcacctgaggttgggagttcgagaccagcctgaccaacatggagaaaccccatctctaataaaaatacaaaattagctgggcgtggtggcacatgcctgtaatctcagctactcaggatgctaaggcaggagaatcccttgaacctgggaggcggaagttgtggtgtgctgagatggcgccattgcactctagcctgggcaacaagagtgaaactccttctcaaaaaaaaaaaaaaaaaaaaaaaaaaaaaaaaaaaggtacactgactcaggttaacacattcaagaaaatcttatggcctacaagttttattctccttatcatcatgtttaatataccatattaaataaattatatggtgtgctactctactcaatgaattcagatgccaaacacttagatatattaaaagataaatgaggctgggctcagtggctcacgcctgtaattctggcactttgggcggctgaggcaggtagattgcttaagctcaggagcacgagaccagcctgggcaacatggcaaaaccccatctctacaaaaagtacaaaaattagccgggcatggtggtgtgtgcctgtagtcccagctatttgggaggctgaggtggaaggatcacctgagctcaggaagttgaggctgcagtgagctgtgactgcgccactgcactccagcctaggcaacagagtgagaacctgtctcaaaaacaacaacaacaataacgaaaaggaaaagattttcaagttactttgaaaaagacaactgtacagctaacatgacccttctctcaaagatgtaatgaaatgcttaacttattgtaattatatgtgctttagattagcattggcaagctatggctgtgggccaaatatggcctgctgtttgtttctataaataaaattgtattggaacacaaccctatccttaaaaaaaaaaaaaagaaaagataatgtgtggctgcttttatactacaatggcaaagcgaaatagttgagacccagacagtgtggctcataaagcctaaggtatttactctccggctctgttgacccctggtctaggagatgtggaagagcgcatccttgaagctcttagattctgcttgctacgtataatagttttcctatgctgaatgataacttaatttcaggactaatttttaaattctaactgttttttttttttttagatggagtctcactctgtcatccaggctggagtgcagtggtatgatcttggctcactgcaatctccacctccaggattcaagcgatttatctgcctcagcctcctgagtagctggtattacaggtgcgtaccatcatgtccggttaatttttgtatttttagtagagatggggtttcaccatgtttgccaggctggtctcgaactcctgacctcaagtgatctgtctgcctcctaaagtgctgggattacaggtgtgagccactgtgcccggccttaaattctaacatattttaaaacagtgttgtttggccgggcgcggtggctcatgcctgtaatcccagcactttgggaggccgaggagggcggatcacaaggtcaggagattgagaccatcctggctaacacggtgaaaccccatctctactaaaaatagaaaaaattagctgggtgtgctggtggacgcctgtagtcccagccacaggggaggctgaggcaggagaatggcgtgagcccgagagtcggagcttgcagtgagccgagatcacaccactgcactccagcctgggcgacagagcgagactccgtctcaaaaaaaaaaaaaaaaaaagacagtgttgtttagctgcctttccccctcttccaagctgttttccgtttaactccaatggccaaatttatgagacatggaagaagaaaatatctgatgaaggttgttggctcagctcctgacacttatatattaataatttcttaaaattccaaaagagatacaagagggtttgttttcattcattcattcattcattcagcaaatagttattgaccacctgctatgtgccagatactgtgctagctatggtggacctcgtccttgtggagctgacttctgagttaagtgaactcagttaactgaattacgcttcaaatgccaaataggtgagaattgaggtatttgtactcatggttactgaccagagcctgcttcaaaagggtcatacacctcaacattgttaacattcgtttctgataaggccatagttccccaagttaaaagcccatataccatcagaattttgcttttaaatatatcaggggtgtctggggactagtgtgaaataccatatcctgaatgttgagattcttgcttggggcagaagtgtggacagaatgaataataagtatacttcagaagtagaaacttatctgtgagcaaatcaaaatatctagataaataacacagagttccccagtttcatccattcaccatgtgacagttttaaaagggactgggcattctggtttaggcttcgtagcatgttgaataaatgcaagtctctagagtcagacagtctgaagtccaaatcttagttcctctacttctagctgtgaaccttgagaaaagccatttaacatcattaagaatctatattctcatctctaaaatgatgactgtattaaccaatgtttactgaatgtctattatgtgacaggcagagtgctatgcttgtgcatattaactcattctaatcctcacagtgtctatatggtatacgactagggtctccaccctacagatagggaaactgaggcacagagaggctaagtagattctcagttaatgagcatcagagctggtgtgtgaaccctgggagtctgattttcatcatagggctgtgatgaggattaagtaaaatgatttgtgtaaagttcttagtgcagaacctagcactaagtgatcaaggaatgttagcacaagaaaactgaacttaaggctgggcgtggtgactcatacctttaatcctaacactttggtatgctgaggcaggagaattgcttgagctcaggagcttgagactagcctgggcaacatagtgagaccccatctctacaaaaatttaaaaaattagctgggtgttgtggcgtaacacctgtggtcccagctatttgggaggctgaggtgggaagatcacttgagcctgggaggtcaaggctgcagtgagctatgattgtgccactgtactccagcctaggtgacagagcaagacccagtctcaaaaaaaaaaaaaaaaaaaaaaggaaaaaagacaataaaacttaaaaaaaaaattgaactggagggaagaatcttgccccatgtaggattctgtgtttatgggaaaacaggcaagaggttatcccagccaactttaaaccagtcagtagagaagcctagcctgtgagttctggtggagactagtgtatcagagtctcccagattcctttcatagcaggtaagctgtctggcagtgtgattctccactggtgatgtggcttatgcatccatgtgtaagcctgtttctcacctaatccttggctaaagcactttgcagaagctctcccagaaagaacatgaagagacttgccacattggatgcaaaatgtccaaccatctatgtagatgccaaatcccctgaggtaggaccctcccagcacacagctattcttcccaacactaaaaatgcatgagtcttcactgaaggctgctagcattaaataaacatggcaatatatttgaaataaatcatttactcacagttttgtatataaaacaagcagaaaaaatataccttcaaatcaagctattattattctgaactagggatttttgttatgttttagggagagtttgaacttgttgggttaaaataaaatttcaaggcaaacaggtaaagcagacatcatcaaggatttgaattctctttttagcgtttgttcagagtagctttcattaggattttaactttgaactgggacattttagagggcaaaggataccagtgtactactgggaaatattatcaatgtttacataccagtgtttacctaggatcaaaatcatgcatgagtttactctagaattaataagactaccggtccgctgcactggctcaggcctgtaatcccagcactttggaaggctgaggcgggtggatcacaaggtcaggagttcaagaccaacctggccaagatggtaaaaccccatctctactaaaaatttaaaacaggccaggcgcagtggctcacgcctataatcccagcactttgggaggctgaggcgggtggatcacaaggtcaggagatcgagaccatcctggctaacacagtgaaaccccatctctactaaaaatacaaaaaaattagccgggcatggtggcaggcgcctgtagtcccagttactctggaggccgaggcaggagaatggcgtgaacccgggaggtggagcttgcagtgagccgagatcgtgccactgcactccagcccgggtgacaaagagagactccgtctcaaaaaaataaaaataaaaaaataaaaaaacaaaacaagtagccaggcatggtggcgggtgcctgtaatctcagctactcgggaggctgaggtagagaattgcttgaacccgggaggcagaggttgcagtgagccgagactgcgccactgcactccagcctgggtgacagagtgagactccatctcaaaataaataaataaataaataagactacaagttaactttggttcacagctcttggagtgtgactgtgagagtgtgtgtgtgtgagtgtgagtgtgtgtgtttgagtgtgtgtgtgtgtttgagatgagtatgcaatttggaattcttgggagagctttatttgctgaccaactgacaaattgcaatttgaagctatatacagtggggtacagtgtcttccaatcactacctggaatttaattcagtggagggttttaaaatgtgttgatccaagagataattctatctctgtggttagatttctattttgatgttccttattcataccataaaattttgtcctaataatcacgtcttaagcatgacctaacacacacaatgcacataagagcaaaggctttggagtcagagatctaagttcaagtcatgactgtgccacttactagctgtgtctcctcaggcaaatcaccttagttccatttccacatctctaagatggttctagtaacagcaccaggactaagtgacatttggcaatgtgtggcacacaatttgtttaaaaagtttggcaattattattattactttaaagaatgccacttaaaagccatagtttgtgttttagagaggagtctctcacaaaagttcagaataacctcatggtttacagaaaaattatttgattatttggtaaaggaagatgttgccccaaacttggggtgaaggagggggtggggtaggaaatcagagagaaaaacagtttctgcaaaaggtttccaagatttggccttaccctgagcatttatcttactgccttggtccaagttaccaccacccagtagaataaacattggagaggacacgcccactctcgggcaggcccctggcaccaggatgtttctattacctcagagtttgaaagtggaaaaggagttccactcaaaatggaggcagaacatggaatttacttgggaggtcaaacaataagccgaagactttgaaacacgggctctttttttctatcacaggcagggacctcttgctactgaaaagcatggcccttggggcacataaacatctctccttgactctcctttctttaggtaaaatcctgggaggttgaagatacaagggaataatgacattccgggccatgccttctgcccacccctcgctcatctgagaaagcgttcattcataatgggtcttaattgtgttgatgattgtacagattttgttatgtcaaagcacatcattcaatgaatgcttgtgtatgataaacagatgcaaagccaagaggctcaattttcccagacgtttctatcaacacacacctgagaatgcggccttttgctgtgggttctcagggaggcctgctgtgtactacaagacggctgaagccaccctcccgaaaggggtggagtggggagattttctgcaggggtttggcagcacacaaataccagttaggaaactattatcttgttccctttatttatttagacggaatctcattctgtcgcccaggctggagtgcagtggcgccatctcagctcactgaagcctccaccgcccgggttcaagtgattctcctgcctcagcctccggagtagttaggactacaggcatgcaccaccacgcccagctaagttttgtactttttttagtagagatgaggattcaccatgttggccagcctggtctcgaactcctggcctcaaatgatccgcctgccttggcctcctaaagtgctggttttataggtgtgagccaccgcacctggccttgttccctttaaataagcattacttacactttgtctctaaaggttgatggggtaatgctgaaaccaacaaaaatgaaactcacaaattcagcacacatatgcctcccgggccaacgtttttccaatccatgaacaaacagtaggagggacttctagtttcactccttaccttggctcctttgacctaagcctttgagggatctggcaaggaacagaaaggccgactggcagacaccagaaaggaaaaggaaggagaagccacagtggcttctatcatttaacactagcttgaattcatacagtgttttgcaatttataaaattctttcaggctgggcaaggtggctaacgcctataattccagcactttgggaggctgaggcggcctgatcacctgagttgaggagtttgagaccagcctggccaacatagtgaaactctgtctctactgaaaaaaaaaaaatataaaacttagccaggcgtggtggcatgcacctgtagtcccagctatttgggaggctgaggcagaagaattgcttgaacctgggaggcggaggttgcagtgagccaagatcgcaccaatgcactccagcctgggtgacacacaagactctgtctcaaaaaagaaaaaaaaaaattatttcacatatattatctaatttcataaaatcccagaatttgagctgctcagggaatataggtgttctctaacccagggtttttgaacctcagccctattgatatttgtgataattctatgttatgaggggctgtcttgtgtgttttcagatgtttcataacatccctgtcctctacccactagatgcaaaagccccctacctccacaatgttgtgacaaccagaaatgtctccagacattgcaaatctgggggcagggggtgcgcataaaattgctttctgtcgagaattactggtggagtctatcttggagctgtgtaatatgattatatactggcacacatggtaggtactttttaaatagagaagaagttgttattttctacagccctccctcaacatgggcctggtgtcttgatctggctcttacgaatagtcaaggctggccgggcacagtggctcacgcctgtaatcccagcactttgtgaggttgaggtgggaggatcgctggagcccaggagttcgagaccagcctgggcagcatggcaaggcgcagtagctaccaaaaaaaaaaaaaaaaaaaaaagtcaaggctatcaagactgagaaacgtgcaacatttttcaagggtttgaggtaagtgtctctgtgatacaataatactcatttaatttggttgaaacactatcaatttaattttcagacaaaacaacagctaccataaaggcttgttaagaatggttctgttgtctaattgacttgtcatcacagcaaacttgacaggcctgggtcatagaaacatcactgccgaaatcagtctaaagcatccaactgtctcatttaaattccgaccccgctgctacatggacacatgagaactgctgacaatctggtttttaagacttgggctgttttcaaatgtcattactggtttcttcaataatgcaataacccttacttaaaatttacagtttttttttaaagacatactatgaacaatcactgaaaatgggcttctgggatacagtcaattcactggtactaaagtcagcatctgtacaggtctgtaggcaaaaggcaatgatgtggtaaaataaatgattaaacaatatttgcatatgaattgattcattccctcgctcattcaaacactaattgagcactggctgcgtatgaggctgtgctagatgcttggggatacagtggtggctactgcatgttccttggagttcacagtctggcaagggtagatgaagaaggaaggggaggccaggaacagtggctcatgcctgtaatcccagcactttgggaggccaaggcgggcagattgcctgaggtcaggagttcgagaccagcctggccaacatggcaaaaccctgtctctactaaaaatacaaaaattagccgggtgtggtggcatgtgcctgtagtctcagctacttgggagggtgaggcaggagaattgcttgaacccaggaggtagaggctgcaatgagccgagatcatgccactgcactccagcctgggcaacagagcgagactccatctcaaaaaaaaaaaaaagaaggaaagggaggagacagagcagagggaacattatgagcaaaggtgggcatttgcaaaaatgctggaatggtctcaaatagctgaaatgtaggaggtggatatggggcagaagatgaggctcaaaaagaaaatgaaaccagattgtgaagggtctaagtctctcactttctgtggtagacagtggagagccacgaagctttagccatgactaggaagttcaggctgagtcctcagtgaaagaatgagtagctcttgcaccaggagttttatttattcagaggaatagaaacgattttataaatttgtttatgaagtattctgctaagcaagcaggaggcctgagtagtgtttataaggggacaagagaccgaaaactcaggaattaaaagcacgagataaacctgaagttctgtatcttgtcagccttagtctagcgtccgccaggtcaaatctaccgtctattataaacatccgccttttcataatacataacactactgcagtttttttttaagccttttttctacaattagaatgtaaactttgagagagcagaatttatgtctcttcttggttatcataaactcctcaaagcttgacacttaaaagacaataaatatttgtcaaataattaaatggactgtgatttccttctttttttttttttttttttttaagacagagtctgactctgtcacccagactggagtgcagtggcttgatcttggctcactgcaaactccacttcccgggttcaagcagttctcctgcctcagcctcccgagtagctggaactacaggcacccaccactgcacccagctaatttttgtatttttagagacggggtttcaccatgttggccaggatggtctcgagctcctgaccttgtgatctgcccgcctcagcctcccaaagttctgggattacaggcttgagccactgtacccggcccatttccttcttaataacataattaatagcgataaatacttaaagattacttatttttgtacaaggcactgtgctagaaatgggtgggagggaacataaaaaaccatataagattgttcagccctaggaggtcacaaaacttccttcaacaaacattgattgagtgccaaaatgaagacagtggcttagtaaagtgcacaagcaaggatggactgtgggccaagacagacttcagggaataagccagctatcacatgtagccgaggattgaaaatctgcacatttcttgtttaattatatttagagacagatggaaattatgcagcagtagaagttctacttatcctcttacacttagaactaattatgttatcatatgccatgttattgccaatgcaatacacaatgatgttaaataattgattaagatgatgaagatgaactccattttattgaacatctttatgagtgagaccttctgctgactgtcagcagttagcaccatgagagaatttcagaggaggatactgtcccaccccatgtctagtatttctggagaagtggctggagagtgtatttcacttacatgctaagaacagagcagcgctaaaagagaatagccagcttaaatgcaatcctccctacagggaaggagatgaattagaaataatctctcttgttctttgctctcagaggtcaaatttttttttttaaaaaaagaaagaaataatctctccaagagtttccttaatgtatggttttaaaactcccaagttaatgatagttaactatttttttgaacacgtatgtgtaatttgatttctcatgacatttctatgagtggaaattttaaatgtgggctctagagtacggggtagacgcctgctggagacctgcacatttgactccctggctgttttaataaagttttgttggcacataatccacagccattcgtttacatatagtctgtggctgcatttatggggacggtggcagagttgagttaagtagcagcagagatgatacggcctatgaaatctaaagtgtttactgtctggacctttactgcaaacatttgccaacctctgctctaaagtcagatttcctgggtttgagccctagctcttcagctgtgtagctgtgtgacacattggtaaactaactatttaaaatcctgattcctcattatcgtcacctgcaaaatgagactagtaataattatcgctatctcaaagcatcactgtgaggaataaatgagatagccaagggcttagaatgaagctaagtaagggtgtgatcagtgttagctattagtgcccccttttaatttttttattatttatttatttacttatttttattcatttattttttgagatggagtctcactctgtcacccaggttggagtgcagtggcaccatctcagctcactgcaatctccgcctcctgggttcaagcgaatcctgcctcagcctctcgagtagctgggactatagacaagtgccgccatgcccgggtaatttttttgtatctttagtacagacagggttttgccatgttggccaggctggtctcgacctcctgacctcaggtgatccgcccacctcagcctcccaaagtgctgaaattatgtggtggctcacgcctggccatactgcccctttttaaagatcaggagattgagggtatcaaataacttgacccaacttacagaattgaaatgtaggtcaatctgatgacaaagccaaagctctttctaccatgatactcattctttgctacttacttacttacagcaggtttagcaatagccagtgttaacaggataagaccacgattggtgagaaatggacattggctgatagagtggaaggaatttccagtacagacacatggtaaagttgttgggaaatcattactttctaccatccccatcgcttcccctctgcactctccccaccactcttctaagctttcaaagagttctgcaaactgtcccatagcctatttctggctctttgtaaaggagttaacatattcaaactatgtttttagacttaaaaacctatggaattaaattcttaaatggaaatgttgaaggactagaattcacgtaatcgcaatgttcaagtgagaacatgggactgtgatgaggcagtgattccacgcccaggctctggagccagactgcctcgcttcctatctcttgactgtactacttgaaaaacaaatgccatcacacaagtcactttctctccttgagcctcagcttcaccatctataaaatggtgataatattatcattaacattgttgggaggattaaaaagtacctggctggttgggcgtggtggctgaagcctataatcccagcactttgggaggctgaggtgagaagcttgcttgagctcaggagttccagaccagtctgggcaacatagtgagaccctgtctctacaaaaaatacaaaaattagccaggtgtggtggctccagctactcaggaggcggaggtgggaggattgcttcagcctaggaggttaaggctgcaatgagccgtgattgcatcactgcactccggtctgagcaacagagggtaaccctgcctcatagcaaacaaacaaaaagaaacaaaaaagaaaaaagtacctggctacagtaaatgctcaaggccctttgttattatttcagatggtcaagaataaatgtttttcaaggatcttctttttgtagacaactgtgtagtcacagtttagagtcgttaattatctgcctggcaagatactttttaaaattaaaatgtaaagaacctgaggggattcactcccaaatgtttatggacaaactgaaagggcatttacacagatattaccttctacatttatgtgagaaagtgctttaagacactgtacatgtgaaatgtgtagttataatggctactactatgttctcttttatattttctaattatgtaagtattatgttctttttatcactactttgtattcctgcacgggagctttgtgcctacccattgaatgtagtaggccctaaatattgcctgttaactaattatggtgtcatataccatgttaaaattaaaatattacaattactgaagcaggtttaagagagaaacccgggcataatattcttagaaaaactttatgtgccagaagttgaatatatgaactggtagtttgatgcatgattactttttaattataaaagtcatctttaattgcaaaaaattcataatagtgttcttttagataggaaatttcctgtgttgttaagaatatgattcaagttactgagaatttatagatatatatttcctgtacatactattcctatatatctatatataccaacaatactatacaaaagtattagtcccattttcttttttttttttcttttcttttttcttttttttttttttttgagacaagggctctgtcacccaggctggggtgcagtggcatgatcacggctcactgcagcctcaacttctcaggctcaagcaatcctcctacctcgacctctcaggctcaagggatcctctcacctcagcctctcaagttgctgggactacaggtcctcaccaccacgcctggctaattttttatttttttgtagagatgaggtctcaccacgttgcctaaagttgttctcaaactcctgggctcaagcaatcctcctgcctcggcctcccaaagtgctgggattaaaggcgtgagccaacacgcccggccagcctcattttcttgatggagaaactgagaaggagggcgatcatgtgcttacttcaaaatcacaattagataatggcaaatttgtgattgtaattttataaagatgccttatctttggggtgatactttataatttaacttctttttggcagtagagttgttttatatccaaaaccaaaccaaacccagagagtccaaatataaaagatagaattttaaaaaattttaaaatttgtgggggtcgggcgtggtggctcacgcctgtaatcccagcacttttggaggccaagtggagcggatcacctgagatcaggagttcaagaccagcctggccaacatggtgaaatcccatctctactaaaaaatacaaaaattagccgggcgtggtggcctggtgcctgtaatcccaactacttgggaggctgagacagggagaatcacttgaacccaggaggcagagattgcagtgagccaagatagtgccactgcactccagcctgggtgacagagtgagactccatctcaaaaaaaaaaaaaaaacaaaaaaaaggcattttaaaatttgtgtgtaaaaggctgtttactcagggtggaatgtagtgacacgatctcagctcactgcaacctccacctcccaggttcaagtgattttcgtgcctcagcctgggattacaggtgcataccaccacgcccagctaatttttttttgtatttttagtacagacagggtttcaccatgctggccaggctggtcttgaactcctaacgtcaagtgatccactggccttagcctcccaaagtgctgggattagaggcatgagtcactgtgcccagccaagggtatttttcattcgttaaacttcttaaattttactatcacattggggattaagtttaaaaaaattttcttaaatttatgctcaaacagatttagaaagtgaactttttgctgggtgtgctgtcctagcactttgggaagctgaggtaggtggatcacctgagccttggagtttgagaccaacctgggcaacataatgagaccccacctctaataaagtcaaataaaattaaataaaacaaaataaaacaaaatgaaagtgaacgttcccaaacataaacttacagtcattataatggtgtgtgaatgctagtcttctcctcctaatttgaaactatattagtagtttgcaagtagtagttatatagtaacagtatggtctattattactgtgttatattacacatgaatacatgtacaatatgcaccttctggtggtatgtcaaatagtagtatacaaaaataacataggtctttttgtaaaacaaatgacaaattgcctgtcctgaaacaaaggctctgaaacagactgacatagtcaaacattagcttcagttttaggtgtgaccttctgcttttatttggtgaacattagtcatttcagttgcaactaggaaacaatatctgctactatagaaaaaaacagatcctgattatgttgatgtcatgttcattgaccagttatctcaaggcaataattatagtagaatagcattcgcccaggaatactctcaacattgaaaaagtcatgagttaaaatactttcttctataaatgtttaagtttaatgtggggtattttggaagctaaaaatattttcaaaatcaactatatttatgacaatatgaccatagtaggctgtttatgagaaaatataaaaaaggaagtgaactttctggtgggggatcacttaaagacaaaatgcattaaatacaactttaatccagaaaatatgtgttctttttattcattgcattgtttcaatgttgttccacctttccagctctggtgataattgtttttttttcccccttttcttttcttccttttttgggtacacagtgaaaaacaaaaaaagatagcttaaaaaacaggtccttctgcaaacatacggcgaaggttaaactctaataccccatggcttgtttactttaaaaatttggaaaagtaagcaccatgagttcattgatatgagtaggaacctgcgtcatcctgtggtatttgtgaatattgtgggctcttttatcaatttcatttgtttctaagtctttccaaagaactctattagaaatgagaccatctgagacaggtcctttaacacagaaaaagtaaaattcgccttctattatgaagtgattttagatattaaaggctctttccacttctttatgcattgtttgaaatgtcttagaaaagttaaaacaatagtgtttatagtttattttattagctacacttgaagcatctcaaaggcagtgatgcttattttatccccagtgcctggcactgaatgaatgtttgaataaaagaatgaatggatagaagaatgaatgaatgtgcactgtcttttgcaagaaacatggtaggacaaagctacaaaaagagtttccttttataactaacatccaccaaattgctttggacatttttttcacgtatctatttactaagttttgtgggagagccgtgcatgggggtgcatgcctgaaatcccagctactggggagggtgaggtgggaggattgcttgagcctaggagttcaaggctgcattgagctatgattgtgccactgcactccagcctgggcaacagagcaagaccctatctctaaaaaaaattaataataaaaataatttaaaaaaacttttgtggtttacctgcatatagaactgggtacaaatagtcatacccaggtactatctggtggtatttctgcatggccgaaaggagcccatcagagaatgaataggccagctttggtacaggagttggcatttctttctttcttctttctttttttgagacagagtttcattcttgttgctaaggctggtgtgcaatagtgtaatggcgctatcttggctcaccacagcctctgcctccgcctcccaggttcaagcaattctcctgcctcagcctcccgggtagctgggattataggcatgtgccaccatgcctatagctaattttgtatttttagtagagacggggtttcaccacgttggtcaggctggtctcaaattcccaacctcaggtgatccacccgcctcggcctctcaaagtgctgggattacaggcctgagccaccacgcctggccaggagctggcatttctaacacatgcccaggcatcaggaatgtcacatggaaaagccacaccaacccctaatggattatattgaatgccaatgttaatatcccttgagccgtcttggtaaagtaggtactggccagggagctataaaatttccatcactgttttttttttttttcttttttcttttggccttaactgatatgcttagcttctgctatactgtctcaggaattcggtagagattttatgccacaaggaaataggcacataaatgaggcctgcccatgaaggcagtttttaatcactcttttatctgaaggtattttgagaggctgcttattacagtgcttgagctcgagctcctgcatgccagagctcaaccgcttgagttcaataccatttattaactgtgtgacttcaggtgagtgacttactctcccaagcttcagttcactcaactggaaaatgggaatagaccgggtgtggtggctcacgcctgtaatcccagctacttgggaggctgaggcaggacaattgcttgaaccaggaaggtgaaggttgcagtgaggtgagattgtgccactgcactccagagaggctgaggcaggtggatcacctgaggtcaggagtccaggaccagcctggcccacatagcaaaaccccatctctactaaaaatacaaaagttagtcaggcatggtggcaggcgcctgtagtcccagctactcgggacgctgaggcaggacaatctcttgaaccccagaggcaggtgttgcagtgagccaagatcgcaccactgcactccagcctgggtgacagagttaagactctgtctcaaaaaaaaaaaaaaaaaaaaagatacttattaaaagaagaaggaagagaaggaaaatcagttttcccagtctctataattaaactaggcagttagagacaattggaaattcttacaaatttaaataaaaagcacaactacattaattaaagaaactcaagaaatatgcacttaaattaagaatggaaatgaacagaaaatacatatctagagtttcactgaacctagagtatttaaaatgaaaaattcaggtgtcaggaaatttatgatttcccaggtctactaaactcctggaacaattgttggcatttaattgctattcatgtctcgcgtactctgtactttcactgagtgcacttggagttaatatttcaattaaaaaactaatacatcagtaaaaacgcccagatttgagctaatcatttattctcaggctcacagggaaatactggatattcttcgagttaataaagtgtgaaatgattttaattattcaagggaaatatagtataccagtcttgcaaatggtttttttagacagcatggtctgtcttatcccatcctacatcagaaaatttaattggcttagttatttcctctttcccaaatccctttttatggcaaagagaaaatgaggacctacagcagcccacgttgctgaggacctaaaccagtccctgtgaaaaccaaaacagggatgggctggatttcagtttgtttctcataggttccgaagtcagagttttaaaagatttaacaggctgggcacagtggctcatgcctgtaatcccagcactttggaaggctgagatgggcggatcacctgaggtcaggagttcaagaccagctatggctaacatggagaaaccctgtctgtactaaaacagaaatacaaaaattagtcgggcatggtggcaggcgcctgtaatcccaactactcgagaggctgaggtaggagaatcgcttgaacctgggaggcagaggttgcagtgagccaagatcgcaccattgtactccagcctgggtgacaagagtgaaaactccgtctcaaaaaaaaaaaaaaaagatttaacattaatttatttggaatttggacagccaactgccaatgtcaagcattccaatgttgagagcctaatacagaatcttgttcatgtggggagacctctgagaccctgagttgcattagcatggcactactgtcatctccaagcccgtcagagaacagcgcccgtccagtgcagacatttgaagctaggcgaggcgggttacacagcctggggagtctttgtacttttcaatattctccaagggaagtctagacaggcttcacattttgttaagtacagctaggttctgtccacaataaaacagaactaggacaactgttttggaaacatagttagcacataattgtagctaatttagtttttttctctgaagcagcatgaaaagaaatttgtttttgtacaaaagatgtttttatcttctatagcccacaattcccaacaacagagtgtcctctctccttccctctgctgcaaatatatgcacctacataacacccacatgcacgtttttttctagcctaagccactatctacccctgctgttctctttttggggatttcttcaagcatatttacaaaacacttgctgagcccaactgccgcctcactgctgtatcctagttacatgagccatcagttccccaaacgcttgctttcacctgtctgttgggaaaccacctaagcctatacgaggaagaaaaatcattcagaacaaatgttggcttgaatactcatgtcgttttcttaactgcttgatacaggctttcaccgagatttggtgggaatcaaaagtacatctttaaaagaatcctggcctttaccttacactatatataaaaataaactcaaatagatcaaagacctaaatgtaagagctaaaactataagacttggaagaaaatacaggggcaaactttcatgatactggatttggcaatgattttttggacaaccccaaaagcacagcaacaaaagaaaaaatagataaagtaaacttaatcgaaattaataacttttgtgcaccaaaggacactgtcaagagagtgaaaaggcaacccacagtgtaggagaaaatatgtgcaaatcatgtctgataaggaattgatattcagaacatataaagaactacaactcaataacaaaaagcaaacaagctaatttaaaaatggtcaaaaaagttgaacagatatttttccaaggaagatatacattatacatccgcaaagatatacattatacatctgcattacacatctgcaaagacccttgaaaaaataaagaagacacacagatgccccttaaggacatgagaagatgctcaacatcattcatcattagggaaatgcaaatcaaagccaccatgatataccgcttcacactcactgtgatggcaattatcaaaaaaacaaaaccacaagtgttggtgagaatgtggagaaactggaacccttgtgcactgctggtgggaatgtataatggtgcagcttctgtgggaaaaagtatggtggtgcttcaaaaatataatcataataaacagaagtaccacatgagccagcagcttctcctgatgcacagtgcaagaaatgaacataagtggtaataataaatattcagtgaatgaatgtaggcctcacatatctttttcccatagagagattgaggttggtaagtaataacagatctggtgacactgtcttctactttagagacctgatattggctagaggtggggtaggtaaaggggagggaataggcttttattaggttggtgcaaaagtgattgcagtttttgtcgttacatttaatggcaaaaactgcaattacttttgcaccaacctaaatattttttgagtatctataaaaatatttctggttttaaaatcttcctaaattggtaatacagtttttacatgtgccctgtgaaacgcacattgccatatatgatgcgtggggataggtgggaaggtgggtaaaatttgctgtttctgaaagagttggacaatatcaagagctttacagtgttcattagtcaattctcattagcccaatgattccatttatagacatgtataatcaaatacccaagcaaagatttacattcaaatctgtttactgaagttctatttataatacaatgcaatgaacataatagtatatatttacacgtaatgtaataaacacaaatattcaatggtataaaaatggtcaataaatcgtggcatagccacagcttagagtacctgtttaatgttctcagctattttaactttgctaaataatatttaaagatatgcggtagtcccccttcatctgaggaggacctgttccaagacccccagtggatgcctgaaacctctgatagtaatgaaccctatatatactgttttttcctatacatatttacatatataatacatacctatgattaagtttaatttataaattaggcacagtaagagattaacaacaacaataataaaatgtaacaattatagcaatactctaataataaagttatgtgagtgtggtctctctctctgtctcaaaatatcatactgtatgcctctattttgggaatacagttgacaacgggtaactgaaaccgagaaaagtgaaactgcagatgggggctgactactgtatatgaaaattaaacaatcagccaggcatggtggctcacgcctgtaataccagcactttgggaggccgaggcgggaggatcacgaggtcaggagatcgagaccacggtgaaaccccgtctctattaaaaatacaaaaaaaaaattagccgggtacagtggcaggcacctgtagtcccagctactcgggaggctgaggcaggagaatggcgtgaacccgggaggcagagcttgcagtgagccgagatcgcgccactgcactccagcctgggcgacagagcaagactctgtctcaaaaaaaaaaaaaaaaaaaaaaaaaaggaaaagaaaattaaacaaccaaacaaaatcagagtaaatacaccatgttaattctggttatatttggattgtgggcttatgggtagattttgttacatttttctataatttccagatttccttccattagtatacttttataagaagaaaaaaattacaattaaaaaaattttgctctctgagtccctgaattcaatggactaaatccaaaacccagcctagggaacatgaagacaaagtacctattttctctcgcagggattattgggcacatcagtgtcgctggcagcccctccctgacacaccaatatctactgcctccaccttctggagctatgtgagggctggggtccaaggtcagggtgaagctaatctttctcctatcttcccttcctagcacacacaagattatcgtccatagaataatctcactcactagatccatagaaagatctcagctcagcggggcactgtgcctcatgcctgtaatcctagcacatgggaggccgaggagggcagattgcctgagctcagaggttcaagaccagcctgggcaacacagtgaaaccctgtctctactaaaaatacaaaaaaattagctgggcatgaaaattagccgggtgtggtagcgtgcacctataatcccacctactcgggaggctgaagcaggagaattgctcgaacccgggaggcggcggctgcagtgagccgagatcgtgccactgcactctagcctggtcgacagagcgacactccatctccaaaaaaaaaaaaagagagatcttggctcactgcaacctctgcctccttggctcagtcctacttggagaagattaaatggttgtcaaagtgcttttacatatgttgtggttctttggatcatcatgaattgggatgacagttatttttacctcatatgacaggcaaggaaacagaaacttagagaaggtatgaggattgatcaaaaatacaagatactatcacactgaatcctagtctagtttgtaccaagaacccagcctcgtgtcacacaatcaaaatacagtctgactgaaacatagttgactggctgggtgctgtggctcatgtccgtaatcccaggactttgggaggctgaggtgggtgaatctcttgaggccagcagtttgagaactagcctggccaaaatggtaaaaccttgtctctaataaaaatataaaaatcagccagatgtggtggtacacacctgtaatcccagctactcgggaggctgagtcacgagaattgcttgaacctgggaggtgaaggctgcagtgagctgagatcgtgccactgcactccaccctgggtaacagagtgagactgtctcaaaaaaaaaaaaaaaaaaaagaaagaaagaaatacagttgacctcttttttgggaggttaagggtcagatttataagcaacacatagttatatcttgtctcttaagtcacaaagatgtaaagtgtacaaagacataaaggtttatattgagggttccaaatgacttatcacgttctatattccactaacgttgccacatgaacacacaacaggtacacattgtctaagtagcaggtatcttggttgaaaggaatgaaaacttatgttcttgcttaagtggaagggaaaaggaccagaggaagtatactcaccaaaaccactaatttgatttgtctggtcctttataagtcgcagaacgagagtatacaggcaaattcaggcagcttccttgggattcctctgttcaatttttgcagtgccctttgaggcaaatcctaagggttaaaaaagaaatggttagaaatattttctatttcaacatgattttcatatgtgcattagaaattgggggggggggggcagatcctcttgcgtagttcctaagcataataattagaaactggggggccattttcttcaaaaaatgaaataccattactctaattatcatgttctctataaaccaagtgcaactgcttatctgattcttaaagaaacaaggaacagtaataataagaaaatgactaatttcttccatttgtgtttgtctctatgccttcttcagagtgtgcatgacttcaagatgcacataatgtttaagaaggaatacagatgtagcctatattttacacttatagactcacaaaaagaggtagtatcctttacagaaataatcatatctagctcatggacttcccagccaatttgggagcttatgctacacatcactaatagatcttcaaactcttcctgcagggtccagagagggttcccaaaaccattgaagcaagtactccagctatccactaccaaccagagttggtatgaaagagacttactgttctgcccctaaaatgtagaggtaagactcttttttttttttgagatggagttttgctctgtcgcccaggctggagtgcagttgcgtagtctcggctcactgcaaacgccacctcccaggttcatgcgattctcctgcctcagcctcccaagtagctgagattacaggtgcccaccaccacgcctggctaatttttgtattttttagtagagctggggtttcatcatgttggccaggctggtctcaaactcctgacctcaagtgatccacccgactcagcctcccaaagtgccaggattacaggtttgagccactgtactcggcagagtcaagactcttttgaggatgttcatcgcatggagaggcccatgaaaaatatgatttgggggtttagaataatctttaataagtaatgatataggaaatattcacatgaaaagaatttaaagttcaagataaagatatttcagatgaggaattaaaatatatcttaagcacaaaacttttatttttatttcaatgtgtggaaatataatctgcctgattttccaaactacagagagcccccatcaagccaactgaagctccaaataacttatacaagattcaatatggcacagtggtttcaacaccagactgggaaccagaaggctagttttaaggctatctctgtcatgcccagttcatttcacctgtctgagccaaagtttactcccatggaaaaaaaataataaaggaggccaggtgtggtggctcatgcctgtaatcctagcactttgggaggtcaagatgagtggatcacttgagatcaagagttcaagaccagcctggccaacatggtgaaaccctgttaccgctaaaaatacaaaaaattagctgggtgcagtggtaggcgcctgtaatcccagctactcaggaggctgaggcaggagaatcacttgaacctgggatgcggaggctgcagtgagctgagattgtgccactgcactccagcctgggcgacagagcaagactgtctcaaaaaagttaaataaataaaaataagaataaaggagttggattaccaatagttctcaacattaaaaaaaaattgtgtttgttttttctttgtgttttagttgtagcacacttttttccaccaaaaatctaactagttgcagaaacaacaccaataaaacagttgctggttgaagtataggtaggggatgttgtcgggaggtgcccccacttccatcattcattgtgtccctgtggagacaccgtaagacctttaggactccatagagcacagttggaaaccttctggattaaatggcctttaatataacttatagctcaaaattattctgccataactatctttatattggaatgactgggtgctcagtgagatccataacgttatgggaacacagcaataatactttaccatgatctagttttaatcttgttaacaatgatctcctgaaagaaaaaaagccacaccctcaaataaattacagagcaatagctgttaaaatgatttacgttttaatacacataatctttacccaactctgtgaaaagataattcctgaaatgctgcatcctggataatacctagtaatcaagatcatagtggttgataaaaactacgaaaacgaatgtacaaagtacaagaaggtgtgtcttgaaattaattgtacactgtctggacaatagactcctgcatctctcatctactagctaagtaaatccagacaagtatattcaactttcctgagcctcagtttccacctccataaagcagaaatcattcctggcaggactgttgtggagaacagagaaaatatttataaagcaccattctcgacatatattatttgtgcagaattttgagttttcactctttctgtaatggtaaaatgtctccctttaaaatgtaataccaaggtaatgaacatgtaaactctaagaattgaaagcaaattattaatatataaatgaaacacagaattcacgtagttttgtgctacatcataaaaagggaaagaaggatcacagatgtgcctttcacggctattcaagtaacacaggacatttccccaaaatgaaacacttagggtcaatgtttgtttccagaaaaatctgactttccagaataactccaaacacaatccattccataattttttttttttttttttgagatggcgtctcactccatcccccaggctggagtgcagtagcctgatctcggctcactgcaacctctgcctcctgggttcaagcgattctcctgtctcagcctcctgagtagctgggactacaggtgtgcgtcaccatgcctggctaattttgggaggccgaggccagcagatcaaatgaaatagattgtgtttggagttattctggaaagtcagatttttctggaaacaaacattgaccctaagtgtttcattttggggaaatgtcctgtgttacttgaatagccatgaaaggcacatctgtgatccttctttccctttttatgatgtagcacaaaactacgtgagacattttgtatttttagtagagatggggttttgccatgttggccaggctggtctctaactcttaacctcaagcgatctgctggcctcggcctcccaaagtgctggggttacaggcgtgagccaccatgtgcggccagaatatttaatattgttatgtttgccataaaaatcttcaagcaaaacctatatgttatgtttgtcctgtggcttcacattcctcctgacacaatattggatactccagagaacccagtttgagaaggttagttccagtccaaacctttgattttactatggaggaaactgtcttaccaaaggtcacacagtaggtaggaaacatagtaataagatttgtggggcagtttctggagaaacggggtggtttccagacattaatggcgttaattcattccagctccccccgccccccagcctggtaccctgaaattgcatagacatcactcaccccatcatggagtctttataaagaccaaatggggaaaagtttatagattccagtaggaggaaagctatactgacagaacaactggtttgttttaatgttttggggcatgtgaatctcacagccgctcatgactccgtcttcaacacatggggggacttgagggcaagcatttattggatgcttctggcatcatcttagtttgcctatcttgatttttttgccccctcttctatttgtgtcttgacgtgtcgtatgtagttttgaaagctgtttcaagtccatttttggaatgaagcatagcatacataaaacacttgaaattaatacatttatttttcggaaaaagatgctccagtctaatatcaagtcatgtcctgttctacttctctcagtcataaagctaagctaaaaataactttctcaccacaaccctccaccaaggaatgataattccatttcttaaaaacagatcctttcttttctttatttttttaagaggcagagtctcgctctgttgcctaggctggagtgcagtggcgtgatcttgaatcgctgcagcctctgcttcccgggttcaagtgattctcctgcctcagcctcccacgtagctgggattacaggtgcacaccaccacacctggctaatttttgtatttttagtagaggcagggtttcagcatgttggccaggctggtcctgaacgcctgacctcaagtgatctgcccactttggcctcccaaagtgctgggattacaggcgtgagccaccgcgtctcgccagaacctttcttaagataaaccaattgccctcacccaaggatgctagtacatggggtcctaaagctgccaggagaccaccaggttgagagtcaaataactaagttctagttctcgctttgccacctgaacagtttgaccatggcatgctacacaactttctgagcctcaggttgttacccgtacactgaaagatcaccattataaggattacacaagacacaacatttgaaagcatctcctaaactaaccattagctcctgcctggacttctacagtagactcccagctggcttctccctatccactcaggcctgctgcaatcaatctaggtctccttacaggcaaagggaccgtttaaaaaatatacaatttggtcaggcgcagtggctcacgcctgtaatcccagcactttgggaggccaaggtagacagatcacctgaggtcaggagttcgagaccagcctggccaacctggtgaaaccccatctctactaaaaatacaaaattagccgggtgtggtggcacacacctgtaatcctagctactcaggaagctgagacagaattgcttgaatccgggaggtggaggctgcagtaagccgagatcgtgccaggcactccagcctgggtgacaagagcaaaactccacctcaaaaaaaaaaaaaaaggaagcgttttatcacccttctgcttaaacccctacactctcctcccattgcccttagactaagtttgtatcctttgtaaggcttgtaaggcctataaagaggctccacgtcctcctccagcctcatcttgtgttacttcccccttacacatgctgttccaatatttcagccctcaccaattcccatctagccagcttgcactcatcccgaacttcattccttctacaaagctattcctgcagccccctgtgatatgctcccccaacatcatataatccttcatatagcactaggttgaaccatatgaaattgctattttataggacaaaaacagtagactgttgacaattttctttggtttagccttatagtaattgctgtaatgctagtcatcttgagtcagttttaaactctaccagggaagaatctagatctgactcataactagaatcctagagttccacacccaatccaagccaatagtaggcacttaattttttaattagtctgagatgttgttactacctttttaatgccaagcatataaattttatatcgtcattaatagttaaaaatagttttttgtcgggtgcggtggctcatgcctgtaatttcagcactttaggaggccaaggtgggtggatcacctgaggtcaggagtttgagaccagcctgaccaacatggtgaaaccccgtctctgctaaatacaaaaaattagccaggcatggtggcgcatacctgtaatctcagctaaggcaggagaatcacttaaacctgggaggtggaggttgcagtaagctgagatcacgccattgcaccccagcctgggcaacaagagtgatgctctgtctcaaaaaaaaaaaaaaaaaatcatgtttttcttcaaatgctattgatacattccataggactaaaatgaaaaaaatggaatgaaaaagaatcactttcatactttcatttctggcatttctggaaagcatgaattctagtaagtgtaatatatatataaacaagtatagaatttagcccactggtaaggtatcatttatggattttttttttaaactcaaatgtttttcactgcttggcagaataaaggagctctcaaaggaaaccagataatttggatttatccccttttatagtttttgccatgtgacagcaaatcagctaaagaaaaaagatagcatctaaaagagtgctagacttgaaatggaggaattttataagcttccccatgacattcaaaagaaatgcatcctgaaacattcccaaatcaccttatcctatgccacatccaacgatgtccctcatgaaatgaacacagccaagaccaagtctaaaccaaattgagatggtatatgtggtaggctaggtgaactcacaacctaagtaacataataatattaataatagtaatgaccatcaacattcattgaatgtttatcatgcaccaggtatggcactaagcattccacatacatcgtcttatttaatcattgctacaacctcatgaagcaagatctatgatgctactcattctggagatgccagaactgaggtataatgaggctgcccatttgttaaggtcccttagctggaagtgaagaagctggggttcaaaccccaggccttctatggaagaatccaattgctgctgcactccaatctggaagagtagaaaactgaaatctgtgctataacaaaaatgacaaatgattctatatgcattatatattacagcttcagagtcaacatgaggagttaaacctgaatggcaaattcatgaattgttaaggcctaccaggtaggaattttttcaagaaccccaatattcagctttaaacagtaaatgatattctcaacctaggttagaaatatagataggagttcaactttttgggtgacgaatagagaatatcagataggcataaatatcatgggctcagaaatatctggtgttctgacttgtttcctagcttcttaaaaaactatcacactttagaaagtttttgaggactcagagaccccacaaaatgagtaaacaaaactgcaatttcactttctactgcttagttaataatctctaatcagacagttgtttcctgctaacacctaacaaaattatccacctctttcaaatagcaaagaaaatgaacatactaacattcttacagtggaaatataattttacaaataaacacaaattactgaatctttacatatgattcacagatggtggtgatgagattatcatgcccctccccactccgtctttgtgcactgacatttgaccctttttataatatgcaccttgtaccagtgaaacctaaggcaccagttagttactcattaaacttgggtgctgagggctgacttgtacaaattacgctgttaactgcccagcctggcctctgtgcagaagtggaaaaaagcaatcatcatagctgtgaaattctgtcatatcggcagaattgaactacaaattgcagcaattcgtacctgacctctgatctgtgaagttagtctaaacctttgaaccttagcttggaaccgagaagcagcactgacttatacaggacaaggtggctagcaagcgttctccatcgtgaatagttaacactgtgactgttggtcgccccccacacccacctcccccacagagtcatccagagtaaaagacacaaataacgatgatcttgagaatggcagacgtcttacaaaaaggcatttggaacaaatctaatacaagtatacaatttcaggatgcaagtctttttaaatgaatatgtcaaaataagaaaatggaatctgcaataactgaaattcttggatatttaatactttgtgatatgtacattaaaaaatttcctttacaaattagaccaaagtagagttcaaaatgaaatatttaaatacatttttaatcaaatggtgccatctctcatttgtcacattttaaaataaacatattacctaatctctgttataaaatacaaacccatattaagccacctttggcaaaaagcaatcagggaaaaccagttacacttttctttgaacccaaacttatcttttgacactaaatatcagatgtaggctaataaaaagtataagaatatgcatttctcacatatacattttgttgcaacattgattcatcataatgagaagggagaagggttaagagagaagagtatttttctttaaaagattagcttctacttcaaatgctattcaaattgctccactgccagacagaaatgactaaagattctacttctctggtcatttgagttaatattaaaacaaattttgaatagcatataaaatataactaaacaattatttataatgaaagtgaaactaatgttaatactttaaagcatataatctacacctaaataattccatttcataaatttaactattggtttgaaaacaatgataaaagtcttcttatacaagaactttactctgagaggaaatgtcatcattgtcaacctttatatgctaattatcataaagctaattccattaatttttccttattttaattatcacatcttaaaattataatttccttctctaaacactgactctgaaatggctttaaaaatcaaatatgggcaacactgctgataaattcctgcttcttaccccatagtttaaataacaggaaactataaaacaacaacaatactgtgaagatctagatttttcaagcatataaagtgaaaagctgttagaaaaactcattttttagaaaatgtttttaacttaagaattttggttttactgctggtaaggcagactgtgcagcagttgaaattcttaccaacttccaaatttttttgggggggtcttcaattaaaaaacaaacaatatggatcatttgtttatctggtctgatctaaattgctttaaccaaacacagttacctcttcttctcttcatttaaaacaaataaggtttcccctacctttccaatcttgatctgggtgcgacaggctaactgtaatgaaagctttgcttaagcaaccttcgctcccaataccaggagctgtgtaactctgttatacatggcacagggctcctcattggtcaacgaaatgagctttggccacttaatgccttgggagtcatttgctaagggcacctggaatgagcttgagtgggtggtacagaaagaagggaggtgttaaaactgccacaaagataatgctcaacagcaacctgaaacggaatggaaaccctactgtaactgatggatttggggaaggctcaaaagctttgccacttcatagaggacatttaacagaaatattttattcaaacccaaataacgaccgtaaggaaacaaatgatttttcaaagtccaccatcctagaaccagatagatgcccattacatttgtacagctacatgcagagataaaaaacaataatgcccaccttgtctaggctgttgggattaaataaataaatatacgtaaagtgtttagaaaagctcctggcatatagaaagtactcaaaaagtgttactaggatttcttagaaatgttatatttttagcaagtgttgctttttccccttctcattatatctggggtaggtaactttggttaagtaccctgtgtctaaaagactgtcaacaatcatgtttatgatgatcagtctgggagaaaaaaaataggaaaaaattacacatgaaccaaaccctcaccttattttactttatcagtttggagctagaaattgatttactcataagaagtggagacaagtagaagaggcatagaatgaaagagaagcaggcagtacagcaggatttatggtaataaaaccatctgtacacaacaacagatcaggaggacctgaggcacttaagctgagtaaatacactccttttcaggcagttatgggatggaacctcatcgaaagtctctctggaggctgagtttgtcagttcaggcaattgggaggttagaggaaaagggagctgaagttgcctggaggaggtcctgaaagcaatgtgacttctgtgtcctctgcatcaggattaaagtgagctctgcagcacatcaagagaggaaggagaaactaactcctcctaaaacaaaaatttcaaaaaaatgtggtccccagttttccctgagtcatcactgtatcattgttaagcttattcagttaaaccttagtaactggaaggagccagagttggaagtaaaaagaccagaatgggccgggtgtggtggctcatgcctgtcatcccagcactttgggaggcggaggcgggtggatcacttgaggtcagaagttcgagactcgggcgtggtggtgggctcctgtaatcccaactactcggaaggctgaggcatgagaatcgctagaacctgggaggcggaggttgcagtgagccaagatggcgccactgcactccagcctgggcaacacagtgagactccgtctcgaaaaacaaacaaacaaaaacggccagaatgacgacaagaacattttcaatctattcatctacgcatatattttttaaaaagacagttttattactcctagatagaataatagctatcgacagtgactataaattatcaacaagttaacatagggtcaaaatccaaaacaagtctaagattataactatgttaaatattatataaaactaaatcgctatgttctggctgaaggaactctgaagcagtcagttactaaggcagtgttttcaaaatctactgatttcagacaaatttaaattcctctcgactacaaatgggactcagaaagtctgtttttctataagagtaatttagtatattatataagaaaaagttctggcatgttttaagcattagagagtattctgagattgaggtttggtgtgagtgtgtgcacgtgtgctcctataccaaatgctaccaaaaaataacttaggcaaaaacataggaaataaaccatctcaggatgatgaattttaagactaagggggtaaggagagagcaatttttcactgaatacctgaaaacaacaattacaattatgggctgccctaaataaaaaatgagcaaatttttcctgccttggctttgaacaaagttaatttaaaaaatacatgcacataaacatactagttttaacaaactcaaaaaatatagaaaagtacacagaaaaagcaagtcaccccttctactgatagtaaaagtggctcctactacacagccctctgtataggcacgtgtgcatcacagtagaaaagtcatgccacatgagccatgtggcatgttctttttttttttttttttttttttgagacagagttttgctcttattacccaggctggagtgcagtggcgcgatcttggctcaccgcaacctccgcctcctgggttcaagcgattctcctgcctcagcctcccgagtagctgggattacagccatgcgccaccacgcccggataattttgtatttttagtagagacggggtttcaccatgttggtcaggctggtcttgaactcccgacctcaggtgatccacctgcctcagcctcccaaagtgctgggattataggcctgagccaccacacccggtcacattaacttctgtatagctctggcttgcaacaagcttaaatcatccctggaggagtgatcctttgtcttttacaaagcatctttgatttagagtagagtgacagcaggcagttctgaggtctgaggctgtggagaaaaggaaaaaaaagtacagacgcaaaacagaagcctgggatgagataagctctgaggtagatttggaaaaaggggtaagaaacaggactcaggtccaggagaggaagaaatggagcatagtaagacatgattatgtggcctatttcagataggatctattaaggccactgtggcatcctggtaagagagttattattattagttattactttcttatttttagagacaggtcttgctatgttacccaggctggtctcgaaatgctaggctcaagtgatctgcctgccttggcctctcaaaatgctgagattagacatgaacccccatgcccagcctactttttagtttaattatctaaaagctaagatatagccaatgcaaagattatgtgtgtatttgcttttgtatatagtagtagcatatcattttccacaagtatatttgacactatttagaatttcaagcctttgctgaaactgtttattgtattaacacatgactaaagcataaaagaaattgcacatatgtgtgcgcatagacattcagatggtagccttcacctgaaaaggtgtcaaacactgataatgaaatcacataactgtattggtggtatcagcaataatagttggctaagaagctaattaaccagtattgaaaaacagatgaagtataaagcagtatccacaagcctatatgattaaagcaccatagtattttctttcggttaatttgtctattatcctattatagcatcaacagtcacagagaaggaagaattaaacaatggacattgtcatatctgaaatgagtgttccttatctggacattaggaaggatctgtgggctgtccttttaaaatttaaaatggtaggctggatacagtggctcatgcctataatcccagcactttgggaggccaggacaggaggattgcttgagcccaggagttcaggaccagcctggggaacatagtgagaccccatctctacaaataataaaaaaattagcagggcatggtgacatatgcctgtggtcccagctactcgggaaaattgcttgtttgagcctgggaggttgaggctgcagtgagccatgactgcatcactgcattccagactggatgacagagtgagatcctgtctcaaaaataaataaataaataaataaatatataaatataaataaaatggtaccttctcaattggcatccttggtttatttactcatttttgttttgtgatagagtctagctatgttgctcaggctggtctagaactcctgggctcaagcgatcctcctccctcagcctcctaagtagctgggactacagctgcaccattgtgcccagaggtacaactgttttaaagattaaaattattcatcacatccacctgtaataaaataactatagctaactcctacatacagcccttgtccttcaccaggcactgttctaagtgtttcgcatatattaacacaggcaacccccatacataggttgaggcaggtactagtatcatctccatttttttttttttttttttgagacggagtcttattcttgttgcccaggctggaatgcaattctgtgatctcagctcactgcgacctccacctctcaggttcaagtgattctcctgcctcagcctcctgagtagctgggattacaggtgtccgccaccatgcctgactaatttttgtattttcagtagaaacagggtttcactacgttggtcaggctggtctcgaactcctgacctcaggtgatccatctgcctcggcctcccaaagtgttaggattacagccgtgagccacgcgctcagcctcatctccattttatagatgagaaaacaagaaataaagtaattggtccaagaccaacagccagcaaataagtagtggagtgaggattcaaacccaggcattctggctcttagagatcacactttaccgcctcaagctaagtagataatcttctttctttcctcctaattagctacctctctacctacctacccatgtttcaccttgctgctctgtcagcctgccagggacaggaacttctgtactaacccagaaaaactttggaactttgagatggcatctttggagctaagtaggaaaccctttaatgttcaatgaatgaaaccataagttaagaaagccacaaaatctaatttgaatctaaagagaattctctttgcattttctctctaagcccttcctctacccgaggcagcactcttcattaattcttagaaacctgctagattttatggcgatccctttctgtctgtccctctaacacagcaaaatgtagcatctgataagctaagtaattattagtatttacctaatagattctgtggtagttttaacagacttcttaatcttaaaaagagaaagttcagaatacatattgaatgctggtggagagaagacacctattaccaagtcacatatcatgtgtaacattatagccctttcttccacttgtgctaaggaaaagccagctacattgtcataatatgaaaagtagatatatttcctcctgagccaggaggaacaaggcagtcaggttaacaagggctcaggaagtgtgtggttttgccaagtattttgtgagttttactctttaataatcaaatgatattttaataatttcctcaaaattgccacaaaaatcccctaacattctggatttatcaagtactatgctcttccatttcaactggtgtttaagtagcactttctataatatcccgagatgtactcaagccctggggaagtgcagtcaaagacctggatcatatgttgtttctttcttttttttttttttgagatggagtctcactctgtcacccaggctggagtgcagcggcgtgaccttggctcactgtaacatctgcctcccaggttcaagcaattctcctgcctcagcctccagagtagctgggactacaggtgaatgtcaccattccctgctaatttttgtattattattattattattattattattattattattattatttttatttttatttttgagatgtactcaagccctggggaagtgcagtcaaagacctggatcatgatgtggctttttttttttttgacggagtctcgctctgttgcccaggctagagtgcagtggcatgatctcagctcactgcaacctctgcctcccaggttcaagcaattctcctgcttcagcctctagagtaaccgggattacaggtgtgcgccaccatgcccagctaatttttatatttttggtagagacagggttttgccatgttggccaggctggtcttaaactcctgacctcaagcgatccgcccgccttggtcttccaaagtgttgggattacaggcgtgagcctccgcatccagcctttttgtatttttaatagagatggagtttcgccatgttggccacgctggtctcgaactcctgacctcaggcgatccaccggcctcaacctcccaaagtacttgtgattacaggcatgtgccactgcgcccggccatgatgtggtttctattaaattacaggtgtgagccaccgtacctggccatgatgtgatttctattaactgggagctaataatcctcttggagagatcattaaatgtctgataattacaacatatagaatacacagaaatggaacagcatgtgctatccagacaatgggagccaccacaatcaggtgaagagtattgctaagacagatcagagtccatggggaaagcttcctggaggaggtataactagcctgcattcccttttttatcttatttttttaattttttgagacagggtctcactgtgtcacccaagctggagcacagtggcgcgatctcagctcactacaacctccgcctccccggttcaagccattttcccacctcagcctcccaagtagctgggactacatgttcatgctaccacacccggctaatttttgtatttttagtagaggtggggtttcaccatgttggccaggctcgtcttgaactcctgacctcaggtaatccacctgcctctgctttccaaagtgccgggattacaggtgtaagcacctggcctagcctgcattcttatttacaattgcatcaggttacaaacagaggcaatcacaaaatcctacacttcaaaatatgtattctctgtatttgtttactttgtgatttaaaaagtaaaacacctctttcctgaagaatgttccttatttcaagaattgagtattcctaaaattggaataaaccttagacatattttataatcagccaagaaacggaaatttttcaggagcttgataagctagcaagtaactaaatgagttatgtggagtctaaaaatctttgaaaatttttcttcttaagaccttgtggttcagttcttatttaagcctagttacctgttcaacatattattttaccactttgaaaagggagctcttattttttgaaaaataaaagtagatattctaaagaaatttgaaagcaatatggaaataattgaaatcattcgaaaaaaatcaaacactaaaactttagctgcgatggatctataaatactggttacgctattaatgattacaggtgaaattagaaacacgagaacatctttaaaaggtcaactccaaggctgatcagtttagacgggatgctaaaattagcgaggagtataagctcaggaaaaagaacaacataaaatgctagtgaagcaaatcgtttcgacacaatgagcctgattttccatgagcaaatggtaacttggcaaggcattcaattttgaattggttgcaagagtcactcaatcgttcaacaatggctattgatcctactatgcgtggctttgttctagaccccgaagattggatggtgacaggcagaggagtccctgaagaacagaacaacaagaaaggggcggggtagcggaagcagagggagcgagacaggcaggggtcagatgggagcgttataacacccaggagaggacttcaagttctccttggctgattggaggattctgagcagagaagcgctgtgatctgcttttctgttttttaagatcactggtgtgcagccgggtgcattggctcacgccggtaatcccagctactcgggaagctgagacaggagaattgcttgaacccgggagtcagaggttgcagtgagctgagattgtgccactggactccagcctgggtgacagagcaagactccatctcaaaagaacaaaaatacaatacaatacagtacaatacaatacactatcattttttaatcaaccaataaaattagctaaaatacttaatagtgattaagtgtcacacttcagtaaaacaagtatgaaagcatcaaaacccttctaaaaaagaaattgcatagtgtatttgaagagcctggaaatgtttattctttttacttagcaatgatgttattataaatctatccttaagaaataagaaaaaaagcatgtttacatccaaagatatttatctcagaattctttataatacattgagaaacaatccttataggaatggttaaataaatggtgacacaccagccactaaaaattacatttatgaagaatttaatgtcatgagtaaaggttcacaatatgtgagcttaagaaaaaagagagtagagaaaactttatgtagggtacaatttctactgatattatagtaatcaaatgtagaaaaatataacaaaatattgacagtggtcgtctctggagagtaagaatatgaatatgggtgattaaaatacatatgtaacacatgtatgttaaatatctgtaacatatatgactttgatcagcaaaattttaatgatttgataaaacgaacctatttgttctgtccctcattctctccatttcgacccatcattacattctgccaattcctttcttttcctttcttcctgatttagttcagcactaaccatgcacaacctcccacccccacccattgggtttcctagctgacacctttccctgctaaccatcctgaaagcagtaggatgaaccattttccttaggtatggttgggatcatgttactcccatgaagggaatttgaggtgatccttggtcatccataacattgcaggcttttgatcatgagctgcaaatctctggttaacttatgatgacaaatcactgcataatttccctttgttcccttcaacctcaacagatacacagctacacacaaaatctccaagactaccttccttccttctctatctaccagattcttattttcctttgtaactctcttctagaatcaccttcctccaaaaggattttttttatccaggtatctatctttctcaacacaactttactcactgccacaccacttcagcatttcttcttttctagatatttggcaattgtgtatttgtcatttgggatcaaatttgattcctgtttcatcacaacattgcctaaacagcaatgcttctgattctacatttgaaaattaaagcttatacacaaagtttaagattgtctctttttttttgtttgttttctttttcttttttgtttttgttaagactgtctcttgtaaaaaatgtttgcacagttgtcatatgtttgcatgacaagctgatcatggttccttacaaagtatacccaaggtatttgctctcaaccttttctcaccacccagtgcacacacacagaaattcactaacatgggtgctcaataattgttattgacaagaattccaaacagttggtcaaatgactttttacttacaacatggagccataagtcataagataatttaatttatgaagaatcaatatgaaataaagacttaaagctcaatcttgttacctgtttggtgaacaactctggaaagtcaggataaaggaaagccaagtcgacagctgctttatctaagcagtaagaatatgcagatgggaccctcttctgttctcctaccatgtttgttccaggattccaatttgaaatctgtatgtgccccttgacacctcaatgctttgtcaagcacctcatttctctggctttagttttatagacaaagaaaccaaatacatggtgatggagcagcttatcacagtatgtttttagaaacaccaatgctaaaattaccagtccccaagtgtcaggtgaaattactataagaattaagtgagaattactttgatctaaagtattaatgaaaatggtagtgtcagtcatgattctggataattactcaaatagacaattttaaaaattgggacaacacattaatatgagaatatactgttataaagagaaaataggccgggtagggtggctcactcatgtaatcctagcattttgggaggctgaggtgggcggattgcttgagtccaggagtttgagaccagcctgggcaacatggcaaaaggccatctgtgtaaaaaaaaaaaaaaaaatacaaacattagctaggcatggtggcatgcgcctgtagtcccaactacttgggggtgtgaggtgggagaactgcttgagcccggaagctccaactgtagtgagccatatttggaccactgcattctagcttggacaacagagcaaaaccctgtttcaaaaaaaaaaaaaaaaaaaaaaaaaaaagagcttagtgtgaagagtttagaaactaaatacagtagctaaggaagaaactgattatttatctgaatttcaaattgaactaaacattggtcccaatcactcttcctttttccaagaactgagcattaaatggaattttaaaacatttattaaaacaaaatcaaagacaaactacaattaggagtgtgtcattaaagagccaatttccttaatatgccagagtgcttccgtatcaacaaaaaaatacaacacaatacatacgagcaaagatatcagcaggcagtttgcagaaaaacaagattctatgatgaataaacatgaaaatagttcaactctattcaaatcaaactttgtctgattaaaatagatagaaatcgaaacagtgagtcctactatatcagcaaaaatttttaaatttgggctgggtgtggtggctcatgcctgtaatcccagtactttaggaggccaaagtgggtgatgacttgaggtcaggagttcgagaccagactggtcaatatggtgaaaccccatcacagatttaaatggaagttgtaaaatcttacccccagtagaggatctttagaggaaatggggtgagggttgggtagagggcacatggattgagcaaccttgactgtgattcccataaatttagaagttcaggcaggaggacttcccccatgtaactatgattcaacagagcacacatcctgtttaataacaaaggcatttatgcaacattcattctatgtctctgggtaatttatatgttgcttgatcttggtaatgtgcaaacatttttagccagttcttaactgtcaggtgatctctgattgttgctgttttctatagttgttgtctagacactcacaaggattcaggtttattttggatcctaaagtcaaggccagtatttctttaagacttacttaaactggaagagtcctaagatttcagtagccacaaaaaattattctctgtgctcccccaagagggacagacacaatgagcaaccttaggatggtcaagggtcatctgttagctcttttagactcagtggagccttcatggggattggcagatggaaccgaaagcaacaaaaaagaccccaaaggaattggcatcttgggaactcagatttcctcaaggactcctccatctgatgatgttggtaatttcagctctacatcatcatttcttttcttttctttttttaaagatggagtctcactcggtcgcccaggctggagtgcagtggcgcgatctcggctcactgcaaactccacctcccaggttcaagtgattttcctgcctcctgagtagctgggtctacaggtgtgcacaaccatgcccagctaatttttgtattttttagtagagacagggtttcacctggttagtcaggctggtcttgaactcctgacctcaagtgatccacccaccttggcctcccaaattgttgggataacaggcgtcagcccccatgcttggcctcatcatttctttttttatcaaaaaccagacagtcaactaggcacccctctgtgctcacctttcacgtcctggcataacacttcgtaagcatagctacacaaagaataagaatggcaagccccaagtatgaagagataaatcaaatttaattgttattaatatattattgattattcacactaaatttagtcttccaaaaaaataaatctacttggataaaattcatgttgatggatagaccaaagaaagctggttatcaatttatatgctaatgaatttttcttacttttcccctatgtatagcctagtattttgtaatttctctgcacctacagggccagaggagggaaaaaaacggaacgcacatcctttctgttctttagtgaagcttttgatgaaagggattaataagagttaggggtgagggaaagaaagaaagagagagagaggctgggcacggtggctcacacctgtaatcccagcactctgggaggccaaggcaggtggatcacctgagatcaggagttcaagaccagcctggccaacatggtgaaacccagcctctactacaaaattagccagtgtagtggtgcgcacctgtaatcgccactactcaggaggctgaggcacaagaatcacttgaacccgggaggcagaggctgcagtgagcagaggttgcagtgagccgagattgtacaactgcactccagcctaggtgacagagcgagactctgtctcaaaagaaaaaaaaaagggtgggggggaagggggagaacttgagacgctataaaatgaaaattagaacttttcagtgcgcaccattttcataatttatggtacttccaccccaagcatgcctcaaatttgtttaggaaaatattttcttctcataccttcatttgttctcatatcatcattgtaatatgggtggatgatcaaataagcaaggccggcaattggtctgagaaaagagctcatttggaaataacatcctgagctttgcaaccgcaagtgagaagtgtatctcagcacctggtagcaaatgcaggtgaggtccaccctggtagtacatacaggagagttcatagatggttggcaaagaggtacaaactaatggaaacacaacaacaagctctgtagctactttacatggagttgactcagcaaaggcccatctgacctaacaacaacaaccagattagaatagttaatctttattgaacagttgttaccaccagttctgggtgcttcacatatgctatttcatttaatcctcacgacaatcctatgaggtactaattatctttctgctattttgcagatgtggagactgaggcttacaaagattaaataagtgttcaaagtctcacaactattaggtggcagatgtagaactcatatccaggttcccaaaccccagagcccaagtttttgccccagaatcacaatgctatatggactgcaccataatgaaacagctgtgtcaactgtactctgtatgcccccctcatgtattcagttgccctgtaactctgtccccaaaggagaaagtttgcatgccctgactgtttcagcattggtcactcatactcacaaactgtcctgtaaaatggagcttgggggaatggagataacagttaaaatacagtaaacaatctaagctttcagtttaagaagccagaaaaaagaagggcaaaataaatctgaaacagattaaggaaggaaataataatgatttaggtgggaataaagcaaatacggactataaaaacaaaataaaagttaataaaaccaaaagttggttctttgaaaagagcaacaacattgacaaaccactagctagaatgacaaagaaatgaaaagactcaacttactaaactcagggataagagaagtgacaacactactgaccttctagaaataaaaaggatagcaaagaaatactatgaacaattatatgccagcaaattagataacctacatgtagaggagaaattcctagaaagatgcaaagggccaaaatagactcaagaagaaatagaatatctgaatagacttataagtaaatacactgaatttgtaacataaaaattttccacaaagaaaagcccaagaacagatgacttctctggaggattctatcaaatgttttaaagtctaattaccaccaatccttcacaaattcttccaaaaaacagaagggactagaacacttcccactgaggccagtattacatgcatagaaaatacagacaaagttatcagaaaatgacaaatcaatatgtcttatgcatatggactttttaaaaatacacaactaaatactaataaactgaattcagcaacatgaccaagtctgatttaacccagaaatgcaagatagcttaacagatgaaaatcaatcagtgcaatacaccatatcaacaaaagacaaaaactatacacagtaatctgaatagctgccagaaaagcatttgatacaatgcaccaacccttcataactaaaacacaacatattaaagcagaagggaacttcttcaatctgataaataacatctacaaaaaacccatgactaatacacttaatgtgaaaaagactgaatgctctccccatgaagaacagcaacaaggatttgcactctctcaacttctatatgcaacattgtacttgtttctagccaggataaatagaaaaaaaggaaaaagaaaaaaaaagaaagaaaggggatccatatgggaaaggaagaaataaaactctgttcatagatgacgtagtcaattacatgtaaaaaacctaaggaatccattaaaaaattattagaactaataatcaagttcaacaaggttgcaggacataaaagcaatatagaaaaatcaattataaatttctatctactagcaatgaacaaactaaaatataaaattaacaaagcaatttcatctacaatagcatcaaaaataatacaagtgttaaaactacaaaacattgttcaaagaaatcaaagatctaggccatctattaaaaatacaaaaattagccgggcgtggtggcgcctggccgagacataagaatcacttgaacccgggaggcggaggttgcagtgaggagagatcgcgccactgcactccagcctgacaagtgagactctgtctcaaaaaaaaaagagagaaaaaaaatctaaataaatggaaagacactgcttgttcatgaatagaagactgaacgctgctaaaatgacaatactcctcgatctgatctacagagtcaacacaatattcccatcaaaatctcagctagtttctgggaaaaaaaattgataaatggatactaaaattcctacagaaattcaaggggcccagaatagccaaaacaaacttgaaaaagaagaacaaagctcaaggactcacccttccaggtttcaaaatttactacaaagctacagtaaacgagacagtgtatagggtgcagaaatcttaggggaaaaccataaggtgcggggagggtgggcagcgtggtactggcataaggatggccataggacaatagattcgaaatgagagttcagggaaaaaacccaaaacatgtatctgtggtcaatcgattccggacaagggtgccaagactatttgatgggaatagtcttttgaagaaattatgctttaataactggatacgcacaatgcaaaagaatagagttggacccctaattcatatcatatacaaaaattaaatcattatagatcaaccacctcataagagctaaaactgtaaaactcttggaagaaaacatgggtataaatcttcatgaccttagctcaggtaggcagcagccttttagatatgatacctttcaaatatgataaacacagcaataaaagaaaaaataatgaaattgtcctttgtcaaaatgggaagctttatttctcaaaggacaccattaagaaaggaaagacaacttacaaaatgagagaaaatatttgcagatgtatatttgataatagccttgtatctagaatatataaagaactcctacaactcaataatgaataagacaaataacccaacttaaagataggtaaagagtctgaacagacatttctctaaagctacacacactctttggtctcagctgcagaagccaaatgacaaagagaacgtcatcgtctggaaagcatcgcaataagatgcacacgatgtgccaccgctgtggctctgaagcctaccaccttcagaagtcaacctgtggcaaatgtggctacattgccaagtgcaagagaaagtgtaactgaagtatcaaggctaaaagttgaaacaccaccaggactgatcatatggggcgcctaaaaattgcacactgcagattcaggcatggattctgtgaaagaacaacacataaacccaagaaggcagctattgcaacatccagcttatctcacgaatttcagtgattagtcatgccataaaggttctggtttaaaacctgaactgaaaaaaggctaggcacggtggctcacgcctgtaatcccagcactttgggaggcagagataggcagatcacttgagctcaggagttcgagaccagcctgggcaacatggcgaaacctcatctctatgaaaaatacaaaaacatagccaggcctgggggtatgcgcctgtagtcccagctacttcggaggctgaggtgggagaatcacttgagcccccgaggttgaggctgcagtgattgtgccactgcactccagcctgggtgacagagcgagaccctgtgtccaaaaaaaagtaaagaaaagaaaaaaataatgaagtcacactttgcgagagtgggagaagtatggcagatgctgccacttattaccctccacttcagaagggcacatttcaaaggctcccatgacacctctcctgttccgatcattgtttccaaggaacaaagctcaggcatgcacctgtggatgccatgatgtccatgttccatgttctccactaatttcacttcagactagaaccttatcactaaaaacctcaccatgcagaattatcttacagagaagtttccttatgacacaatttttatgtcccaatggctgcctggctttgtgtcccagctctttgttctcacagtgaatagctttccaagaaaatgcttccctggtccctgttcactcagcactcccatcatgacctgtgtgtgtgtgtgtgtgtgtacgcgcacacacgagtgtgcagtgtgatgaggatgggaatcagggggctggagcattgcttaactgagcaatgcataattagcctcccttcccagcctcagcaggcagcaactcccctgcatcttccccttctgcttcccctcctccatcaccctcattatctcaatgttgctttccaatattcccaagcaaccaagctaaacaaagcaaacattaagcaaagaagacagaaagaaaacaggctttggagtgtggcacagagaagctcaaaaactagccctgtcattttccacttaggaaccccaggcaagcctacgatgtcaactttgtcaaatgaagatcacataatacccaatttcaagatatatttataggattccccctatgagctgggtgccgaggttacaacctgaatgacacatgtagactgtcattgaaaaactcatagtgtagtaggagatatagaaatgcaaacaaattccaatgcagtgtgataaaggccatgacaggtggcattaaggaggcaggagggattaattctcttcatggttgaggaggaggaagaaggcattctggggtggatgtaagacttcagtaagacaatgtgtccacagaacacttggcacacggtaagtgctcaaagaatgtgaaattctttcttcacaaagagccctaggaatgcagaaaataaaatttatatgttttggcctggcgcagtggctcacacctgtaatcacagcactttgggaggccaaggcagacagatcacctgaggtcaggagttcaagaccagcctggccaacatggtgaaaccctgtctctaccaaatgtacaaaaattagccaggcgtggtggtgggcacatgtaatcccagctacttgggaggctgaggcagaactgcttgaacctgggaggcggaggttgcagtggctggcactgcactccagcctgggtgacagagtgagaccctgtctcaaaaaaaaaaaaaaaaaattagatgggcatggtgatgcatgcctgtaatcccagctactccggaggttgaggcacgagagttgcttgaacccgggaggcagaggttgcagtgagccaagatcgcaccactgcactccagcctgggcaacagagtgagaccctgtctcaaaaataaaggatattaattataataaatttattgtataacaaactaatgttgatgtcttagggttaatactgtgaatttcaactgataattctaactttgccaaagaacaatggtcagaaatccttgattcttccttcaatggacacatatttattgacccccttttatgtgataccgggtaacagagacacaaaattgaacttacaacaagtttacagatgactcgaaaagacaaaacaagttctcaataattataatacacggcagaatggcatgttgcatttatcccccacctccccagtcactgcttcagaggttttcttactcttgaaataaagcagtgagataatgttaacatgagtcccttctgatcagacctttcctgcacttctatgctaatttctaggactagatatttagaaatggcttccccttggtgaaaacaagaaatgataaagtttgtcagtagagacaagtcaaatacttagtgtcctcagagcaatatcttgctaaatctaccacttaatgagtggctcagctgtacagagataatccggagagtcagtaatctgtgggagggcaaggaacaaggtgtcattcagctttgggggcaactgagtctgtgggataggatgtggagattcctaaatcagagatcaacaaagcaccgcattgagacgagggctctcaggtgtagcccatatgtgctttctcctgtgcactcaccttcccaagtctaccaataacagacccctccaagccccagaagccagggacaggtacaggtgtggtaccatgagggtgaatcagagtcctttgggggaatttctcatcctgcagataagactgctataggttttcctcaggaatggtagaaaataaaaccaacacagaaaacatatagagaaaaacagtcctgatgaccaaagcatgtcatgctgcatgctttggaatttccagttaggtaaatatatatgtataaatataatctgatgcattcatttgtcgattgattccttaagctatttttaaaattttctttatttttagagatgggagtctcactatgttgcctaggctagtctcgaattccccagctcaagcgatcctcctgcctcagcctcctgagcagctgggactacaggcacgccccaccatgcccagcccttaaactattttggattaggtttctattacttgcagccaaaagttctgaattaacaaagggcctcaccctggctcttccttggtatatattactatggggatgggatgaccgaggtcccatagaaatctcaactgatccattcttcccatctatttttccaggtctcatgaaaagttgccattttccctcctcaatttgttccctaaaattttactcagccaggcatggtggctcacatctgtaatccccttgggagcctgaggcaggtggatcacttgaggccaggagttggagaacagcttggccaacatggtgaaaccccatctctgttaaaaatacaaaaattagccaggtgtggtggcaggtgtctgtggtcccagctacttgggaggcagatgcaggagaatctcttgaacccatgaggcagaggttgcagcgagccaagatcacaccactgcactccagcctgggtgacaagagtgaaatttcatctcaaaaaagaaaaaaaaaaagtttaggttatgactcgttccctgtactgaaaaggacatttaataatttctacagagtttttgggataacagaagagtggtgctaatctaacatttctttgaagaggcatgctagcactcagactgaaaattgacaaagcacattgtaatcaaagaaggctcctcctggaggttccttatttataacttctgaaaagtggtcacattgtgcgcgctctctctctctctctttcctctgtagtagaagctaacagaataccctcacgttcgtggagagaacctttttcactgattatagctgattgccgcttacatgctgccctgaaaagctctcttgcctgtcgatctcttgtctgtgcctaatgtcctgacagtgttaactgagatggctcaaaggactaagaaacaattgatcatccccatctttctattcccttttatttcatctgccttctcctgctttcctctgagaaaaaaggcagagagaagaaacaagagtaaagaacaaaacccacaaggaggcaacttgcacaggaaactgtggaaaatccataagactttttgactagggttgaatcagatcagcacctgtgttgtgtgggttatgcagtggctcactcacaaatcaaggcaaggctaccagcaggagtgatagcttccaaactgtcacttggtctaaactattctgtatcttggctggagaacttaaacacacacacacacacacacacacacacacacacaaagagagaaaaacctagaatctttgtagggtcctgggccgcaatagtttttaaaagcaccctctaacaccaccccagccaggtgagtctaatgtgtagccaaggctggaaaaaaaaaatcacttgtctatgcagacattcacataaactctttatccaaccattgcaattgttcagccaattttggctataacccaaatagctaccaaccaaaatggctacctaggctactctgtttcctctctaccagcagacaaccacagcgatcactgttcgaagtttacagtgtgtcaggccgtactaagcacattacatgcgtaatctctaatctttacagccaccctggattggaaagtagtaccattcctgcttttagcataagaaacagaaaaatgtccaggcacagtggctcacgtctgtaatcccagcactttgggaggcaaaggtgggtggatcacctgaggtcaggagttcgagactagcctgaccaacatggtgaaaccccatctctactaaaaatacaaaaattagccaggcgtggtggcacatgccctataatcccagctactcaggaggctgaggcaggagaatcacttgaacctgggaggcggaggttgcggtgagccaagatcacgccactgcactctagcccaggcaacaagagcaaaactccatctcaaaaaaaaaaaaaaaagaaagaaagaaagaaagaaatggaaaaatggagctgttaaagaatttgcccaagacaaggtacagcaattaaatggcacagcaagatctgaatcccagctggccttaactcccaagttcgacccctctccactacaaagatggtccctcacttcggtgtgtctttacttctggctttacttttttcctgcttttgacaaaatccaaagtactttcagttcatatccttctaatatcctgccatgtgtacaaatatatgactatttaaaaacaagcaaagggccgggcatggtggctcaagcctgtaatcccagcactttgagaggccaaggtggagggtcgcttgagcccagaagttcgagaccagcctgggcaacatagtgggacccccttctcttcaaaaaattaaaaatgagttgagcgtggtagtgtgtggtctgtagttccagctactcgggaggctgaggatggaggatggcttgagtccaggaagtcaaggctgcactgcagcctgggcaacagggtgagatcctatctcaaataaaataattttttaaaaaattttaaataaataaataaaaataaaaactagcaaaacccagagaaatacttataaattcaaagtaagcctccctggccaggcacactggctcttgcttgcagtcccagtactttaggaggctgaggcagaaggatagcttgaacccaggagttcaaaaccagcctgggcaacatagggagaccctgtctctacagcaaattaaaaaaaaaaaaaaattagtcaggtgtggtggcacatgtctatggttccagctacttggaaggctgaggcaggaggatcacttgagcctgggagcctggcaggtcaaggtttcagggggccatgatcacaccactgccctccagcctggatgacagagcaagactctatctcaaaaccaaaaccaaaaccaaagtaagcctcctttattttgcaaataaaatgtaagtgcttgttttatatatatatatatatatatatatgtttatctaattccagaaagcagagacaaatgttgagcgctgttagcagaccaacttcaaaattctaatgcccatttttaaaatgatcgtacttcactgaacaagctggttctgcttagtttgatgaatacacaattggtttgggccatataaccaaaggtgagccttccagtaatgcacaccccagaatactggttacctaaaattgatgcttttttaaattccctttcctgaagatacttatattactggtaaatttaggaattcctcttgggaattcttgaaaagcaaattatactacagcattctattaaaaattgttaagtattggccttggccaggcatggtggctcacgcctgtaatccctgcggggggatcacctgaggtcaggaggttgagaccagcctggccaacatggggaaacccgtctctactaaaaagacaaaaattagcctggcatggtggtgcttgtctgaagtcccaactacttgggaggctaaggcacgagaatccacccagaaggtggaggttgcagtgagccaatattgcgccattgcactccagcctgggcaacagagagactccatctcaaaaaaaaaaaaaaaaaaaaaaattgttaagtatgacaattgatgtacgatgtgctagcttttgattgcaagaaggtataaggcatttatacatagcgtctgaaaatacaagttttcacttctaacacaatgtataaatgtgactgtgatttggtgcctttataaactggaggtgttacagcctgaccaacacggagcaaccccgtctctactaaaaatacaaaattagccgggcacggtggcacatgcctgtaatcccagctacttgggaggctgaggtaggagaatggcttgaacctgggaggcagaggttgcggtgagccaagattacaccattgcactccagcctgggcaacaagagtgaaactccaactcaaaaataaataaataaataaaagaagacttagctgaatggaaaggggagtgatagatggcacaatgtagcaaaaccttaataactaagaaatctgtgtgatgggtatattggaatttgtattttattccctctaaacttcaatatgtttgtaatttttaaaaaacaaaaccaattagtacatacttacatgaagactgcaaaactcagagggctagtcaaagttctcttaaggttttgaaataacattctgtgattgatgtaatagcacccctatttcattaaaagtaggttaggatgtagattttcttttgtaaaattaaggtaaatctaatttcaatttgttattagaattttgttttattttatttatttgtttattttgagatggagtcttgctctgtcgcccaggctggagtgcaatggcacgctctcagctcactgcaacctccgccttccgggttcaagtgattcgcctgcctcagcctcccgagtagctgggattacaggcacacactaccacgtccagctaatctttttatttttagtagagacggggtttcaccgtgttggccaggcttgtcttgaactcctgacctcatgatcctgctgcctcagcctcccaaagtgctgggataacaggcatgaggcaccgcgctcagcctgttattagaatttaaaaaattaagttctatgactccttggaataaattagataaacacaggtcacaattgcaggtcttagaaccattgggttaatcatattatagagtattcactcactcattcactcagtcattcattcaataaatgtgtgcttaatgccgctcttttgcaagatccataataatataattataaccctctataaactttttttagcataaagataacataaatccctaaaacacctttgtatttggggtatcccaaagctactagctgtgcttaaacaattctaacatatctggttgtgacattaaaaaataggccgggcgcagtggctcacgcctgtaatcccaacactgtgggaggccgaggcgggtggatcacctgaggccaggagttcgagaccagcctcgccaacagagtgaaatcccgttctactaaaaatacaaaattagccgggtgtggtggtgcatgcctgtaatcccagctacttaggaggctgaggcaggagaatcacttgaaccctggaggtggaggttgcagtgagccgagatcgtgccactgcactccagcctgggcgacaagggccagacttcgtccccccccaaaaaaaaaagggctggactcagcggctcatgcctgtaatcccagcacttcgggaggccgagatgggcgaaatgcttgaatccaggagtcgagaccagcctgggcaacaaggtgaaaccccatctctacaaaaaatacaaacattagctgggtgtggtggtatgtgcctatagtcccagctattcaggaggctgaggcaggagaatcacctgagcccaggaggtcgaggctgcagtgagccatgactgtgcctgggtgataaagcaagaccctatctccaaatatatatatatataaaaccaacaaaagtttcatctacttgaccctaaacaacttgccttaattttgtacttaatgaattggtcataggtatagccttgcagggataacaacatagtacataaacttctgaattttaccaaatgaattagaaggtagtttaagtcattttaaaaaataatttagcaacttttcttatgctttctcaatacatttaaaacctgattgacttaccagatgttccttaaccacaattttttcagtaacaaatctatcacagaaaacactgaccatggtcgtgacattctttggttttctatcacgtctcttactcaggtttcacttgtttctgaatttcaaattctaaggtttgaaaaaatatctgcaagtcaatatttaaactggccactggcaatgattatgttcttcattaagttcctcaatgttaaaaaaaaaaacaaaacagcaatataaaacaagcgatcccgggtgactgaagttttaactcagagtccaaatgctgcatagaagagcagctgctggcttcatttatcgtgacgagtaaaataaaacataggaaaacagtcgcagttttaatttaagcataatctaaacttcaacttgatccttgcaatgtagcatcataccttatggagaaacatgaagacaaaggttgtaataaaatttggatgataaaaaaagttggatgacaaagaagatgtggaaagcagaaagaggattggtatgcaaaacccatttaggttctgctgctcacagttctaacctcagagggtggagagatacacagcccatacttcacatagtcagatgctgaaaacaagcatctaggccagtgccatccaacagagctttctgtaatgatggaaacactctgcgtctgcaccgtctaatacaaaagccactgatacgcatgtgccacaaagtccttggcatgtgtgtagtgcaaacaaggaattatttcatttaattttaaacaaatttaaataactgcactgcatgcagctatgggctaccatattggacaacacatgtctgtgttcacagggtagctcctggacagaagaatgagagatttggggcagagttagatcagtaagtcttagaaatgctgcacccactctggtggagaagctaatctaactaatgccttttccattgcaatggtgagcagaagcttccaatacactttaatacactattagaaatgtgtgatcaacttttctcaagagtcaacagatgctcagataagagtgaaataaagctcagaaactcagaaaatagtggccctattttcagtcttttagttcttcttctccagaggcagaattccctttctgatgctgacattaattacccactcaacaccaccacaagccccacagcgaggccctcaaatgcacacatcttcttccacctgtctcctgcttggcctgcttgaaggtttccatccatgtagacttgaacactaacatggtctagaacctccatacaagccagtcagctcaatagaatgaatttacagaggccaagcttgagcattttgtaactgtttctgacatatgtctaaagcaggttggactgcctcacttcttggatgagaagggtgggtacgtcacattggacaaatcacctgttatattgttttcatgttgacacatttcccacagcaaatttgtttgatgtgtccttgttattctgttcaaaaaatggagtccagaacgtcatttgatgaatatagcctggtctgaattgaagggaagtcaagcatgaaggaggaagtggactgaactccctgaatgctgctgagaaatgcttccccagctaagacagtgtttttcccatctctctggtaaggaggggtgagaagaggtgaggaagagaggccaatgagtgctcgtgaatcagtaagactccaacgacacagaacttgagaacagttgaatttgctgggtgcagtggctcaggcctgtaatcccagcattttgggaagctgaggcaggaagattgcttgagcccaggagttcaagaccagcctgggcaacatggggaaacgccatctttacaaaaaaatttaaaagtcagccaggtgtggtgacatgcacctgtagctccagctattcaggaggttgaggcaggaagatcacttgagcccaggaggttgaggctgcagtgagcagtaatcatattgctgtactccagcctgggttgagagagcaaaaccctgtccgaaaaaaaagacggctgggcgtggtggctcatgcctacgatcccagcactttgggaggccaaggcaggatgattgcttgaggctaggagttcaagaccatcctcgtcaacatagtgtaacattgtacaaccctgtctgtacaaaaaaaaaaaaaaaaaagaatggaaaaagaaaacagttgaatttgttaagcctggacagacagaggacagtgttacatcacagactcagaaacagtgactaaagtctgacatttctatcttccctcctccttcacttcctgtctttgaaacaagcactacaaagacatgaaatcagaacctaaaactgagaagaaagaaaaactgtcacaggagtatgatgagtctgcattaggcaaaggactctcctgacaaggtggcctcaaggtggaaggaggctgggtagatgcttttggaggtgctgatggccattagtaggtggtgggcattgggaagagtaggtgtacttcacatcatggatgaggggattattcatgagaggtgatttgcaggtttgcctctaagggaggacaagagtgaaagaggaggagtgggtaccagcaatgccagtcctggacgttctgaaaagatgcagaggattccagtttgagaagtgctactagcggtgtccactggaaggtcaaaaaggtgaaggtgaagggcagcagagacagtgactgtggttacccctcactgctgcccctcaccttggacagtgtttactgtcattgtcttgtagatttgccagcagaaggcttttaattatttcagttatttttagaaataatatgtattatatgctgcttctcattatataagaaactcatggaaagcatggaagagcctaagaggggggagagaagaatatatgtaaatatattacacacacacacacagacatatacacacacagatacatatatacatacatacacacacacagaggtatggccagagatttcatattaaagacaatagggacgcaaaagaggacacggaaataagcaaaattaacaatgaaattaggctgggcatggtggctcacacctgtaatcccagcactttgggaggctgaggtgggaggatctcttgaattcaggagttcaaggccagcctgggcaacatagtgagacccccgtcttggaaaaaaaagtgaaaaaaaaatttttttaaggaaatggtataccctctcattatgggtgggaattagagtgctcagattcttcagggatggttttctattttgcattctttctttggaacagtattagtagggatactgagttaagcatctttaaggttcttgacatacattgacatgctgttttctgaataaggcatacctatttgtgtggccaccaggcatgtatgaataagctggggtctttcatggaagggaaatggtatctctctgttgtttccttcttttttttttttttttttgagatggagtcttgctgtgtcacccagtctagagtgcagtagtgcaatctcagctcactgaaacctccacctcccaggttcaagaaattctcctgcctcagccttcccagtagctgggattacaggtgcccgccaccacacctgactaatctttttgtatttttagtagaaacggggtttcaccatgctggccaggctgatctcgaactcctgacctcaagtgatccacccgcctcggccctccaaagtgccgggattacaggcttgggtcactgcacccgaccctcattgttgttttaatttgcaggttatttgtgaggttgtaaaccagtatttttcttttgtgaattagactgtttatttctacttccctccccacctcagcttctatgataaggccttgttaatagaaattaaattaaaagaatattggattacttatttgtgctgaaagtcccacccaccaaaaattatcaccatttaatttgtccaccttctattcacattccttattttggtcatggtttttgtagggcctagatataagtcatttgtgagttatctgccaatggcagattctttaccaaagaagtacttggggaggaccaaggactgccaacctctgaagacaaaaaattgttgtttgtattttgtttttcagaataagcacaagattccttaattttcctttaggcaaagataaagatttttatctttaaaagatgctgggctatcagttaggcacggtggcacatgcctgtagtcccagctgctcaggaggctgaggtaagagaattgcttgaggccaggagtttgaggccacagtggctgtaattgcaccactgcattccagactgggtgacaaagcaagatcttgtgtctaaaaagaaaaaaaacaggctgggcactgtggctcacgtctgtaatcccagcactttgggaggctgagatgggtggctgatcacttgaggccaggagttcaagaccagcctggccaacatggtgaaaccccgtctctactaaaaacacacaaattagccaggcatggtggtatgtgcctgtgttcccagctacttgggaagctgaggctggggaatcacttgaacccagtgaggcgagattgtgccatcgcactccagcctgggtgacacagtaagacttcatctaaaaaaaaaaaaaaaagtgtaaaaaaaaaaaagatgctggactaaaatttataagccagcattccctggtatttaatttttctatatccaaatcaacgttatttcctagaatttaaaaacatatatattttggctggacgcggtggctcacacctgtaatcccagcactttgggaggccgaggcgggtagatcacgaggtcaggagttcgagactagcctagccaacatagtgaaactccatctctactaaaaatacaaaaaaaaaaatagctggttatggtggtgtgcgcctgtagtccccagctactcagaaggctgagacacgagaatcacttgaacccaggaagcagacgttgcagtgagccgagaccacaccactgcagcctgggtgacagagcgagagtctgtctcaaaaaaaacaaaacaaaacaaaacaaaacaaaaaacaaaaaaacttacttgtcattttatgcagcaaataaagcccttatcatatgacaagtcaatcttccttgggggttgggtgggcagtgagctgtaaccttcattatatgatctttctctgacctatctactatcaaacaacagcagtgatggtacagacaaattgctctaatactcttactaaaaaatgaaacagtaggtatttattatggctttatagtaagaagccattttattggaaaagcagaataaaagtctttgttttgtttctactccaagtccaggtttgcatttgtgattgacagcaacggtgcttacttaaacaatggctaatttaaatgtttcacaatcctcaagggaaaaaatgccacctgggacaatgttcaatgtcttgaattcactattaagtaagagtccggttccgttcatgtatgcaaatttccctccaaggaatcctgttcaaagggaaggcaaactgagatctcctagacacccatgatgtgccagatactttaatatactgcaaattatctcaattaatcccaacaataaacacccatggttggaatctttgtggaaaaggtaaaagttctatacagagaaagccactgcactgggaagggcagagggctccgctgttgactggctctttcattctgttacacaggacaagaccagcatgaggtcaaccttgtggcaatggcttttgtactcaactggcttccaagttaccttctggctgactcagtgtctctgagaccatcctgagtgccagggacatttgtacctaccttgggtgctagaaaccagttgattctacttcttatgttacctaaatactttgctctttattggaggaaaagaatgattcagatggagccaaacaagcagtggcttgaacgcctctctccaattttccttcaaaaaaatcttggtcaggcgtggtggctcatgcctataatcccagcactttgggaggctgtggcaggcgaatcacttgaggtcaaaagttcgagaccagcctggccaatatggtgaaaccccatctctaccaaaaacacagattctgctctgtcgcccaggctggagtgcagtggtgcgatcttggctcgctgcaacctccagctcccgggttcaagcaattctcctgactcagcctcccgagtagctgggatcaaaggcatgcgccaccacatctgacaaatttgtatatttttagtagagacacggtttcaccatgttggccaggctggtctcgaactcctaacctcaggtgatctgccagtctccgccttccaaagtgctgggattacaggcataagccactacacctggccttaagcacgtccataaactccactttaaaatacatgattattgactcccaggaaacttctcagtaattctcacttgaaattcacctaactttcttatgatgattaaatatttccttatgtatacacactaaaacctgatcttaaaaaaaaattcaaaaattgctaaatgaaagtttttgaatatattaataccatgtgtgtctgaaaataacaagtattcataagcaaaaatttaaaattccagagttacggctgggcgcggtggctcacgcctgtaatcccaacactttgggaggccgaggcggatggatcatgaagtcaggaattcaagaccagcctggccaagatggtgaaaccccgtctctactaaaaatacaaaaattagccgggcgtggtggcgtgcacctgtaatcccagctacttgggaggctgaggcaaggaattacttgaacctgggaggcggaggttgcagtgacccgagatcgcgccacttcattccagcctgggcgacagagtgagactccatctcaaaaaaaaagtccagagcaagtcttatttttaaaacaaaacaaatttgaagggaaaaagagacaaaatgacctaagtaaaaaagtcagatggctggccagctctccaacagaagatagaaaagtctgcaaattagccaggcgtggtggcgcatgcctgtaatcccagctacttgggaggctgaggcaggagaatagcttcaacccgggaggcggaggttgcggtgagccgagatcaccccactgcaccccagcctgggcaacaagagcgaaatcccatctcaaaaagaaaagaaaagtctgcagtacgtaaaacctgagcctcagaaatcggaggtggcggagcctcaacagcgttctggcattgtctttgccaggacgggactgccctctggtgtaactaacaattttcacgttttgttcagcctcactgtaaagtcataaaacttttctgatgcttagtttcctcatgtacaaaacagcagcagtcaccttctagggtaattactgcagttaaacagccaacatagagcacttagcaaatacactcccagaaacagacctctttccttccaccctttcaggtcataatatttccatcccaccttaagatatcacttaactttaaagagctggcacagatagggaatgattttcagctcatatagtcatgtttttaattcctgaaaatgctctgcgttgtggtctgttcttacaaaggaatactatgcagcaacaacaggataaattataactacatgaaactatgtggatgagcgtcaccgataaagggttgagtgagaggccagatacaaaagagtacatactgtctgattccatcttaatgaagtaagaatagccaaaggtaatctatggtgatacaagtcagaatggtggttaccttgggttgaggggataatgggaggagaggcacgacgatactgagatgctgaaaatattttgtgccttaatctgggtggtggttccacaggtacatacacatataaaaattcatcaagctgtgtacctaacagtcgtgcagtttactgcctttatgttatacacttcaatgaatatttaaaataatatgttttcggccaggcgcagtggctcacgcctgtaatcccagcactttggtaggccaaggtgggcggatcacctgaggtcaggagttcgagaccagcctggccaacatggtgaaaccctgtctctactaaaaatacaaaaattagccaggtgtggtggcgcgtgcctgtagcccagctacttgggaggctgaagcaggagaattgcttgaatctgggaagctgaggttgtagtgagccgagattgtgccactgcactccagcctgggcaacagagtgagcctccatctcaaaataaataaataaataaataaataaataataataatatatttttttcaaagtagttatttgatttaatattttctctgaatgataaattcattcactggtgcttcataattgtagacatcacttgtataggatattttccaaataactgaatttactcatgtaagcaaacacactattactttcttgggtaaaaatatttctaaaatgatttgtaccctcactatcattttaaagaggctccaaagcacattcttcttggtgaaccaaggttatccatagaaatttacatgttggtgacctgtattggctcatgcctttaatcccaacagtttgggtggtctaggtgggagaattacttgagcccaggaatttgagaccagtctgggcaacatagtgagaccctgtctctataaaatttttaaaaagtaaagaaactgggccgggcgcggtggcttacgcctgtaatcccagcactttgggaggccaaggcaggtggatcacgaggtcaggagatcgagaccatcctggccaacacggtgaaaccccgtctccactaaaaatacaaaaaaaaaaattctccaggcgtggtggcgggcgcctgtagtcctagctactgcggaggctgaggcagaatggtgtgagcccgggaggcggagcttgcagtgagcggagattgcgccactgcactccagcctgggcgacagagtgagactccgtctcaaaaaaaaaaagtaaagaaactggccaggtgcagtggctcacgcctgtaatcccagcactttgggaggctgagggggggtgggtcacttgaggtcaggagttcaagaccagcttgaccaacatggtaaaaccctgtctctactaaaaatacaaaattagccaggcatgatggcacatgcctgtaatcccagctacttaggaggctgaggaaggagaactgcttgaacctaggaggcggaggctgcaattagccaagatagcgccattgcactccagcctgggcaacaagagtgaaactccatctcaaaaaaaaaaaaaaaaaaaagtaaagaaacttacatggtagagctcagctgagatggggcaatagcttcggggaccattgcttctggattggatggcagcagttttacccctttgttatatgccctatttctcaccattgtctgcctgcctgtaatcatccctgtccttctcatttgtttcctttcattcatttattcatatatctggtacatatttttgaacacgtgggatatgctaagagctagagatacagtagcaagttagacacttgtgatccatgacctaagggaacttaatattttagcaaaagaggcaagcataaaacaaatacaatgtgtattttcagagcaaaattagaggacctcctttaggggacctgggaaggtcaccttgaagaggtgacattcaagaactgtgagatgagaccctatcccagagtgagccattagtaagtactgactgaatgaatgagtccatgtgtgaatgcttgcttgaatggtcatcagccaagtagaaaggagaaaagaaagagtcgtgatttattatgcactgaggaaccagaaatgttattgaaagatgtctaaactaagagtcaatagggggacgggcatgatggctcacacctgtaatcccaacactttgggaggctgagacgggtggatcatttgaggtcaggggtttgagaccagactggccaacatgaaaccctgtctctactgaaaaatacaaagagtcaacaggcactgagtgaggtactaatagaatttatggcattaattttggctgctgtgggggctgttttattgccttacttaagatcttgagttgctagacaactgaaggatttttcattatcactgggctaacctatacgcattcagtttttacttcatcctgcaaaaagcaaaaccagccacatatggcccaagtgtctgaaggttcctccaagttgcccgtgtagttctgactccgagctcctacgcatgtgacttttctggcacagccgccagaatcaccttgaaaggttgtcacctacctgttccttaacaaagccatacagctctgttcagaaaagacagcaggcctgcctcttaggcattatggcatgttgtgaaatgccttttcatttgggtcctattattgtccccagaaatttcagcctcatgacattttacaaatcaagaagaacttgcagtctaaaggatggaaggagcagataacaaacaagaacgcttgtagagacgttactcaattatatgcctaatacagccaacctgacatagaagcattattatcatatcacgtttaatagcagcagagtctaaaatgccagaaacgtgggccaagttattcaggacttaatgtgatgcatgactagatctgtcaataaactatcatgaaaccataagaacccctaacaggaggatccaacgtagcctttgttgatcttagtttcttacaattcctcatggaaatactaaatcgggctgggcacaggggctcaagcctgtaatctcagcacttcgggaggccgaggtgggcagatcagttgaggtcaggagatggtgaaaccccatctctactaaaaatacaaaaattagccgggcgtggtggcaggcgcctatagccccagctactggggaggctgaggcaggagaatcgcctgaacctgggaggcacaggttacagtgagccaagattgtgccactgcactccagcctgggggacacagtaagactctgtctcaaaaaaaaaaaaaagaaaagaaaaaagaaaaactaaacaaaaagattgtaccgaatatggattttcctagtgaaataaagggaaacaaggaatgacaagtgtctagaaatggtttgtttttagatttttccccagagtctttctgttcctttgataaaatttcagactcaacacaggctcaatctactttagaaagtgtggtattgccaggcgcggtggctcacacctctaatcccaacactttgggaggccaaggcaggtggatcacctgaggtcaggagttcaagaccagtctggccaacataatgaaaccccttctctactaaaaatacaaaaaattagccgggcatgatggtgggcgcccagctacttgggaggctgaggcaggagaatctcttgaacctgggaggtggaggttgcagagagccgagattgcgccactgcattccagcctgggtgacagaacgaaactccatctcaaaaaaaaaaaaaaaaaaaaggccgggtgcggtggcttacgcctgtaatcccagcactttgggaggccgaggcgagtggatcacttgaggtcaggagttcaagaccagcttggccaaaatggtgaaaccctgtctctacaaaaatacaaaaattagctggagatgatggtggctgccagtaatcccagctacttgggaggctgaggtgggagaatcacttgaaccccggaggcagaggttgcagtgagccgagattgtgccactgcactccagcctgggtgacagagtgagacttcatctcaaaaaaaaaaaaaaaagaaagaaagaaaagaaaaaaaaggaaagaaaagaaaagaaaaagtgtgcttttaatgcatgaattatttcactggtcagggtttctattttggattcacatggtatggctctctttccctacttgatagactcaagcaatctaagtgcacctgtgtaacaggcaattagatacagtaagtatcaaaatcttaaaagagacataggaaaacattaatccacttgtcaaaagttacataaacttgcagtggtcagagtagtgaaatgactttctgctaaactcaattttccgatatgcatataaaaagatattaaacctgccatgcttccagggaactcaaggtctttaacctctacaattgttagatttcttcctatttgcctgaatatacaaagccacagcgaagtttgtcctgtggaggaaatgtcttccaattttgaaacaatcatttcttccagccgttttcaaatgactggccacttctcagaagaaaaaacccttggcttcttactgcaagcgtcattgggcaaaaatatacccaaatcatgttctttcataattggtgagctcttcaacttagtactgtccttgtacaggccaaagatcccacacccttgttatattgcccgttttatactgcaacacttttccccaagaactggcaattgtagaaatctgttggaactattttttttcctagattttcctataactgtttgagttttaactattaataacacagttactgctatctgtgtgtggcatatcattattacaattgatcatacataaacatttgattaaggctgtagctttattatattttctacccacccaaaaaagctagattataaagacttagtattcccaagaagtatttattcattagtttctcctaaaccatgaccagtatagaaaaagtcggtctcaagctggtctgtttcaaaaacacagagttgaggataagaggccgttttaaactgactttttttttttttcttttttggagacggagtttcgctcttgtcacccaggctggagtgcagtggcacaatcttggctcactgcaacctctgcctccggggttcaagcgattctcctgcctcagcctcctgagtagctgggactaccggcgcacaccaccatgcccggctaatttttgtatttttggtagagatggggtttcaccttgttggccaggctcgtctcgaactcctgacctcaagtgatccacccacctcggccttccaaagtgctgaggttacaggtgtgagccaccgcacccagcctaacctgacctttaatttgctgttatcttgtctaaatttaacagaattgggggtggggtggggggagaaagtttaaaagtattttcatgaaaccagaaccaccatttagcaaaacctttaaatggaatgaattcccgagctcacagaagtgcaaattgcaaggttacacattgcctcccagaaacacaggacctggttctgaactctttgctaaaggattctgattcagcccactgtaaaatctcaagcacaagtaggttttccacttactctccattacacacatgtccctctagcaaaaccaaaaacagcatttgatggaagctaaagattacaattatccggggactccgagccactaaaaaatagagtttgcaaagaaatcccttttgcccccgtcttcccctcaccatccctgccccttccgcagaagggaacccaaatcgtatgcaatttgaaatttttaatatgaatatactaaagtaggaagcacgtacctgctaagcacctggcgctctctttccctgcttgctctctcctcccacactctggcaacggaatgcccttcaaaaaccatggctcagtgcttttggtaaatgttttacgagacactaaacaggcttgtgtcccaccctcagagcaaacaccactgagggaacacaatataatggtcgaaaagatatcatgtaatgtacaataatgaaaatgaacaagcaggctctatttccacacttccccttaagggggaaagcaatgtcaaactttcaggtggtgggggcggagttgccggaaaggctcatagaaataaaccttgacgctggaagcgttagagcgatttttttaaaggtggcataacgataagctcattgttctaatcctcaaacaagtcttggcttgctgagctgaaaaactgtcaaaggcaagagttaataaagggtggagttcaccggcgaatatgtagacgcagtagcatctccacattgaccacatattcctatttatcagagaaaatgcaactcaaaaagtgctcataaaccatcctccacaataaccaaaggtacttcccattttccatatccttcaagttattcacagttaagacccaactctgctccaaaccagaagttttgcattccattcaagttaacaattacaactgaaggataacagaaacttgctggcaccaaactattagaatgtcaggtgcctcctggtaccaccagggttaatgagataaagagagggtgcccagggatgatctatctgcctggttttacagaaactacctatagagattgctagagtcttgggcccatgcaagcagcacgcactcatcggctactggaggactgagtgggacatctaagacatgaaaaagcagaattacttagctacagtcaagcccactcgctaaaaagagaccaagaccgtctagagaagaagccagaattggctttggttgcagaatcacacccacaggcaggataggcaaataagataacccattctctgtccccacccactcctccaatccccaagagagtgctcagaattttgcatttcctacctttaaaatatctgctggggtggaaacaaaacaaagcaaaacaaaactgaacctagaattgagatcatgtgttttctacactccagctgtgtgaccttgagggagtaacttaacctccctgagcccgtctcctcatctataaagtacaaatgtctagaaacacagaagttatttccaagaactgacagctctccagctccaggagcctagaaaatggcacagagcagttcttgacagttttaaaatgtcagaagggttgttgtcattttttggtctcctaccttatgtggatgggttccatcttattttcaatgtcctcctgttgcagaagcttccggttagtcctgggactaaagggcaattgacctcactcctcctgggtctgact

SEQ ID NO: 972 - DNA, 116398 bp, Homo sapiens
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggtaacagcatgggccagtttgtctgggggcccccgcttgggggcgcgacccctctctaatgcccaacgcttgccttgatgacacatattagcgattgtggaccgacaccttggatttttcaaatcccttcctaattacacaggcacccgcttggtcactggcccaacactggggggcttctctgccctggatgtctgcaccacagatggctgtggccccaggcttgcagagcagggacctggtcaagggatgtggggcgctttcttcaccttaaagttccccccaagccctctccggggctgtattgtgttgtaactttgttgaatttccttagcgggtctgaagctagcgagtttctaaactgtttttatccgtgatgcttctaagcaatgatctttgtgtatctgaggcttcatcttgtgcatttccacttgctagaaaagctgaaatcaggtttctgagctgcgtacaggacaccagagtccttattgaaggcgtttggagaggttttatccccttctgggagtgagatagggtttccagacaataccattttagttcttctgtcaaaccatcaggcattttccaacagtgccgccctaggtcaaatttagggtctggaggagaggaaaatgatcttcttcaagctgtcgttctagttaaagacagaactactaactaaaaaccaaaaatacatttgttcatctcccatttcccctcagctatagtgtagatatttgaaatatttatttctttttaaaaaatcttaatgataacatgaattatacaaagatgctggtttcctttttttaatccaaatattcaaagttgttttaaacatatgtctaaatttctaattccattcacatccaaataactttcaagtgggaactactaatgagaggaaggatggaaaaatcaatggtttgtaaactgtgaaggacatatttttgtttccatctggatttctaattaaaccataataaattgagtaaaattatcataataatgatgaatctaagttatggatgaatttgcaaaatggctataatgtgctcaaaaatagtgccattatcatcaacagaatggcaattgtatgcagagttcaattagagtctttcatctgttaaaaacttctatagatcgatcatttaataaaacagtgatgcaatatagtgcagtaacagtacctactgcactatatttaaaggcacatattaacattacagactggctattgtaataataaaaaaatgtgctttctttattgcttgaaaataacatgttactcatatatcattatcctattctttttctcaatatgtgtttttccaaaatccatacaccccaataagatctttctactagccatgatttcttcatgtctatagaaaacttcagagcatttgaggcttaagcttatttttgcttcatctatctgtttgtctgtttcatctggcagttttattcttggtgcattttgtgaacacattacaaagtatctaaaattatatattagaaattcattgttttatttgtatgattattttatcccatagttcctataaatcatactgctcaccaatactctcttttacagatgtcaaagactataggttgaataaatatgaattcactataaaccaatgaatgatttcttccagaaatatcagtttatttattgtagttgttcttcggctctgtgtgtgtgtgtgtgcatgtgtgtgagtgagtgtgattttttatgagaattccatgcaaatgcctctgtgataaatatttataaaccttttcactgtattgcattaaaatggatttccagctgtaacatggaacacaaaataaggacaacttcatgccttgaagcttcagatacttaaaaataataattttgtaaaatactgccctccttattatggaaaaaaggacattggttttagctaaagacttcaaaactgtcaagcacattcaaagaaaatggaataaatataatctcacattcctaaaacacatctggattagtctattctcatgctgctataaaggactgcctgagactgggtaatttataaaggaaaaagatttaattgactcaaagttctgcagggctgaggaggcctcaggagacttacaatcatggcagaaggggaagcaaacacgttctctttcacgtgatggcacgaaggagaaacgccaagccaaagggggaaaagccccctataaaaccatcagatctcatgagaactcactcactatcatgagaataacatggtggtagctgtcctcatgattcaattacctcccaccaagtccctcccaaggacacatggggattacaagaactacaattcaagatgagatttggatggggacacggccaaactatatcaatatttatatagtattttaataatcttaacaaattgttctcttaaacatatgaattttatgcttaccattaacctgatgttaacagctgattttcttttcctctctgtttccctttgattttaagttccagctttttggataagttggttcttaaatgaattttccaattgccttgaaactgaacattaagggtccagggagaccttcactccattaaactagaaggaaatggaaatatactgcccatacaaaaagatgcaatggtccctatagcagacagctgtttagaatgggtcttgtgtccttgctttgcggagttttcaaatacaagacttctaaaagtaaagaaattaggtttcttcccagtcagacttctaactggctctgtgcctcaggcaaatcatttaacttctctatgtctaagattcctcaaacgtaaaaggatgaattataatttgatttctaaaattattttacccctctagatttctctgtttctatggtagaaggcagaggatacagagtgagaaagctcagatgtccttgctttgccatttgagagcttctgcccttaggcaaggccctgaaattctgtgacatcaacacctcatctataaaatggcctaatagaagaaattaatagaatgatctattatgctggatacagtgtctagtacatagaagacgcacaagaatgtttttaaggcacccatctctgaaaaatctaaagggatttctgcctgtggcaggggaggaaatgacctaaaagcagaggagtctatcctgcatctgcaggtaggcatttcgcagtatagtttctatagtattcaccagagaccaggaaaagagagggccagagcctcaagcatagtatgaatgcctccttggtatctttccatagtttagccccccctaaaaaagtcaaagtgagtcaggacagcataaatattaaacttaatgccacacatgactgacaagacatgtcctgttctggtttccatgtcaaactaggcttgattctgttacagctaagcataccagctaggctgtataatgaccatcagaataattgcacaatccaaatcacaccacaccagtaattagaaaaaggaaagaaaaaacaaataaaataactcctgaaatgccaaaaaattggttctctttcagctgtatttccatttaaaatttaaagttttcaaatgttatgaaagtatatttcttactttttttcttcttgggctattgtaagagtctcatttaggtgtctgcatggagtctgggttccatgtggcagttgcagaataaagcacctgccattagaactgatgtgcctttttctagtccttcaaacaagtctcagttgatccatattttcagaactctggagggtttaccaaacagaatattacagttctggttgcattcccacaaaatttagaaagcatcaataaatctttcccaaagccaaacgagatcaaaatatctaaacttaagtgagctgcaaccatacgcattatctcatttaatcttcatgattttagaaattgagtatgcttacaatcccttttcggtggataaagaaactgaggctcagaaataatttgccaaagtaaacatgtttactaggttgaggaaccaggataatgaactcatgtagtctcccagtctacatgcttaaattctacactgcaggactcccaagtatgtagcaacaacagcttataatcaaagtaccaatttctgtatatactgatcctttccacatgaaagctatatacctaggaagagataaatattacagtcctcatgaagatttttctaagtggaagtaagaagcatcagagttatttgtgaaactttcaaatgtctcaccacagattagtgggctggagttgggttcgggtggtgtgtgtgtgtgtgtatatatataatgtatatatacatttaaatatatagtatatataatgtatatatacatttaaatatatagtatatataatgtatatatacatttaaatatatagtatatatatgagattctgagtcaaaattattttcatgatttcccataatgaaaaaaatttgtcccaatccacaatgccattttgcagccatagacagactaatcttaagaatcttaagtgttgtcttggacaggaggtatttagaaaaattataatgagaggataaacatttctttaatttagcctcaccagaatgtgagttaaatcaaatagatgtatatattagaatttaccagctgcaaacatgcaaggaaataaggacaaatttcgattaagtgcttgcacatgaccttatgattctcatatcttgggagagtttgcgacttataaaaactgctttatcttaccaagagtgacatctcaaacaccctgtctccttgctaaatgtaaacatttaaagaggtgatacttgcagcgttcaggatttctctcaaattccctacttttccttaaagtatggagtctcatttaaaatctttaaagtacctcatttaggccaggtgtggtaactcatgcctgtaattccagcactttgggaggcagaggcaggaggatcgcttgagctcagtttgagatcagcctaggcaacatagtgagatcctgtgcctacaaattaaaaaaaaaaacaaaaaactagctggtcatagtggtacatacctgtagttctagcaactcgggaagttaaggttaaggtgggaggattgcttgacccctggaggttgaggttgcagtgagccatgattatgccactgcactccagcttcggcaacagagcaagatcttgtttgaaaaaaaaaaaaaaaaaaggacctcatttaaagtctctaaattttccttctcattttactttctgtccttgcattcttggcacactgataataaactgaatgtggggtctttctaggatcacatcttccagtctttgtaaggatgctgtatctcatttataatagacaactctctcagcagagttcgtagtcttgtgtttccctttctacttactcatgatctcctcttctgtctggaattcctcatcctccacaggtgtgcaaactgttttgtttgtttttgtccttgggtagccgtttatatcatttatatcagtgttacttaaggcttcaaagcctttggctaaaatcttccctgtttgagggagtttcctttgttcctgctcttttttcagctggaaaaactacattaagtaatttctgtgatatatgcttctttcaaaactagtggccctatgcttcccttaacacagaagtatcaaagaccagcatgagcttgaccaatatcctgagcttgcttttgatattttgattatctaggttttagtaactttttctaattcatgtttacctacagaattagtgcccgcttgaagattctacagtatccaaagccttacagtttctcactgtctctatcctcagctctcatcttttttcctcctttgacaccctcgagtcttgaacatgccaagctcattctcaattacaacttttgcacgtgatgctctccctgcctgggaatcgtgagtctcagagctgcagggaaggggttctttaagtcatttcatctcgggtctggaatgcttctccacactactagtcctcacagtattgtctgatttgtgtcaaagcccacttgctagttgagactttctcatttatgtgttcacttattaatgattttattccccaaaatgaaatataagctccatgagagatgtacagtatgctttcatatttattgctggccttagtgcctagaacagagtctagtgcatagtagatactcagaaaatatttgttctgtgaaaattttacttccatttccctattagattatcctgcatctttttacaggtccagacaagttgccgaaacttcaaccttatcattcctgttttttaattcctttctgttgatcctaccttagctaaaataccaatcagtatattttttttcctgtaatatggaaaaaaatttgaaaaagctatcattgcaccattttaatatacattcaggttgcatagtatctgtatatgttgatttcaaagaataatctggatctgagtactaggaaaaacgaaaataaaaagtagcacaacgtttactttttattaaagttacattagccattccactgttttcactggcatgatttttcatgtttaaaatatattttgaaaatatatacatatatagagatataattttgcataagtgcctaaactaaattatatcataatgttgttttttaattcttgatttttaaatttcctttctttttttttttttttttttttgagatggagtctctgtcgcccaggctagagtgcagtggcgcaatctcggctcactgcaagctccgcctcccgggttcgcgccattctcctgcgtcagcctcccgagtagctgggactggcgcctgggttttttgtttttttttgttttttgagacggagtctcgctctgtcgcccaggctggaatgcagtggcgcgatctcggctcactgcaagctccacctcctgggttcacgctattctcctgcctcagcctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtaaccaatcttaattgggttctattatgttagatttttctctactcttatacccattcacatatatacactctcaaatcaatctttttgtcatcatttaaaaaatatatgcatcttgttttctaactcatgatgaccttgtggaaagccctccatgttgattgttatggataaaattcaattctaaatggctgtatataatataccgtgatatggataataagaaacaaattcaaccattcccttcttgataaacattcactttgtttccagaggtttctatcttgttgggttttgtcacaaaacaaggctacaataaaagtagttatttaaaaactactttatctccaggtttaaagagcaaagctatttttcaattttaatgtatgttgccttattgctttctaagtactacaaataattacatttttaccagaagactatgacactgttctttactcatgtccttacagcaataggtgttgtaactgtttatgttattagttgttaaattaatttgaatttcttaactacttgtgaaattaaatatatttttatcttcttcagatgtttggacttcttgtgtaaatcatttattaatattcttgctcattttactgagatattagtctttttctcaatttatacattctttgaatattgtaattattaatgcttatcatagtaggtgttttccatattgtcggctgcctttgttcataactttatcatgcacatttaaaatatttgtatagacaatatatttattattgtatacattttggattccagtgttgattaatatgattttttcttattgctgcattagacatgtagtcttctagattttactgaaggatttttatttttaaaaattttagcatgggtttttaattcaagtggagttttaaaacacatgccataaatagtgagccaactttcacttcttccaaacagcttactaaatattttattcttccccttcgaattgaaaacacacttttgtcatattttaaaatctcatatataatgggatctatatttgtatccttgattctgtttcactgaccaatttgtccatttctatggcaacaccaaattgctttgattatatttgccatagattatttttctgatatcctaaaaagcatatctccttactgtttttcttcacaaatgttcttagcttttcttgggcacattttcttccctctgaacttttaaaaatcatattccaaaacaaatcctgtcactgctttgcaaatatttttaccaaacgaactgtttgtctatacatattttaaatgatattatattaaattgatatgttaatttggggagatgacctataaagtattaaaatttatcttccaaaaatcaggcatgttgttcaattttaaagaaattttaaaatctttcagtagggttttattttttatgtcatcattttatattccatcttttgcctgttaaatttatttttatatatgctacattttagtcactgctgtaaaatatatatatatatattcattttaatttctaggtgctattgctaatattaagaatggctacttttaaaaaatttttaacttattttatattcagggggtacatgtgctggtttgttacaaaggtatattgtgtgatgctgaggtttgggtacagttgaacccattacccaggtagtgagcgaactacccaatacgtaatttttcaacccttaatcccttcctcccttccccttcttgtattccttagtgtctattgtgcccatctttatatctatgcgtttccaatgattagctccctcttataagtgagaacatatggtatttagttttctgtttctgcatttatttgcttaggataatggcctccagccgtatccatgttgctgcaaagtacatgatgctgttcttttttataactgcatagtattacatggtgtatatgtatcatattttttaaatccaaaccactgttgatgaacgcctgggttgatttcatgtctttattattgtgaatagtgctgcaatgaatatatgaatgcaagtgtcttcttggtagaatgatttattttcctttggatatataccaagtaatgggattgctggtttgaatggtagttctatttttagttctttaagagatctgcaaactgttttccacagtggctgaactaatttactctcccaccaacagtatataagcattcctttttctccacaacctcgtcagcatctgttctttttagactttttagtaatagccattctaattggtgtgagatgatatctcactgtggtttgatttgcatttctctgatgtttagtggtgttgagcatttttccatgtttgttgactgctcgtatgtcttctcttgacaagcatctactcatgtcctatgttcactttttaatggagtttattttttcttgatttaagctccttatagattgtggatattagacctttgttggatgcatagtttgcaaatattttctcccactctgtaggttgtctgtttacttcgttgagagtttcctttgctgtgcagaagctctttagtttaactagagtctcacttgtcaatttttgtttttgttgcaattgcttttgaggtttataaattctttgccatggccaataatatggcttggctgtgtcccccacccaaatctcattttgaattatagttctcataatccccatgtgtccctgctgttcttgtgatagtgagttctcatgagatctgatggctttataaggggcttttcccccttttgcttggcacttcttgctgccaccatgtgaagaaggaaatgtttgcttccctttctgccataattgtaagttttctgaggcctccccagccctgcagaactgtgagtcaattaaacctgtttcctttataaattacccagtcttggctatattcgtatagcggcgtgagaatggactagtagagtatattaatatccagaatggggtgctgctataaggatagccaaaaatgtggaagcaactttggaactaagtaattggcagaggttggaacagtttggagggctcagtagaagataagaaatgtgggaaagtttggaacttcctagagacttgttgaatggctttgaccaaaatgctgatagtgatatggacaataatgtccaggctgaggtaatctgagattgagatgaggaacttgttgggaactggagcaaaggtaactcttgtatgctttagcaaagagtctggaggcattttgcccctttcctagagatctgtggaacactcaacttgagagagatgatttagggcatctggcagaagaaatttctatgtggcaaagcattcaagagaaagcagagcataaaagtttaaaaaatgtgcaggctgattatgaagtggaaaagaaaaatccattttctgaaaagaaatttaagccagcagcagaaattttcataagtaacgaggagcagaatttaatcaccaaaacaatgagaaaaatgtctccagggcacatcagagaccttcatggcagccctcccatcacaggcccagaggcctaggagggaaaaatggtttcttaggccaagtccaggcccccttgctgtgttcagccttgggacttggtgccctgtgtcccagccactccaaccgtgggtaaaaggggtcaatgtacatttcgggccattgcaattcccaatccttggtagctgccatgtagtgttggtcctgcaggtgcacagaagacaagaattgaggattgggaacctccacctagatttcaaagaatgtatggaagtgcctggatgtccaggcagaggtatgctgcaggggctgatcgcttgtggagaacctgctagggtagtgcagaagggaaatgtggggttggagccctgagagagtcctcactggggcactgcctagtaggcctgtgagaagaggctactgtcttctagacctcaaaatggtaaatccactgacagcttgcaccatgcacctggaaaaggtgcagacactcaaagtcatcccatgaaggcagtcagtaagggggctgtgccctgcgaagccacaggggtggagcttgccaaggccatgggagcctacatcttgcatcagtgtgacctggatgtgagacatggaaccaaaagagatcattttggtaatttaatgtttaataattgccctattggattttgtgcttgcatggggcctgtagcccctttgttttcactaatttatcccatgtgaaatggtgtatctacccaatgcctgtaccccattgtatctaggaagtaaccaacttgcttttcattttataggctcataggtggaagggacttgccttgtctcagatgagactttggacttggacttttgagttaatgctggaatgagtcaagactttaggggactgttggaagggcatgattgtgttatgaattgtgaggacatgagatttgggagggtccaggaccagaatgacatggtttggctgtgtccccacccaaatctcatcttgaattgtagttcccaaaatccccacgtgtaatgaaggagatgtggtgggaagtaattgaatcacgggggcacttacttccatgctgttcacatgatagtgagtgagtcctcacaagatctgatggttttataaggggcttttccctgttttgcttggcatttcttcttgctgccaccatgtgaaaaaggacatgtttgcttccccttccaccatgattgtaagtttcctgaggcctccccactcatgcagaattgtgaatcaatcaaacctctttcctttataaattacccagtcttgagtatgtccttatagcagcatgagaatgaactaatacagccaatgtcaagaaatgtattccctgggttgtcttccaggatttttatagttttaggtcttacatttaagtctttaatccatcttgagttactttttgtatattgtgagcagtaagggtctaatttcattcttctgtatgtggtttgccagttatcccagcactactttaacaatatagattctttgaatctatgaacatggaacgtttttctacttgattatgtcatctgtgatttctttcaacagtgttcccttttatccacattctcaccagtgtcagttattttttgtctttttaatagtagccattcaaactagggtaagatgatatctcattgtggttttgatttgcattttcctgataatcagtgatgttgagaattttttttcatgtagccattggccatgtttatgtcttcttttaagaaatctctatttgtgttctttgtccactttttactgggattattatttttttttctgtggagttgtttcattccttgtatattctggatattagtgcctttttggatgaatagtttacaattattttctcccattcagcagagtctctatactgtgttcatttttttcctttgctgtgcagaagcttttcagcttctactaatcccatttgtctatttttgtttttgttgcctgtgttgaggtcttagccataaaatctctgcctagacaaatattctgaattgtttccctatttttttctagtaattttatagttttaaatcttagatttaagtctttatttcatgttgagttgatatttgtgtatgaaggatatgggtccagtttctttcttccacatatggatatccaattttcccagtaccatttattgaagagggtgttctttcctcaatgtatgttctagtccctttgtcaaaaatcagttcactataagtatctgatatactgattttgtttccttcggataaatacacagtagtgagattgcaggattgaatgatattctatttatagttgtttttgagaaatctccacattgttttccatcatggctgtactaatttacattcccacaccagggagtatttccacgttctctattctgttccattgatctatgtgtctatttttataccaataccatttcctcttttggttactatagccttataatatattttttaatcaaatagtgtgatacttttgcctttgctctgtttgctcaggatatctgagcaaccaagtacagatgctcctcagcttatgatgtataataaacccatggttaagttgaaaatattgcaattcccaaatgcatttagtacatctaaccttctgaacatcgtagcttagcctagcctaccagaaacatgctcagaaaacttacattagcctacagttgggcaaaaatcatctaatacaatacatattttgtaataaagtttgaatatctcatgtactttattgaatgctgtactgaaaagagaaaaaataatggttgtgtgggtactcaaagtatggtttctgttaaatgcatatggctttcacatgatcataaagtagaaaaatcctaagttgaccctttgaatgttggaaactgtgtgtattgatggtgcggagtaatgaagatttttacttgctttgatcaatttagaaagcaatctgatttcatacaattaaaaatgtatatgccctatatatgcataaggagatatatataaagatgtttattgcagtattatttataataaaataatgaaaaattaaaccattaattaaagaatgggtaagtaataggtaatataatcatgtggtaaataccacaggtaggcaaaaaaatagctgccatgacttggttaaatgaaaagactggatagatttgagtcctggccctgtcataactttggatagttacttatacttttcctgcttcagcactgtaaaatatagataatgctatggtttggaagctctctccaaaactcatgttgaaatttaattgccaatataatattattgcaaactggggactttaacagatgattaggtcatgggagtttcaccctcatgagtggattaatgccatcattgcagaagtgggctagttattacaggagtgggctcctgataaaaagataagcccagccgccttttgttctctctgtctcacatgcttgcttacccttccacagtgggatatccctcaccagacgctggcaccatcctcttggacttcccattatccagacccatgagccaaataaatttctgttctttataagttactcagtgtgtggtactctattataacagcagaaaaaaagacatactattcatactgaaaagtgaggctgtcattatagcaaagtgctgaaaaggtggaagcagctttggaactagataatgggtagaggctggaagaatttggaggagcaggctagaaaaagcctagattgctgtgaatgtagcattaaaggcaactctggtaaggggtccaaacaagaggagagctgtagggaaacatgaaactttttagagattacataaggggtggtgaccaaaaggctgattgaaatattaaaggtaaaggccattttgatgaggtttcagagggaaatgaagaacaatgttttagacactggggtaaagtccatccttgttttacagttgtaaagaccttgagtgaattgtacccaaagcctgagggctttgcagaatgcagagctttaaagtgatgaactaggatatctggtggaagacatacccaagcagcaaagcattcaggctgctgcatggctgcttttaaccatatacagtgagacgtgagggatgacttcaataaagattgtataataaaataagaaacagagtgaaaggatttggaaaattcacagcctggttatgtaaagaattaaaaaaaaaaaagaaaatttcagaagagagcactaaggatgtggccaagtgacaattgccaaagagattaatatggataaaagccaggtgctatatatcaagaccatggaagaaagaccctgaaggcatttcacttatcactgaggttgccccttccattataggcccagagctgtaggagggcagaatggtttctggtgatggtcttgaagcatcctccatgggctcactgcccagggttaacttgggtctccactcattgtgattctagcaatgtgcccctagtctgcactgggagcatctcatatctaacattttgatttaacccttttccaagtgggcatgcccagtcagggatctggtttagctctccctgatctactttgccccactgcccaggtttcccaaatcacagaactcataatccttgtgattacttgctcaatgctttgtcttttatataggattgttagcttaatgaaaactgttaagcccgaatattgtgtttaattcacagcagaagatcctaaatgagtaatgaatgaataaaaattatagaaatatatgcgtatatgttaataatagttgggtcttacagagtatttcaaatagtagccttctttccactcatctgaatttggagctatttagagatagacacacaagcatatatgcttccatttaggatagatgcaaacatatagacatcaaaatatcagctttatttctgttgaaactatttgagaatgtgtctagggactgtgggcaaggagtaaagttattcctaaatttgacagatttcccccactcaatctctcattacagggagatggctaacttcgtatatattacagttcatatcatattatgtgtgtatgtattacacacacgtatattacacacacacacatatatgtttatgtataggtcatctccctgccatatatatatacacacgtacgtaaatgcacagagagcatatgcactttattggcagcaagattcaatggggagcaacgaaaaggccagagacactcaagttcagtttcttcttcccaagttctggattcttggagaagtgagggaggagtcaggcaacttacccaagagaagatttcaggaatagagaataagttatctctagaagggggtaatttgggtttttggtttttggtttatattttctatgttttccaatgatcatgcactatttttaatcagataaaaattcctaaaacataaattgcaatcttaatttttcttggcctcttattttctcacaagtgttaatttggccaattcacaatatacatatatgcctgtgtaaaattgtagatctcctgtgtgggaatgaaagaagtatctgatggagaaaatgaacaaatagcttaaaaatatataaaagagaaacatctatattaactattcacaattacttggggatagcttcttgtgtgagaaaattatattttaaatgaagtggctggtgccaagtgatatgagtactaatttttttttaatgatactttggtaatgtggtcaaaatgtgaaataacttatctttttttttcaatatttttctactacttctcagtaagcatgagttttgttggaattattgtgaagttttagagttagaatgtaatctttttcgtaatttcacagatcatattaaaatttacaaatagttatattgcttatagagccacagtgaggggtcaggtttcttattctgccagttaatgtagtgtctgctttagaatactgtcatctaccctagttcacaatttttgaagatcttgtgaaagaagatatgtagggaagtcaataacaatgaatcttccaataaagaaaaggaagaaagttctcattcccttattttttgaacctaccttttaacagatggttttactgctctattacacagcataattggattgttttatctgaaagtgaataataaagacaaaactttaaaaatagaactgtttgaactgagagctcacttttattaagagaacttgtcctatgaaaattattatttggaaacagaaaccaaagtacatatattaaatagcatcttttgcaatcaatgtcaaggctgtgttgtgtctttggttgtcttttggtaaatctacaaaggagcatcaacttagtgtcctcataaaagacatatatgtgttccactacattcagtgtgaacaatattttaatttagcttgccaagatatagtgaaatagaatttttgcagggtgattgttctgttaaaaatatataaaagggcctagaaaatgatcttttggctaaagctgtagaaaacagactgccattgatttgcagaatatgctgtttgatgtttagacagctggaaaaagtttggtaggagaactttaaaaacctgttataattgtagccttgagtatgatatgatttggcaactaagagatcacctcacaaagctatgatccacaggcaatgcagtcttaggtattataaattcatatttatatcaaaaattccaaatatctattgagatattgtgatagaataagaatacacattttggtcttctttcccagctcctggccagacctcctgaaactcttgtaagtgctagtgataagagctataggagcaccttttattataatgtaattggtttttgttcctagctcttgaaatgcttctaaaaatgtgaaagaataaccttttgctagtcataacaagccccattcaactacacttgaatttatgtcaacgaagtgacttgtggaaagcccctaagggtgggggtcactggttgtgaaggaaatcaacaccatgattagagggttggaatttttagcactcccatccaaacctccaaggatgggagaggggcttgaggttgagttaatcattagtggccaatgatttaacaaatcatgcctatgtaatgaatatcctaatccttcatgaatgtcctaatcaaaggagtttggagattttccatgttagtgaacacatggagggctgtaagtctcaatctccaaactatacaaaccaagaacaaataatttcacacaaatcctttgccattgacattaaccagaagacagggtactatataaacccaaactaatattttaagcccccctaaccaactgaatggaaccctcttctttgccaagggcattcaaaagttaaactgaaaaactagttcagtctgtgatgggaaggggggttgtacgtgcttcattatacactcctccctttacaattcgggcacaactgaacagcattaacattaaaactgacaccttaagaatgacaaaacagactctttgcagcaataaaataccaaattccaacccgactctattataacatgacatggcaaatagcaggccctgaaggaaagcaacatgttttacctcaaaatacatttctttgatgtatttttttaaattatactttaagttttagggtacatgtgcacaatgtgcaggttagttacacatgtatacatgtgacatgctggtgcactgcacccactaacttgtcatctagcattaggtatatctcccaatgctatccctcccacctccccccaccccacaacagtccccagagtgtgatgttccccttcctgtgtccatgtgttctcattgttcaattcccacctatgagtgagaatatgcggtgtttggtttttgttcttgcgatagtttactgagaatgatgatttccaatttcatccatgtccctacaaaggacatgaactcatcattttttatggctgcatagtattccatggtgtatatgtgctacattttcttaatccagtctatcattgttgtacatttgggttggttccaagtctttgctattgtgaatagtgccgcaataaacatacgtgtgcatatgtctttatagcagcatgatttatagtcctctgggtatatacccagtaatgggatggctgggtcaaatggtatttctagttctagatccctgaggagttgccacactgacttccacaatggttgaactcgtttacagtcccaccaacagtgtaaatggaagtaaagctctcctcagcaaatgtaaaagaacagaaattataacaaactatctctcagaccacagtgcaatcaaactagaactcaggattaagaaactcactcaaaacagctcaactacatggaaactgaacgacctgctcctgaatgactactgggtacataacgaaatggaggcagaaataaagatgttctttgaaaccaatgagagcaaagacacaacataccagaatctctgggacacattcaaagcagtgtgtagagggaaatttatagcactaaatgcccacaagagaaagcagggaagatccaaaattgacaccctaacgtcacaattgaaagaactagagaagcaagagcaaacacattcaaaagctagcagaaggcaagaaataactaaaatcagagcagaactgaaggaaatagagacacaaaaaacccttcaaaaaattggtgaatccaggatctggttctttgaaaggatcaacaaaattgatagactgctagcaagactaataaagaaaaaaagagagaagaatcaaatagatgcaataaaaaatgataaaggggatatcaccaccgatcccacagaagtacaaactaccatcaaagaatactacaaacacctctatgcaaataaactagaaaatctagaagaaatggataaattcctcgacacatacactctcccaagactaaaccaggaagaagttgaatctctgaatagaccaataacaggatctgaaattgtggcgataatcaatagcttaccaaccaaaaaaagtccaggaccagatggattcacagccgaattctaccagaggtaaaaggaggaactggtaccattccttctgaaactattccaatcaatagaaaaagagagaatcctccctaactcattttatgaggccagcatcattctgataccaaagccgggcagagacacaaccaaaaaagagaattttagaccaatatccttgatgaacattgatgcagaaatcctcaataaaatactggtaaactgaatccagcagcacatcaaaaagcttgtccactatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggaagtatctcaaaataataagagctatctatgacaaacccacagccaatatcatactgaatgagcaaaaactggaagcattccctttgaaaactggcacaagacagggatgccttctcacaccactcctattctttgagatattttgaaaaggccctgcaaaactgtctcttgtgggaaaaatctacattctgtagagaatccctttccctttccaggtcttttccctgatttaggagagattaactaagagtctggcacctttttaagcctaataagaaacatttacaatctattctctttgaagcctgctacctggaggcttcatcttcatgataaaaatcttgctctttacaatcgcttatcttaagcagacactcctttctattaatttcaggtcttacataataacttaactctttcaaccaattgacaatcagaaaatctttgaatctacctatgacctagaacacccctaccccttgcttcaagttgtcctgcctttctggaccagccagtgtacatcttacatgtattgattgatatcgtgtgcctccctaaaatatataaaaccaagctgtagctcgaccaccttgggcacatgttctcaagacttcctggggctgtgtcgttggcaatggtcctcaggtttggctcagaataagtctcttcatatattttacagaatttgactcattttgtcaacaacttcaaaccaagttatctgtaaatagaaaacaataataatgacaacaacaataccaatttcaagcagagatgtttctcaagctcccagatctccaggctatgtggagaacaaagtgaatctgggggaaagaaaacagcatggaagagataatgagagaacagagagcctatgagtgaactaaaattgtccccagaaagagaaagtttaccctaggaacaaaaatactataaatagtactggaaattctataagaaagttatttttttaatatccaccagcaatgttttgtagttttaagcatatgcattttatacatcttttcttaaatttattaccatgtattttgtttttttatttatgataaatcaagtactttaaaaaaatttcttccaggttatccattgccaatatatagaaatacaattattatttgtaaattgactttatatcttgagaacttactaaattattatttatgatgactttcatatagattcaggattttctatgtacacaatcatgcattatgccaataaagacagttttagttccttctttctgatctgtatgtcttttatatttttttctaatgcactagctatatctccagtacagtgttaaaacagaaagaacagacatctttgcctattccttatctaagagcacagtattcaatcattttaccattgatgactatagtaactgtatgttttgtataggtctcctttctcaaattcccttttctcctagttttaaaaatcataaacagtattgaatagcatgttcatattttgagtctacatttatgagaaactcaatattattaagattttgattctcaaaattgatctatagattcagttgatctatagacactattgatctccattcaatctatagattcaatccaacaaaatctcagcatgctttttttgaagaaaataataagctattaatgtatatggaaaagcaaacaacctagaagaaacaacaattttttttaaatgaacaagtttaattagactacttggtttacagatttgctgtaaactacagtaattgagacagtgttgttggtgtaagcacggccatgtagacaaacagaacacaatcaccagtacagaaatagacccacacttatgtggccaatttattttagacaatggatccaagataattcaattagaaaaggttaatcttttcaataaatagtactggaactaccaaatattcctataaaaaattaaccttaactcttacattacaccatacacaaaaattaaattgaaatggaacataaatgtaaacatataagctaaaactataaaccttctataaaaatcataagagaaaatttttgcaaacttttacaggaaagatttcttaaatataacacaagaatcacaaaccatgaaagaaataaactgacacaattaactttatcaaaacttaaagaaacaatttttttgctctctgaaagacacagttgagaaaacaaagagacaaaccacagaatgggagaaaatgttttgaaaatatatattttacaaagtactttatccagaagatataaacaattcttataactcaatgagaatacaaagaaccttcacaaatggagatattaatagctaataaactcatgaaaaactgttcagagttctgtcttcatgaaaaagaaaactaaaaaacaatgagacatctctacaccatcatcctcaacaagggtgatatcatccccaaggtagcaaaaattagttcttaggtacagaggaaaattttctatattgtataatatacagattttatatgtacatataatacatatacacacagtataaaacagatactattaaactactaatatatgcaaaacatcaatgaatcttaaaaagcattagactaagtagaagaaaatcttaatatccacatacaggtatacctcatttgattgcactttgctttattgtgcttcacagtattgtgtttgcaaattgaaagtttgtggtaaccttgtattgaacaaggctatcagtgccatgttcccatgttccccaagcgcataggctcacttcgtgtctttgtcacatttcggtaattcttgtgataataaaaaagtttgaaatattgcatctgtgaacatgatctgtaatgctattattgtaattgttttggggtaccacaaactgtgactgcataaaatggcaaaggtaatagataagtgttgtgtgtattctgactgctctaccatagcacatagtagagcagatattctcccctctccctctccttgaggcttcctattatatgagacaaaacgatatcaaaattaggccaattaataaccctacaatggcctctaagtgtttaggttaaaggaaaagttgcacatctttcactttaaatcaaaagctagaaataattaagcttagtgaggaaggcatgtccaatgccaagacaggccaaaccctaggcctcttgagccaaacagctagccaagttgtgaatgcaaaggaaaagttatcagaggaaatttaaagtgctgctccagtgaatacatgaatgataagaaagcaaaatagctttatggctgatatggagaaagtctgagtcatctggatagaaaatctaacaagccacaacattcccttaagttggagtctaatccagagcaaggccctaactctattcaattctatgaaagctaaaagaggtgaggaagctgcaggagaaaagtgtgaagctagcagaggttggttcatgagattcaaggaaaaaaattctctccgtgccataaaagtcaaaggtgaagcaacaagtgctgacacagaaactgcctcaggttatccagaagttctcactaagatgattgatgaaagtggctacactaagtaatagattttcaatgtgcatgaaaacaccttctattggaagaagatgccattgaggactttcatagctagagagaagaagaaaatgcctggcttcagaacctcaaaggacagcctgataaggcagctggtgactttaagttgaagccaatgctcattgattattccaaaacccctaagttccttaagaattatgctaaatatactctgtccatgctctataaatgaaacatcaaagctttgatgacagcacttctgtttacagcatggtgtactctatactttcagcccactatggagacctactgctcagcaaagaagattcctttcaaaacattacttctcatttacaatgcacctggtcactcaagaactctgatagagatatacaaatagattaatgtagttttcatgcctgctaatacaacatacattctttagtccatagatcaatgagtaattttgactttccagtcttatttaagaaatacattttttaaggctataaatggcacaaatagtgcttcttctgatggacatgggcaaagtaagctaaaaaccttctggaaaggattcaccattttagatgccatgaatatttgtgatttatgggaggtagtcaaaatgttaacattaacagcagtttggaagaagttggttcagatcttcagggatgattttgagaagttgaagacttcagtggaggaagtaactgtggatctgatggaaataacaagagaactagaattagaagtggaacctgaagatgtgtctcaattgctgcaatgtcataatcaaacttaaacagatgaggagttgcttcttatggataagcaaagagagtggttttttgtctgttttttagagggaatctactacaggtgaagatgctgtggacattgttgaaatggcaacaaaggatttgtatataaatgacatgagtaaaaccacaataaagtgatatattgaagcctattgaataataaaagaatatattggttcatactgaaataaacaaatagaagaaagctcttccttatattggattgccaactaacaaatacaaaagaaataatagaatttaaaaattaccacttggcaatcatcatcatcatcatcattgactcaggtgggaaacatcaattaaggctaaaactggtgggtgcaggtttgctgaccatgtgagtttcctagggctgctataacgtatcatcataaatgtggtggcttaaaacaatagaaatttattttctcacagttccagaggccagaaatctgaaatcaaggggtaggaaggaccaagttgccttgaaagatctccgagaaaattcttccttgcttcttccagcttgtggtggctccaggaacaccttcgcttaaggcagcataactccaacctttgcctttgtcttcacataaccttctttgttgctatgtctgaattttcctctgcctttctcttacaaggatatctttcactggatttagggctcaccctaaatttcgggtgatatcattttcagatccctaattatgtttgcaaagaccctttttccaagtaaggtcacatacatagattccaggtggacaaatctttggaggagtcacaaaccaatgcacaacagtgaaaataggatatttacagagtatctcccacaatatacttattaagtgccaagggaaaagtagatactccataatggagagacctggcaaatcaaggtcaatgtcatcaatagtagtacaaatgtatattgcatccctccatgcgtgatgcactatgaagagtaccgtgtcacttctaccacatttctgccaaaaatgcataatgtgaatctaattctgagaaaacctgcacaaatccaaatggagtggcattctgatacttccagaaacctcaaagttatgaaagacaggaagagaggatggagaggcttggctagttaaaaattgtactagaaaaacatttcttcagctctaaaagacattgccaggaggtaataatatttgagtaaggtctttgggtagagacagcgttttatcagtgataatttcctgattttgattatcgtgttgtgtaggagaatgtgtttattttatggggagtacacactaaagtatttatgggcacagggacattatttcaataacttactcctagagagtttagaaaatactatgtatatacagaaagaaaatttagtaaatatggcaaagtgtgaatatttggggattctgaaaagtatgtggcagttctttgtataactgctgtaacttttctctagttctgaaattatttcaaaataaaaagtaaaaaaaaaaagacttttgaagaaaatatctacttaccccagaggagtctggttcccaaaattcattgtggctggaacactgatgtgatatatgttttaatgcatataagctggtccctggcaactaagccagtgacctgactggttttctgaagcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaacagatttattccagttgcgtaaaacagtatattaaattctgaacctttgggggaaaacaacatatgtaagtatagacgttgagctgagaatttagaaccccgagcttgtcattcttattattatttggggatttttccgatgaggtcagaagccaacccacctgagtccccttcatcatcacttttctactaaagtccccatttagtagctgctgagttgttcattctaaaccttgcctttaatggacatttcattctattaaaaaacctgtgataatttaagtaacttttttgccactgcatgttagagattacaaatatcacatttttcactgcaagccatttatgtaccttatacaatatcagtcaacagtctcttaaaggagagtttcgacagcagaaagacatttaagtcagagaatatatgctcacaaaagcattagaaatattggaggatcaaagatcagggaaagctgctgctggctgtaggttttagaaatctctatcaagttttagaaaaaaatcaggaaggtgtggaaccagtgtcttcactgcagcactgacagtcatgatttgcaaagcacctggaggctagtgaaacactttctatctgctgaagctcatagagctgactgtcactgctggaggagcaaagtagagctttctgcctgtctttcaccttccaaatctcataactgctttttgctgttgcacctaacccagaactaaagaagttacttgtttccagccctgcgatacaggaatattagagaaaagctgagactgtgctaatctatcactagacaaactgacatagtggttaagagaatgggctttgaagctccggagccagatcacctgggttcagagccaggttcctccacctactatttctatgaccttggcagggtgcccaatttctttgtgcctcagttgtgacagttttgaactgtagctaatctccctacctcaaagatttttaagagttagttcaatatactatatgataatgcctgacatatgtatttctttgcaggaacatgggtaaagctggaaaccatcattatcagcaaactaacacaggaacagaaaaccaaacacctcatgttctcactcataagtaggagttgaacaatgagaacacatggacagaaggaaggaaacatcacacactggggcctgttgcggggtgggaggcaaggggagggagagcattaggacaaataacataatgcatgcagagcttaacacctagataatgggttgataggtgcagcgaccaccatgacacatgtatacctatgtaacaaacctacatgttctgcacatgtatcccagaacttaaagtaaaataataaatacataaggacagaaagaaagaaattattactaaaatatatgaatgtagaaaatggttttgcaaaaatgcaaataaagtgattaggcattgcataatctgtttggaactctttggtactcaatttttttttttatttgaggtatttctttccacgggaaccataactatttaactattttaggtttacgttatgtttgaggctaaatatactagcagctagcttatgtttaatcagcattgcttttacataaaggacactcatctgaaagctcaaggtagtatacttaagtcattatattttactttttcatgaaggccaaggaaaaatgccacaggtctttttactcttcttggtaggatcataattttgttaaatgtccataaataattaagatgcctctaaaggtttgctccataactataaagtaataaaacaaaatcttccaatttgaatttctctggaagcattgattgcaacttaatcaattaaacttttcacaaattgactttataatttcataatgttttaaattcattcaagactaggtatactgtaatagattgtaaaaaaaaaaaaaaagaagtcgtgagtcttcattctttcccgtatctatgtcctttccaatgtgaaattgtagcttcttgcataaagacgtgaaatcttcccgatccctttaatatgggctgcacatgtgacttttttttcccaacaaaatgtaatggtactccaggttgaggctttgtgattctttcttgctcctctgcctttatcatgagaagatgctcaagctggcctgttagaggatgagacttgtggaaccatatggagcagagctgattcagcccagttgtctcagttaaagccccagatgtgtgagagaggccagttgaaattagcaaagccagcctatagctgaccaatgatacacagatgagccaaaccaagcccacttcatattagttgaatttctaggagacttttgagaaaacaaaacaaaacaaaaaacactgtacgtcttgaaggttgtgtagttggttgtaattattgcagcaacaggtaactgtacatacacagtgacatgattacaaactgagcagtaagtatatttaaattcaaaaagtatttttgtttagcaatgttataatagtagcagtttcatctttttgatgctttttctaaatatacaatataatgctttcaaaaacattaatttagggaaaatttagagcatctgcattcataaccaaaagtatgtttatatttgttattctaccaagggtctataaaacaagtctaaagaatttattcattggcaaaatgaattttgcatggcaaaattttatggcaaaacatacaaatcagaagcaattattcattccttgcattttgcattctacactaacttgctgcctacgtcgaagcaaacaaggtaatttgaataaataaatggtttctctttaataatgttgtgcagcagggaagtcagcttctaaagaaatggttttgaagtgattaagaagaaaaagctttataagtattttaaggctattgagttactctgaggataagtaggataaatgttatgagtagaaagcagagcaaggtttcaagcattcagcaggcaaggtttcaaaacataatattagttggcataaataaaaataaaagttcttttcagtattgcttgagaaaggcaaaagtggttatttccagtcagcccactttaattcagtacctggtgaagttttccagctggggcatatggcgcatagaaatgacttatcaaaagaggggcttcaagatagttcaagaaaagttaatcttttacctataatgtgttagccattctgctaggtactgagaacagagctggccaaagacaatgattttaaatctgtgtgaaatgcagaataatagtatatgcaagacatgagaaacaaaatttgtctatgtggctagagaatgattcacagaggagaaaaccaatgactgggtctcgatttacgtttatagtttaccatttaggaaaaaaggatgacagtaataaaaaggaacagtataaacaaaggcatagggatgtgaatgagtgagtcacaatggaaaattccacccaccaggaacatggataacccaggacagaagaggatggaggtaaaatatgatagtactgatggtatattagttatttatttctgcaaatgaattagtgcaaaacttactggcttaaaaacaacaatattaatctcacagtttctgtgggtcaggagctcagcatggctcacctgggccctctggctcaggatctctcaggctgccatcaaggctgctgtcagcctcatctggagggacagtgcagggaggatccacttccatgctcactggtcatcagcaggatccagtttttgttggctattggcctgaggccaccctcagttccctgccaccctccgtaggcagttctcaacttctcagcttgtaagcaagcatggagagccagagagagtgtgagcaagatggatgtcaatcttttgttacctaatctcagacgtgacttctgtcacttttgccatattatatccattaaaagcaagttactagatccaacccactcttaaggaagtgggaaggaatataaagcaaggacatagatagtaggagggagggatcattgggagccttttagaagcagtccccaaaagatggtaaaagtaattccatccatcatgagtgacagtactaggaaaagaggtcggtgataaggatacatgaaattgatgagacagacagttggtaaatgatagggaacattttagtgttctactgaaatgactagagagcctgcataggtaggatacattgatccctgtgagtagggctaaacaatgctaacaatgatcacctgagacatctaggaaaagaagagcttcgaatgcccacgtggtggagacttgtttcttacttcttctacacaggcaagatgctgctggagggatgcttgcagcctaacctgactgccaaatatgaaaagagaaaagaggaggtgaaggacagagcacaatatcaatgcatccaagttgtccagtggccagagacagaaatctgaaataaaacaaccagcactggttgctcagagaaaaaaaaaaaaacaaagcttatgacaaaggcaattttcacaaaaataatatcaagaatattttaaaagataatttagaggattaaaaaacttcattaaaaattatttttgaatgaaataattccataggcaagtggaaagaaatgacattaacattgagaactgaatcagaaactgaaatatcaagttaaagaatcaggtctctgaaaaaaatcagagaccaaaaggaatgcgatggaaataatgaatgcaaatatgtaaataatcttaattcttaaagaagaaaaacatatcaagaaatgacaggcaatcactaaatatatgagagaaataagctcttggtctcaaaaagactttcttctccaaaagattgaaaggaaaatgaaattccattattaatgttttaaaagaaactcctgatcatatgttagtataattactgaattctgagaataaaacaatttatcctattgtaaattatacaaattgacccaaggagatacacattttcttctaagacactctctttcagccaaagtggtttatttgctattcattaaatgcagggcaccatcattcctagtcccattttcttctagtaggagcagcctttccccaactacacagttggaattggagagccaaagagagtgctgtaataattacattaagactagcagcagggtacaggaactatcccaggcaaatctggtcctgtggttctccctacccagatcttcagaaggctcatccttgcgatgcccttaggactttgcttaagtgtcagcttatccacttccctgaccatcccctagtgaattaatgaactactactcatgcaagcccccttaccctacttgatattttgcctcatatattatgcatttatttgttatatctctccacctgtcttagttaatttgtgctactacaacaaaataccagagacaattgtaaagaacagaaatttgttttcccatagttccggagctttggaagtccaagatcaaggaactgtcaggtttgattgtctggagagggctgctgtctgcctccaagatggcaccttgttgctgcatcctctggagaggaggagtgctgtgtccttacaaggtggaaggcataagggcaagagggccaaacacctagtgaaggctctttcataagggttttaattccactaatgaagaaggatccctcatgacctaatcacctcttaagagccccacctcttaataccatctcgttggtcattaagttttaacacctgaatttttgaagcaatacatccaaatttatgtccctcttagatgaaaaatatattcagtccattcccatagcccctaaagtattaactatttctagtatcaacttaaaagtctaaagtccaaagtctcatttaaatatttctcaatcagatatgggttagatgcaaaggtgtatatcatctgtaggcaagtgtccctttagctgtgaatctgtggaattaaaaaagttatgtgcttccaaaataggtggtgggatgggcacaagttagatgtttctgttccaaaagggagaaacaggaaagaagaatgaggtaactggtgttaagtaagtctaaaatccaacagggcaaacaacactctatcttaagccttgagaataatctttgactccatgtctcacattccaggaacaatggggcaagggttaggtccccaaggctccaggggactacaaccccatggctttactgagtgtaccccaagcagctgccctcacagattgaaattgggtgcctacagctctcccagactggcattccgcattggtgacagatctaggctctctgaggtggctctgctcccatggctccattaagaattgctctactgggggctctctgcagtggccccaacccctcggctctgctgggcttttcccaggttggggccttattcaacacatgagcaacagtcctctccctgggccccgatcctctctgaggggcgtcctttgaaatcttggtggaggtgaaatcatgccaccacaggtcaaggactctgtgagcctgttgaattagcatcgtgtggatggattctcctgtttatagcattgtggcttacagatcatgccttgcagagcagtggcccgagttctacctggcccactttagccaccgctgaagtggccagtgagcactgtaccagaatatggaaagaaaggacttacagtaacgttgggtggaaagccctgaggccccacagccaccctgggctcctctcttccagcttttctgttctcaaggcctagcactctgggtgtttgatgggtactgcagcttctaaaatgccttcagtgtcgtgctcccattatcttaatgaataatacctggcttccttctattcataataatcttatcaaatggtctcttgggtataccgttggttttctctcctaaacaagcttttaaaattctgtacatggccaggctgagcattttttcaaatctttatattttacttttgttttaactataaattccttcttcagttttttttctctcttctcacattttactataaacaggagaatccatgtagcaccctgaatactttgcttatagagatttcttccaccaaatttcctagttcattgcttttaagttctgcctcctacaaagtcctaggacatagacactgttcagacaaattatttttcactttataatgaggacagccttttctacagtttccaataccttgtttcttatttccatctgagacttcattagaatagtcttcgctaaccatgtttctaccagcattctgttcacaaccactttaagtaatctttgggaagaatgaacctttccctgtagctctgctcttcttctgagccctcatcagaatcacccttaacactccattcatggcaatacaggcttttttcaacatttacttcaaaagttttccagtctgtagccattacccaattccaaatctacttccctatattttggtatctgttatagcaacacccacttctttggtactgatttctctcttagtccatttttatgactataacaaaatatcacagactgagtaatttttaaagaacataaatttatttcctcacacttctgaaggctgagaactccaagatcaagatgtgggcaggttagttgtctggtgagggctgttctctggttccaagatggcaccttgttgctgcatcctctggaaaggagtgctgtgtcctaagatggcagaaggcatatgggcaagagggccaaacactgagtaaagctatttttataaaaggcttagtcccatttattagaaaagagccctcatgctctaatcacttcttaaaggccctacaatagtacttaataatatcatgttgcccattaagtttcaacacctgaattttggaggagacatgctcaagccatagcaccacttctatgagagcagggccctctctgtttagtttactgctgtatctatccttgtgcctagaacagacagtggcatgtcataggcattcagtaaatacggttgaatgaaccaatttttgaattaatgaatgaataaatgaacaaagcagaaaaattatatagatcaatttccatagaaaaaaattggaaggggattagcagatggattcaggtgagaccgcatagaataacggttctatgctagagaatagaacttaataatgcttaagttctagaatatgaatgcctgaggttcttagtttttttttttttttatcttatcttttttcctgcatggctctagacacatatggtttgatttctttatttccaggtctcctcagttgcgaaattaggatgttaattatagcttttgacatacaagaaacatcaaaaagattgaatgtcttaataagagtgaagcatgtagatcagtgactgctatgtaagtattctaatattattttgatcttttgaaaaagagataataccaacactacttaagctattctgatgaggaaaagataagaatagcataacagtaatgctaagccttataaagactgactaaatctcacttttaactagagaaatatcatttatgactacagatttttaaaaggcaaactattagcaatctggaaattagctgtgtgtcaaaagaacactggattatgacctatgaaaaaatatgaatgcaaaggtagtcaatagtaaattatcaaattatatcattatgtaaacacaacatagcattttaaaaactataattgtacaatcacgttctaaaaaggcatttcaaataattcagcagtctttcctgattaaagtgctaaataaaatataaatttaaaaaacttttaagtataaaacagggtcttcaccaaagtccaaccggaaaaattctaaaaagtgaacttttaaagccatttttattaaaataggaatcagacaggtatgcctatgatcactgcagatgttgttattactattagtcaacatgaaagttttaaaacgtttgcgataagacaagacaataaacaacactgacaaaagatataataaagtcaaaagcttttccatagattagaaaaatatttaatgtacagaatatttctgcaaattaataaatgacaattagtaacagaattattggaaatatgaataggaaattcacagtaaagtaaatttaaatggcaaataaacatgaaaatatgttcaacctagtaataaggaaatgtaaattgttttaaaagttacagaataccttttctatatcagattggtaaatataaaaaaattgatcatacaaactgttaataatagccgacatttataatcaagtactgatttatgctagggactttttcatgttctatgtatatcaagtcatatattctttgtaacaagcatatgactaaaactaatattagtctaatatatcaatactggtattattattcctattttacacccaattaaaccaaggaatatagcaatttagtaatttactcaaggtctcacaggtgaaaagttgaagagctataattgatccctagcagattgaccctagagattgctcctttaaccactacactaaattttctcattgctatcagcaacataagtaaagtgtccttctcatatatagctcattgaaataagaattattatagtttttatagagtaacccacactatttattgaaattagaactatggcctttggcccctcacttcacttctaggtttgacaatatttatttgtgaataagcattccaataggaataaccataagcaaattcagggaggtagaggaacacacagtttttaaaggaaaaatgaggagggtcacatacatttttttaagaaaattatccttggctacaagtatcaataatacgggtggcatcagtccaaagttggacaggcagttgctgggcagatatcctcatggaagtatcgtgtgtgtgtgtgtgtgtggggggggggggtggggctctggtggcctttgtgcaagattgtgtttttatgcagagtgttttgtgatagttattttatcagacacaaatgcctgaggaccctcccctcatggccttccgcagctccatttgtcagggaagtggctccattttgattctgacaactttcacacactttataggaaaaaaaagtacatgaatgtaaagatgtgtacaagattgtttattgcagcatgtagtactaaggggtggatgcatagcaataggtttaatgattgaaaacgtattgtatacttgtaatgaactttgtggttgtttttataatatccattcccattttcttaggatcaaatttatttcgacaatgtttcagccttcaccctcttgccaatagttcatgttctttgagagggagagtaacagttgactgcatttctagttttaaaagtggtacatgtgactgaggctttatcactgttagcaaattatcaaaagcaaataatgttgaacattgactgagaaaaaaacataattctggacatcatcttcagaaagtatgattcaatagctctagagttactcctccaagaatctatgttttccttttttgttaaccaagctctccaggtgtttctcatgcacagacatgtttaaaaacaagcatgaatatcgtaaatgtcaatgctgtatggtaaatatcacctagctgagactatgaattcatggaggaaagtgtaattaattactaaggtcagaggtacaggcaagatttgacactttattgatttttgagtattaagtgagattttgtttttgtgaggagcgtgtatgaccccccaaatagaagatagtacagagtggattcttggaagatggtgcagcataaagcatgtgaaatctttctccctaactagacaataattgcactggcacaatctgtctgatgtaactattttggagctctacagtgtattgaaggcttgcagttgaagacttggatgataacttgcagttaatttcagtaaatttcaactcttggcacaaaaccatccatcccctacctctcagccacatgacaggtagatctgcacatgtacctggaatagcttgaacatagcttgaagaagcctgggtgcacaaaaaggaccctttcctttatatactggggatctatgccctgattgttacttctgattgcagatgcacaaagaggctaaagccattgttgttttacctcctcccattgctgcaagcccttccccttctgactgaagtgactgccagggccaatgacttccccttcaccttcatttttctctttttccactttgtgagccagacattgaagactagctcattgaaaagaaaccacatacacgagaaaattagaaagtcaccactcatgcccaggggaaggcactggctcagaaaaggccagagaatacattaagtttgcccctgtggtttattcttggcacagagatagatagcctacaacaatcaagaaacaacaacaaaaaaagcagcaaatcctggtgaagaggaaggattcagtttccagcattgctgtaccattagattaacatgtctagttttcaccagaaatcataaagcatatttacaaaccaggaaaatatggctaattcaaaggaaaaccgcacaaacttcccctgacaaagaactgatagtggagctatgagacacagactttgaacaactgtctcaaagatgctgacagaaccaaagcaagacatgaagaatgccaagaagtcaatgtatgaaaaaaatagaaacataaatgaagagacagaaaacctaaaaagaaagaaaaaaagagaatttggagctgacaaaaaaaataactgaaatgaatagtcactagagggattcaagagcaaatttgatcaagcagaaaaatcagctaacttgaagataggaccatagaaattattgtctgagaaacagaaagaaaaaagattgaaataaagtggacagagactatgagtcctgtgggacaccatcaaacagatcaacatatacattatgaaaatctcaggggggaagagaaggaggaagaggaagagagaatatttgaagaaatcatggctgaaaacttttcaaatataatgaaagatatggaaataaacatccgagaagttcaatagattctgagtagaataaactcaaagatactcaaagtgagatacattatgatcaaagtatcataatcccaaaacagataatgttgaaagtagctttagaggagtgacttaccacataaaaaggatctcaatactattatcagcaaatttctcatcagaaaccttggagcatttcccctatggataagaggaactaaggtgtagaaaaaaatagcaaaatggcagcagtaggtccctatttatcagtaattgcttttaatgtaaatgaattaaattctccaaccaaaaggtagagatcagcaaaatagagtttttaaaatgattcaactatatgccatctacaagagactcattttagatccagaaggcagtggactgatatattcaaacttctaaaagagcaaacaaagaaacaacatgtcaaccaagaactgtgtaactgatttaattgtatattttgaaataactaaaaaagtataattagatggtttgtaacaccaagaataagtgctttagggaatggataccccatttttcatgatgtaattattacatattgcatgcctgtatcaaaatatctcctgtaccccataaacatatacaactacaatgtaccaacaaaaattaaaaatgttctatagctggcaaaactatctttcaaaagcttaccactagaactgccctgcaagaaatgcttaagggagccctgcaggttgaaattaaagaacactaaataataagacataaagatctcaataaaggtgaatacatatgcaattataaaagctaatggtgtggtaactttgatgtatgattctactttttgttctctactctatttaagagacttacacatttaaaaaaattattagtgtcaaagttagtattataactttagtttgtaaattaacatttttttctacataatggtagagatgaatatattaaaatttattagtttatgtttcttaaaacacaatgtgtaaagatataattttataacatcgacaactaaaaaaggtagtgctgaagctgttaaaggtgcagaatttttatgttattaaaatgaaatggtataaattcaaattggtgtaacaactttaggatgttacatgtaatccccatggtaactacagaaaaataactaaagagtatactctaaaggaaatgagaaaggaatagaaatatttcactacaaaaaaattagctaaacagaaaaaaagatggtaatgcagaatatgaggaagaaaaaagctataaggcatagagtggtttcactttccatgggtttcactttccagggtttcactttccatggtttcagtttcccatagtgaactgcagttcaaaaatattaatcaatactcttgtgcttttgaaccagaattaagtaaaataagggttacttgaacctaagtactgcaatactgtgacaaataagctgctaaccaagatggttattaggtgactaatgacaatccaggtaaagatttcatcctgctcttcagaatgacatgcaatttaaaacttatgaattgtttatttttggacttttcaattatgtcacgatgcctacataattcacctcataaatctcatcacatagggattttgtcatctcacttcatcacaagaagaagaagggtgaggacagtgcaataaatattttgaggaagaaacaccacattcacataatttttattacagtagatagctataattgctccattttattactactgtatttttgttaatctctttctgtgcctaatttataaattaaactttatcttaggtggttatgtgtaggaaaaaccataatgtatatagggtttagtactatccatgattttaggcatccactttgggtctgggagcgtatcccctatgggtaaagggggactactatatagaaaaaaaatcaaaatgacagaaataagaccctactacttatcagtaattacttttaatgtaaatgaattaaaccttcccatcaaaagacagagattggcaaaatagatggaaaaaaacatgatccaactatatgctgtctacaacagactcactttagagaccaagatacaaataagttgaaaggttgaaaatggatattctatgcaaacggtaataaaaattcagaagaatggctaaactaatgtcagacaacatagactttaactttaaaagattatgagatgaacaaggacattacatattaataaaagattcaatatggcaaagagacaatataaatatgtttattttttgtgatggttaatactgagtgtcaatttgattggattgacgaatacgaagtattgatcctgggtgtgtctgtgagggtgttgccaacgaagattaccatttgagtcagtgggctgaggaaggcagacccacacttaatctagtgggtgcaatctaattagctgccagtgaatataaagcaggtagaaaaacatgaaaaggtgagactggcctggcctacatctttctaccatgctggatgcttcctgccattgaacaacggactccaagttcttcagttttggaagtcaaactggctctccttgctgttcagcctggagacagcccattgtgggaccttgtgattgtgtgagttaatacttaataaactccattccattagttctgtccctctagagaaacttgactaatacatttaataacagactaccaaaatacatgaggtaagaaatgactaaagaactaaagggagaaatacacagttttacaataatattcagagacttctatgccctactctcaataatggagagaaccaccagacagaattataactaaggaaacagtggacttgaacccataataaaccaactatatctaacatacatatgtggaacattctacccaataacaataggatacacattcttctcaggtacatgtaggacataagccaatcacaaaataacaaatactgtatgattccacttatatgaggtacattgagtagtcaaaatcatggggactgaaagcataatggaaattgccacaggctgggaggagaaaggaatggggagtaattgtttaatgaatatagaatttcagctttgcaaaacaaaaatagttttagagatgaatggtggtgatggttgcacaacaatatgaatgtacttaatatccccaaactttacacctaaaatagttgttactcaaaataataaaaagtaaatcaatctctctctctctctgtcacacacacacacacacatacacacacacacacacacacacacacacacagagagagagagagggcagacagcacaagccaaagcaggaaggaacaaagcactttctatacttgggaaataacaaaggaccggtaaggctagacggcatagatagtggagataagtctagaaagttgggtaaatgtcaaatctagaaaaataattgatgctatgttatggagtttttttttccattataatttaaagcaaatacatttttggattaaaaaaataaaatgaccttatttgctctatgtcttgggaaaaaataatatggaaatatagatgggagaggaaagagaattgagtaagatactttgtatttttggtattttgagaaaaactatttcatctatattatatataaattgttatattctaacaaaagttgatttttatgtactcatttatatctccttttaataatattgagtacaaaccatttccctaataagcatgtacccccaaccagaatattaagagaatacagggctttggagtgcccaagaaagacatcatgatttgatatgaaaataagccattgttttgaccatcagcaaatgatcttagcaagtacagattcagtggaaaatagaggcagaagccaaactgctgtgtgtggaagaataaatggtggttgaaggggtaaagacagcatcatttttcttcaggatgattaagagtgactgctagagcaggaggccagcttgagggtaaccagatcattttagcacaaatacaacctaatgtagccaagtcctgagagagcaagcaaattcattcaacagtcatccagcaagaatgtccctcatcactcctttggtgctgcactttcacacagtatatctgtaatgtgatcatgaaaagtaattaaagaaacagtctgcactgtcagtaaagcattacatctaagtgcttattcaatgttactgcctttagtcatcagtattttcaagaaagagtaaaatattgttcttttttctaaaaagtagtaaatcatctaaattaattttatcttattcttattttcctccaaatgagaacatgtgctactccccttatcagttaatgatttgctgaggtacataggataaaatagtctttaaaaaatcttttgtttatgttcattggtttccattttctacctctatcttcatcctcatattcagcctattttaaaatacttctttcctgagttccattcttccaggctttcactaatgtaaccctgtacattacactggatatattggggatttttgttggctggcataaacttaccacaagaaaattttgtttctacataatattttatgaaagtactaaaagctaccactatcatctcttctagggcctgtcatgggccaggaaaatgacaaattagctgccaaatctaatgaaaggttgattaaatataaagggaagaaaaattcaaccatcctcatacactgacaactgaggtttcttgcttttttctttccaaatgcccttccaatgaggggaagacaaaattaatatctcatccacgatttcagtctggcagaaaatgaacctcttttacaaacaggttgattattaattagcattcctaaaaggttgttcattttgctaatcttaaacactgaaattgaaattgctgcagatcttgacaggcacccactgaaagtcctcactccttaaataagagcttcatcagaaactatcaaatcttttagcacagatttgtcccgatttttaaggcatacttttcttggggctttaattttcacttgattctattttactatttttttgtattaattccctcacacattttagctattagaaagccagcatgaagcgacgtgtttttgtaaaaaatagatttgcctcaacaaatttttactcagataaagaaagtgaaaattagatttagtttgcaattttgaagtagagattttaaaggtcatttatgttgtgtgcatgtgtgtagtggttgtgtggtggtgtcatttcctttttttgtttgccagaaccattctgaaataaaaaatgagtgcaatatattagaaataaaaggtatctgctctctcataatctataattggtgtgctatttcttaatgtttgttccatagtagatgccatgggtaatcagccataattatggattaagattcatattttgcatataggtaccctattgttccagcagtatttgttgaaaatattggattagaagttttaatgtagcaacaaaattgctgctgtgacatgataaagtaaatgaactgaatatataagaatgtcttctaaaatcaagctttcaaagatggtgtctttgaaagaaatcaagagaaagggttgaagaaagagagtgacatatgtactaaagctatcaatgaatgagtgagagcagatagcaacaaaaaacgattagcatgaagctttgtcttgtggcatgagtttcaaaagatctggtgctttttgaaagaggacagaagactccccaaatggatctgtagaatattgtaatttctatcaaaatgcacacaaggatttttgtggacataggcaagttcctcctaaactttatgtagaaaagcacaggactagaatagctaaaacaaccttgaaaaataagaataaagtagaaggaattactctacctgctattaatgcttactatatggctacattgataaaaaagcaatgtggtattggtgaagaaattgacacatacatcagtgaaagagaatagaaaaagcagaacttgacccctacaaacatacccaaatttttgacaaaaatgtaaaagcaattcagtggaattatgctgagtggaaaaggccaatcccaaattttccataatatattattccatttatataacattttaaaatgacaaaattataggatgaagaatagattagtggttgccaggtttatggaagttggagggtgggaggtggctgttgctatagaagggtagcacaaggaatacttatgataaaactgttattttgactgtagtcatggtcaaagaatctacatgtgttataaaatgcatagaactaaacacacacacacacacacacacacacacacacacatctgttgaaatctgaataagctcagtggattgtatcagtgtcaaactcctgcttgtggtattgtactgtagttacgcaggatgttacctttgagtgaatggcacataggctcttcattgtatgatttcttacaactatgtgtgagtctatagttatctcaaaataaaatgttaaaaaaaagcaggagacagactataaatggtttgatcttcgtcttctattttttttagttcctattgaaaaaaacattgtaagctttcaaatactacatttggatgatagccttatgaaagattttgtggtttgatgcatgcaaattattgctttaaaaacatatgaccagttagtcaacataatcaacttatgttaccaatcagcactataattaagaaataagaacatgataccaaaataaactcaaaatagatcagagacctaaatgtaaaactttaagcaataaaatatctagaataaaataggaggaaatctttgtgaccttgtttaggaaaagataaaattcatagatcagacctcataaaaattaagaaattcaaaaaccagtactgagggaatgaaaagacaaaccatagatagggggacagtatgttcaaactacacatctgataaacaacttgtattcagaatgtatcaaaacatctcaaaactcagtgtacaaacaacccagaaaagtacttacagccagattagctttgcagcatatgtcccctgggccctgcaaccctgtagattgatgcagtgagagccaaatggagacatctcttacatgattgtcagattttacttgttgaatgaggaaaacagaaaaaaatacatttttgtgcttttaaagggaaaagaaaccaacttcccctcttcccttctgagagaggctccttggatatgtaatggaagaaatgcacactctagctctttgatatataaataattctctctaggaaccaaataagttcagtatctccaggtttcacaacatagagatgtctctaaagttctgggaccaatttcttttgaaatataaatacctgttttttgttgttgttgttgttgtttttttgttttgtttttctttttttgagatggagtcttgctctgtcacccaggccggagtgcagtggtgcaatctccgctcactgcaacctccacctcccgggttcaagaaattctcctgcctcagtctcctgagtacctgggattagaggtgctcaccactgctcctggctaatttttgtatttttagtagagacagggtttcaccatgttggccatgctggtctctaactcctgacctcgtgatctgcctgcctcggcctcccaaagtgctggattacaggtgtcagccaccacgcctggcctaatctaaatatttctaagagaagtgaaacaaacattatttatcttatactatacatatttccatgtttcatggacctgcagctttgaaacatgggaataaatccaggtttattttctcacagtgacattatgctaaaattagaatatttgttcctcaatttcagctgagatccaaagatagaacataccaatttgttctagtgtcaactgtattgaactaggagctatgttctccataatctccttaatctgtatacttccagcttagagttggataagagaggaaatcccatattaggaggttaaagggaatcaggggcctttactctcagaaagatctaagtttgagagtcactgacaactacagaggcgctcggcttttcctcactttcctctactccaccagctcttcttcccaactgttgaccttgaggaccaacagcggttccaagcctgcccccagttgcagataacagaggccacactgagacatcttccccatagatccctccacaacctcccttatacagtccctctaaggaagctcaacttgcttgtctactcagatgtcactgccaactcctagtggtcctctgctccagtgcttcaagatgactgtttaatgactttatctgcaatactccaaaacttccctctgaaaattcacctccccagcaattcctactcttgtctaagacaggaacgggcaaagtatctacagtcccattgcttattttttaaaagaaaattttattaaaacgattattcccatttgtttctgtatcatctgtggctgctttctgctatacaacagaattgagtagttgtgacagaagccttcgggcctgcaaacccaaaatatttactgctggctctttacagaaaaggtgttgatgtctgctgtaatgtataattcctataaaaattccatattccattatgtttctcccttcctgactgaaccttcactgatgttctcacttaaataggacatgtaaagaagatggctaataattgatttaagaattgttttttttttttttgagactgaggtcttgctctgtcacccaggctggaatgcagtggcatggtcaagctcactgcagcctcaattgcccaggctcaagcgattctcccacctcagcctcctaagtagctaggactacagatgcatgccaccacacctggctaattttttctatttttttgtggagatggggatcttgctatgttgcctaagcttgtcttgagcctctgggctcaagcagtcctcccgccttggcctccagaaatgctaggattacaggcatgagccaccacactcagcctgatttaataactgttagttcatctccaaataggcacccctaaaaagttttacagaggtttagagtccagtgaacaattggagagggaatttccttgaaaaacattttgttgaacagctgtggcattctcccttgcccacagtttttccatcccactaccatattcttacacattttataggcaagacacagggatattctaagatcaagccttgtcagggagtgggatgagggttggagtagctttaagtagaccacataagtttgatactagagacttgtaactgcagacttaactggcaagagactggctatggtgcctatggcagcaaagtacataattgtgtttggaaagtaactgtattcccatcacaacttcaaaaaggatgcatgtctcccagataatacatatggaacctgatgtagagacatcagcataagactaatttagaaagaaccactttcaagacaacttccttcaaggaataggaggagctcagcaaaaagactggaattgttccattcaatgaagaagccaaggggctaggtatatcctctctgagtctctctttaattcattccaatcaggctgtctgcctacctgctctagcaaagataatcttttctagttcatctggaatatctattttgccaaattcaatgactactctttggtcctcattttactcaacttgtttttcttaaactgacattttattttatttatacactatataatttgttatagatttttattgtttatatttatggtgtacattgatggtttgatatatatgtattgtggaatgattacatcaggctgattaatatatctatcacctcatataaatctgcatctttttttgtgatgagaacatttagaatctactatcttagcattcttaagtatacgctacattattattaactgtaattacctcgatgtacaatagatatccaggcttaatctcctaactaactgaaaccttgtatcctttgatcaacatctccccattccacctgcccaccccagcccccactccctggtagcccctattttccaatctacctctctaagttagacttctttatattccacatataattgctatcatgcagcacatttctttctgtacccagcttatttaacttaacataatgtcctttaggttcatctgcgttgttgcaaataacaggattttctttaaaaaaacaaaacctgaatagtattccactgtttgtatgtgtatacattcatatgtatatgtgtgtgtgtgtataaacaacagataaattgataaaaagtgacatatgtatcacacttgaataatggctactgtgaataatgctccaatgaacacagaagtccagttatctcttcgagatactgatttaatttcctttgactctatacccataagtggaatttctgaatcatatggtcattctatttttcattttttgagaactctccatactgttttctataatggttgtattaatttatatttctaccaacagcatacaagggttctcttttgtccacatccttccaacacttgttatattttgtctttttgataatagcccttctgatagatgtgaagtagtatttcattgtagttttaatttgaatttccctgatgattactggtgtttggcagtttttcagtaccttagcagcatttgagtatttgccatcagtgacaactgtctcctttttgaaataactttattggctttaggaacaccatgttctcctggttttgttgtacctcactttctgttctcaatttcttttgctggattcacttcctctgcctaaactctaaatattgcaggactctgagcttgactctgggcccctctcttctcatcgaccttcttttcataggtgatgttttctgattccacagtttaaaataccatcaatatgctaataattcccaaattgatctcattatcttctatctctcctctaagctctcagctcataaaaccaagcactttaagtctccactaggctctctaaaaggcatcttatatttagtacggccaaaacataacaggctttccaacataggtaaatgttactgcattccattcagttctcaagtcaaagctagagcgtgtttgcttgctctcttcctttctactcaagtcagatccaatacattgtcaaagtcaacactaccaccaccaaagatcacccatccatccttttctctatatttataatgctatcacctaacctaagacagcaacatcttccatgtaaactactagaatcacttcttaacgactttcctgcttctattcttgctcctctcctctgcccaaaccattctatataacaatcagaaacatcttttaaaaatgtaaagcaggtaattttctccccagtttgaaacacttcatattaggaaaaaattcatttcctttaccatggcttgtaaaaatttacttaaaactgatttgatatttgcagtctcttatctcaactccacaaaagaatagaaaacagtatgttgtagctgggaaactgcaaaacattaatatggctgaggataaaggtagatatgtgaaactttggaaggtgatgagactgaaaatatagaaaggatgaaattgaaaaagacttaggaacttagaagttgagactttcctcaaggaatttgaacaataaaatgactatatcaaaaattacacatttttaagaccaactggcaataaactaactttggtttatcaatgataaacagtgcctcagattaatcattttagcagatgttttaggtgacccactcattctttcagcccacgtctgatttcagcaacagctgtggtgaacaatttctgcaaacaatgtcaacttttcatctcaaaagaggcccactctcagcgtttgtgcttcagtgctttcctgaaagcagcaggtctctcaacctggaatgagggacactgaatgccttaagggtgtctggagtcagtagataaatgccctggccacaggtcatgatttccacatatttactcagagagctcttttcgcccacagcactaggcagctggaaaactggactttattgagttttcttctttcactttctcatttaccctgttcactcactcttgcttcctgtaattgcctcccaaatatggcatccaagtccttgttttagactctgcattaggtggaatccaaaaattacagacaatcatgctgttctttattcgagaactattagttgagaataatgtgcttaaaaaaaaagtcattaagacatttcataaaataatggtaaatcttctaagagtaaaactagaaatgtatgggatgaaaagacagataccaacaaatgttaatactagttagtactattttccacattcttcagcccatattagtttttttggtagctatttcaactgacatgaggtggctctcagctgaacatggagttattgtttgctctcagtttcgtatcttatataatagcagtgtcaaaatcctgtgaaatctgagcaatcttcagctgtgaaggacaagggaagaaagtcttttgagacaaagggctcgtaacttggattcttgttttttatatgtatattttgcatttcaagcttcagccacaagcttttttttccccagcatatattttatgttttttctctttctcttacatgccttaatctacttcttcttttgttcaactaaatgtatgccatgttgagatcctcatagcataaaacctttcatttcagagttgtttctgcataattgcctaggcaaatggtattctaccattaaattgtttcactttttattgacatcattactgattaaggaggacaactaaattatgttaggttcaattaagtaggctgatgggacaatccagatgtaaagaaatgctagttatgtaatttttaaaaaagcctctgaaccctcctacactgactacatttccatcccactcttcagcacatgatttttttacagcaaactaaagtttttaaatgaaactaatggttaaaaattaaattatctttttggtaagtcctaaaagtacaagtttagtgtatatacatattgtcacagcaagccaaaatctaagaagaaacaatggagggaaaacatggatttctttgtcttataaactggaagagagcaggtgctttgtctgatttgcttgatacataccaagaagatgctcaataatgatcactcgttatcaatgtgccattggttatcacatcacaaggttattatgagcattctttatattaaataatggatagaagattactaaataccaagcacattgtaagtgtaaaataaatgtgttttccttggtatgccctattctcatttgttgattaatgcagcaatcattgctttatattgaaggttgaaaataaatttaaataaatagtctgtgaactagcgaagtccataaaaaaaggtttagatccttgttgttttgcagtgtggtaatggtttcagctttcttaagctctcctaagtaggtagcagtcatcttacgtagatagcagtctgatggaccagaacatggatatcactaataactctgtatttctgtctcactgtaagcaggctacgttattttcagctatttttgccacctatagtgctctatttagaacctcttagaatgtaagctagcaaactgacaattaaaaattaggtcttaattaagtaagggtcttgtgaaaatttagttattaaatatgtaatttatatgtttattctgattttcttgatgattataaggaaataactatatgtctattcacttcagtatttttaactagttaacagagaaaaaagttgaaattaatgatttacattagttagttctgtttagtatccagaatactttaaaatctcattaaccatattgtatgctatccttcaataatggatccccttaaataaaaaatattttggaacagttgattgctaatgcagaataaatagtaaaacaattgttggtagagattgagctccatataaatgtaagatgacaccatgtttaataaagagttatgcatcccatgggaacacaaaaatatatttcctagattactgaactgttgataaactatgatatgcacatttaataataataaagttagtaagtattttgtcaagtctgtaatatctgcataaacattctgacagagaaattgggagagaaaaagaaaataaagcctttattttcacatttagcattagaagagtggtagactccaccagaaataccaacttgggttgaaagagaccattttgcgctaagcttatattgatgatgtacgtattttggtgtgaggattttgccttgaaggtacatgccagctcgtaggagttcgatttaacattcacctctaagcactgaaaaatctgggttatggtcaacgcagcagcttgctacaaataaaattaagactcacctgagattctatgaattgctttactaaaagcctggttgtttaacattgttgctaaagttctgggaagaaaatccaaacacaacatataaaaataaatttccatggctcctactgtttcctttggaaaggcagataatacaattcttattgccttttatttacagatattgttacaggaaagatagatttgactaaaaatgtcatctaggaaaattttaaccaaaattagaaattttgctagtgatctgggttgctaagaatctaagcattaatacatgatggtcttgtgtaggtaatcttcttcagttgtgatggatgagagcccctgtataggatggggaaggaaagaattcagagaaataagctaatatctgagtaataaatttaacagaaatttgagaatgtccctagataaggctgaagataaaggagaactttgctgctttttagaaaggagtggtcaggactgatggaagaagggagaaaatggaagggactggagagtgtgagaacggttcccacaggctgagattaaggaaattaacttttcccttgaagaaaacatttttttcatggtagcaatgacagaagaactttgtgaaaaatgttatctaaagtccaatttaaggctgtttcatttctggttctgctgcatttttctggcatcatccccccaaaaatagccatgcaaaagtgtaccttgaaaattaaatgggaggtcaagaaagccaaagaggggagaatttagtgagagccagaacctgggaccagaagagagaccaaatacctcttttcactacttaatttcctcaaattccgagagagagagaactggatttatcacagtccactgggtaggataatagcgacttaaaatagacattaacaaaaaggcttatctcagaagtatagataaaagtaaagtacacatttttttgtatgattattagttaggtaatgaatgggtgaatttcttgggctgcctcactaatttgtgaactatgttgcgtatttatttaactctatatttctaccacattcttcttttctttcctgagtgtctctaacatattgatgaaaatgtgtaggttttgacctttaagggaagatgaattttaaggagcagattttaaaaaaattattcaaagtaagtaatatagcttacattttaaagatagtttatagaatatacatatatatatagacatatgtagagagactatatgaaggcatacatacttctatgtgtatgtttgcttttgtagatttgaagaattgtatttcttttattttttaatttataaagaaaggaggcttaactgactcacagctccacatagctagggaggcttcaggaaacttaccaatagtggcagaaggcaaaggggaagcaacacgtcttacatggcagcaggagagagagagagtaaaggagggagtgccacttttaaaaccatcagatttcccaagaatacactcattatcacaagaacagcttgggggaaactacccccatgatccaatcaccttccaccaggcccctcccttgacatgtggggaaaacaattcttttttttttcaataggttttgggggaacacgtggtatttggttacatgaataagttcttcagtggtaatttctgagattttggtgcactcatcacttgagcagcctacattgtacccagcgtgtagtcttttatccctcaaccctctcccaccctttccactgagtcctcaaaatccattgtatcattcttatgccgttatgtcctcatagcttagctcccacttatgagtgagaacataacgatgtttggttttccatttctgagttacttcacttaaaataatggttttcaatcttatccaggttgctgcaaatatcattatgttgttcctttttatggtgagtagtattctatggtatatatgtaccacattttctttatccaattgttgattgatgggcatttggctggttccatatttttgcaattgcgagttgtactgctataaacgtctgtgtgtatcttttccatataatggcttattttcctctgggaagatacccagtagtgggattgctggatcaaatggtatatctacttttagttcttaaaggaatcttcacactcttttccatagtggttgtactaggttacattcccaccaacagtgttaaagtgttcccttttcatcacattcttgcccacatctattattttttgatattttgattatggccattttggcaggagtaagatggtatcatattgtggttttgatttgcatttctctgataattagtgatgttgagcattttttcatttgtttgttggccatttgtatatcttcttttgagagttgtctattcatgtccttagcccactttatgatgggatttttttcttactgatttgtttgagttccttgtagattctggatattagtcccttgtcagatgcatagattacaaatattttctcccactctttgtgttacctgtctactctgctgattatttctttggctgtgcagaagtttttttactttaattaagtcctatctatttatctttgtttttgttgcatttgcttttgggttcttggccatgaagtctttgaataagccaaggtctagaagggtttttttctaatgttatcttctagaatttttatggtttcaggtttcagatttaagtctttgatctatcttgatttgatttttgtataaggtgagagatgaggatccagtttcattcttctacatgtggcttgccaattatcccagcaccatttgttgaatagggtgtcctttctccactcttatgtttttgtttgctttgtcgaagaccagttggctttaagtatgtggctttatttcagagtccactattctgttccattggtctattgcctgtctttatacaagtaccatgctgttgtggtgactatggccttatagcatagtttgaagtcaggtaatgtgatgcctccagatttattctttttgcttcatcttgctttggctatgcagggtcttttttggttccatatgagttttaggatggtgttttctagttctgtgaagattgatgatggtattttgatgtgaattgcattgaatttatagattgcttttggtagtattgtcatttttacagtactgattctacccatccatgagcgtgagatgtgtttttattagtttgtgtcatctattatttctttcagcagtgttttatagttttccttgtagagatctctcacccctctggttatgtatattcctaagtattttatttcctttctctgcagcaattgtaaaagtgattgaattcttgatttgattctcagcttggtcactgttggtgtttagcagtgctactgatttgagtacattgattttgtattctgaaactttactgaattcatttatgagatttagaagctttatggatgaatctttacggttttttaggtacacgatcatatcatcagtgaacagcagcagttttactttctctttaccaatttggatgccttttatttctttctgattgctctggctaggacttccagtactatgtgaaatagaagtggtgaaagtgggcatccttgtcttgtttcagttctcagaggaaatgctttcaacttttccccattcagcataatgttggctgtgggtttgtcatagatagcttttattaccttaattatctgccagttttgctgggggttttaatcataaacgttaatctattttaatcataacgggatgctggattttgtcaaatgttcttctgcatctattgagatgatcatataatttttgtttttacttctcttgatgtggtgtattacatttatggacttgtgtatgttcaaccagctctgcatccctggtctgaaacccacttgatcaaggcgtattatctttttgatatgctgttgaatttagttagctagtatttcgttgaggatttttgcatgtgtgttcatcagggacattagtgtgtagttttctttttgtattattctttcctggttttggtattagggtgaactgcttcatagaacgatttagggaggattccctctttctctatctcttggaatagtgtcaataggattggtactaattcttcttttaatgtctgatagaattcagctgtgaatccatctggtcctgcactttttatttgttggcaatttttaaatcaccaatttaccactgctcactgcttgttattagtctgttcagtgtttctacttcttctggtttaatctaggagggttgtacatatccaagaatttatccatctcctctaggttttctagtgtatgtgtgaaaaggcattcatcgtagccttgagtaaacttttgtatttctgtagtgtcggttgtaatatatcctgttttgtttttaattgagtttatttggactttctgtcttcttttcttggttagtctcactaatgttctatcaattttatttaccttttcaaagaatcagctgtttgtttcatttatgttttgtattttttgttgttgtttctatttcatttagttttgctctgatcatgtttgtttcttttcttctgctgggtttggttttggtttgtttttgtttctctagctccttgaggtgtgaccttagattgtctatttgtgctctttctgactttttgatggaggcatttaatggtatgaactttccttttaacactgtttttgctatatcccagatattctgatagtttatatcactattatcattcaattcaaataatttttaaatttccctcttgattttattgctgactcagtgaccattcaggagcaggtcatttaattttcatgtatttgcgtggttttgtgggttccttttggagtggatttccaattgtattccactatggtctgcgagagtacttgatataatctcaattttcttaaaattgttgatacttattttgtggcctatcatatggtctatcatggagaaggttccatttgctgatgaatagaatgtatattctgtggttcttgggtagaaggttctgtaaatatctattaagtccatttgttcttgggtaccatttaagtccattgtttctttgttgactttctgtcttgatgacctgtctagtcctgtcagtggcatattgaagtctcccactattactgtgttgctgtctatctcatttcttaggtttaatagtaattgttttataaatttgggagctccagtgttagatgcatatgtattttggattgtgatattttcctgttagactagtcctcttatcatcgtatattgtccttctttgtctttttaaactgccgttgctttaaagtttgttttgtctggtataggaatagttactcctgctcattttggtgttcatttacatggaatatctttttatacccctttaccttaagtttatatgggtccttatgtgccaggtgagtctcttgaagatagcagatacttggttggtgaattcttattcattttgccattttttgtctttcaagtggaatatttaggccatttacattcaacattagtattgaaatgtgagactctagtcaattcattgtgccatttgttgcttgaataccttcttttcatcatattgttttacagttcctgtgagttttatgcttcaaggaggttctattttggtatattttgaggattgtttcaagatggagagctccttttaacattttttatagttcttgtttggtagtggtaaattctctcagcattgtttatctgaaaaagaatgtatcatttcctcatttatgaagctcagtttaatggatacaaaattcttggctgaaaattgttttgtttaagggggctaaaaataggaccccaacccttttagcttgcagggtttctgctgagaagtctgctgttaatcagataggttttcctttatagtttaccttatgcttttgcctcacagctcttaagattctttatttcattctgactttagataacctgatgactaggtggtgaagcaatgacctttttgcaatgaatttggcaggtgttctttgagcttcttgtatttggatgtctagatctctagcaaggccaggtaagtttttcttgattatttcctcaaatatgttttccaaatgtttagatttctcttcttcctcaggaacaccaattattcttaggtttggtcatttaatgtaatcataaacttcttggaggctttgtttatttttttaaattcttttttctttgtctttgatggattgggttaattcaaaagcctggtgtttgagctctgaatttctttcttctatttgtttgattctattgctgagactttccagtgcattttgccatttctctaagtctgtacttgatttccagatgttgtgattgttttttattcatgctattttactggagatttttccattcacatcctgtatcattttttttatttctttaagttggacttcacctttctttggtgcctcttggattggcttaatagttgaccttctgaattctttttttttttttttgttaattcagagagttcatcttggtttggatccattgctggtaagctagtatattttgggggtgataaccttgttttgtcatattatgagaattgtttttctggttccttctcatttgggcagactatgttagagggcagatcagggactcaagggctgctgttcagattcttttgtcccattgggtacttccttgatttggtgctctccccctttccctagggatggggctttctgagagccaaactgcagtgattgttatttcttttctggatctagccactcagctgagctgccaggctccacctggtgcttgagagtgtttccaaagagtcttgtgatgtgatttgtcttcaggtctctcagctgtgtatactaacacctcctccggtggaggcggcaggggagtgaagtggactccatgagagttcttggttgtatttttgctaagtactgctgattttgtgttcgttggcctcaagccaggaggtggtgctttcaagagcacatcagctgcagtagtatagggaggatacaagcttggcctaggatcaggcggtgtgtggggccatggagctcccaggagactatgtcctttgtcttcagctaccagggcaggtagagaaagacaatcagtggagggcagggttaggagctcagactctccttgagtggggcttgctgcagctgctgtgggggatgagggtgtggttcccagagggattatggctgcctctgctgcctcacacaggttgccagggaagtaggggaaagccggcaacctcaggcctcacccagctcctatgcagcctgcagcctgaaaggctgatctcactccctctgtgcccctgacaacaggactgagtttatttccagggctgagaacttaccccaggttacaagcctcctagctgagaaagaaaagggactcagctcctctgctgccccacagagcctgcagcaacaatccatccacttcaaaaagtctgtggaagttctcagctttcctggtatgttcctgccgtggttcttggagaaaaggttcacaatttgggtctccacacactgtcctgcccatccaagtgggagctgcaagttagtcctgcctcctatctgccgttttccagaactgtatttctttacccactcatttatttgctgtttcctatattttgtacaaaaatgactaaaaattataactaataaaggttattttcctacatcttccctcttccaaggctttttcattgttttcgttaatgaattttttttgaaaaaagaaatgaatattatgttaactataatattaattttcagaaggatagtaagaagacgagtcccaaatcccaatcctcagaaataaacactgttaacacttgatggacataattacagatatgtctgctggtgtgctggaactggcttgtactggcttctgagaactaattgtgtgcatcttgtcccagctctgtacccagggacattacattagtagactgaaatcagtcatgatgggagtattaacaccacggaaatagactacactcagaggctctttttgtgttgctgttttttgttgttgttttgaaagccatttactaaagatttgcaagcccatacatcactgaatatatcactatgaacagatatagaaagacagctaaacattttctataaggagacagacaaaaattacctcatggtctacattataatatttaattaaatgtattcaatttaaaaatatttttaaattttagaagaaagagaaattgaagtgaaattaaaggaattgctaaattctggctggtggggagaggcactattatgggccctatataagccccagtactgctcactcttatcatttagggagggagaggacagttcactttctgtgcagctctcacctttccaggagtctgtcctgaagattttagctgccttggtgttcctggactttcaactgtctctttaactcagaaagttcacggggcttagctcattctctgctccgtagcctcaaaactctctcaaggcagtaagctaggcaggcagccatggggctctccttatttgttttccaactctcagtcatgagtgtcatttctacctgatgtctagtgttttagaaataattgtttcaatatattttgttcattatttgtttgtttcaggtgagagagggaatccagtttctgatatcccatgtggatagaagttctaaggatatgtgtgcaaatataaagtcttttttcaaattatgttgatactgtggatagtttaacattccttccaataattccctacctttacaaaggtctgataaatgccagcaaaatattagatggtgaaaccttgataaaatgaacggtaccaggtaaatattggtaattttaaaaaagatgaataggccatgacatctgttttgaacctaaagctgaatatcagaatgaatcttctgcttttgtattagcatccatggactgtcaagcctttacattttattagggtaacaataatcaacactgtatttataacatgcattcatgatcaaacatcatatttaataaatgctgttgaattaatgtagttttgtttagaaatgcagcctgaataaagtattacaagacaaacataaaattacatttttaatgtgcagttttgataactgtatattgttaaatatatatatacaattttgaggagaacacctatctcaattaaaattcttttcgagcatctacttttaatattgtatgaaggaagctacatcagtatcaaccaagcctcttttctttagaaatgtatgattttaatgaaatttaccaacctggggattgtgacaactaattaacatcttacttatatacactagatatttctgttcactcagttgtatattcatgtattcaacaaattgttttatacagatgctccttgacttacaatggagttacgtcacaatgaaatcatcaaaagtctaaaatatcataagtcaaaaatttaataccctgataagctcattgtaaaataaaaaaatttaagtaaaaccatcataaattgaggactgtctatgtaatacaaatattctgccataaataaaatattgttaaaagtttaagttgttctatagacaatttagaatgtaaaataatgcttataataataataaatgttctatcaggtattatagaatactagatggtcctacattttagttttctagataattgaagttttccctaaatagaatcaataatttccaaaagggttacctacttaccacatatctttctaaagtacattccatgtattttgttctttctacatagggcaaacttttaaaatttatagtttcactaataattcagtgtcaacacttgcattatcaaataccgtttttgtggctataatatattattgtctttagaaaatgtgtgaaattgatgttccctacatgaaattttccaagactttatgcctttttaaatatgtcagtgttttatagttttcctctgtctttctttattcaggcttttatatggcccttttctagttctgtagtgattctgtcttcatcagcttttcctctctcaattctaatctattgtgaccagctcataaggtaaccaagctaattagaataatgagtttaataaaattggtctgtgagtaatgccttaaaatatggactttatagtaaaagcttcactgtagtcttttaactactggagacttttccttgttttcttcctgcttctggattcttgaattgaaattgttctttgaagttttacatttaaactgcactttcacatctagaagaaaaatcacatctgtaaactacacccaagtccagggtgataaagccttaatctgaaagagaccaccatacttctgagatgtatctaataaatgtttagcttttcaagaagattgtgcagaatatacaacccccaaaatacacaagtgggaagagtgttttcaaattacctcatttgttggttgttgatgtaatttaatgaactgcaatatacccttcagattaggctcaaataacttaccttcttggaagcaatttctgacctttcagatagagctgatagattcttcctttatattcttcctacaccacaaattttttctctatcttaatcccattatatacatatttgtttacatacaagtcttgctttttagattgaaagtttccagatgacaagtagagtaacttaaagaatctctaagccaagcacagtgccaacataaagtaagagctcaatgaatgtgcattgaatagatggatattccctttagcaattatggaaacaacatgatattttatgaaatctatgggattaaacaaatagcatataacgtactgtgttatgtgactaaggtcacaaagatgagtaagatataagcccttactgtcaaaaactagacatatgtaaaaagagataaaatggtacacaaataaccgtggagctgtattagttgagataggccaagatatgctctagttcaagttggtccaacctgtggcccatggactgcatgtggcccaggatagctttgaatatgacccaacacaaatttgtgaactttcccaaaatattatgagttttttttgtcattttttttctttttcagctcattagctatcattagtgttagtgtagtttatgtgtggcctaggacaattcttcttcttccagtgtggtctagggaagccaaaagattgggcacccctgctctagtgagtaatgagtaaaccctcaaatctttgtggcttacaacaatagaattttctttctgcttcatccaagttggaggtgggctagaaactttactcactcctctccgaaccatgacacagggatctgggcttcttctgtcatgtatctgggccaactctgagtctttgcctccaagaaatggatgggagagacagacagagggaaatgggcaattacaatataccgttccatgaggagccagtttgaaatagacatgtgtcacttcttgtcacatttgtttggccagaacttgctctattactctgtattggttcaaggggctcagaaatatattcttcctgtctgcctaggaggagaaaaacaaatggtctgattagcactgtggtatgcagcatacagtattgcctctagctcagttgccaagtgcaagtatgaagtcaatatgtacaggcaacttataaaggaacaatttacttatataatacttcaacttatttcttatcactatactccaagatgttttcctgacgtgtcattaaattacaagtataaaaacctctctttagacaagaaagcataacaatcacatgcatcttagcactgctgagcttttatttcattcacctcctgataaattgctgtttgtaaatattgtgttaatgtctgttgagaccagaacaatggatctggtaaaaaattgattcaattaagagataaagaatgaagtttaccattattttacctttttggtgacaccaatagaaccatgtatttcgtcattcttgcattgctataaaggaatacttgacactgggtaatttataaagaaaaaagatttaattggctcagggttctgcaggctgtacaagcattgcactggcatctgcttggcttccagggaggccttggggagtttttactcatggtggaaggcaaagctagagcaggcatatcacatggtgagaccaggagcaagagagagggggaggaggtgccacaagcttttgaacagctcgatctcatgtgaactcactattgtgaggaaagcaccaagccatgaagaatccaccctgatgaccccaacaccgcccatcagtctccacctccaacaccgggaattacatttcaacatgatatttcaaaggaacatccaaagcatatcaaaccatttcttaaaaaaaacttggcattttattactttactatggtttagtggtataattctttatgctactatccctagagaacagacatatgtgctgtgtatgtgtcacacacacacagaaacacacaaggggcccatttccacacatatacataaatatcagtggtcttggcattgacccaatgtctgaatttgtaccttcagacatatgggaatattttcatctctaaaaatcattttgtacattaatgtttaaattatagcttcatatttgatataaaaattctgacttctaacttaatatgtggttattatgctgctactcagtgaatgtattttcaacatttaaacattttgtccttcaaattattaatcatttttcattctaaagatgactataagaagtacaagaaaaacattatagaataaaagtacgtatgatttggtctccatattttacaaatgaagaaatggcttactactggctaagacaagaactcaagaattgtaaaaaaaactgtataggttttggattcagacacacctggattcaaattttggctctgttgcttaatttctgtgtgaatatgtataagctacttaatcttcctaactttcagtctttttatttataaaataggtgttacagtacctgaatttcagagttgctgtgattagatgaaattagataattagatgaaagaagaagaaagaatgtagctgtataaaattcttgttatcagcagcaaatttctgactctctgataataataattggatattcttatactactactactaatactagtactattatcagtttctttctaaagtccttaaggacttatcagagcaacttcaaactaaaatagaatttaaaagtgtacttttctttttcatttgaatactattattaacaggttgagttttggcaaatagtttccctgttaatataatttcttgaatttgacaagtataacaaaatatgttatctgaacacagtggtaataacataataattgaacacatcacagagcagagaattaaaatgatgtagacttcagaaatttcttgtattgttagaaaaacgaataaatggcaagaaaaggatgatttattgtatggctgttatctttttaaatcatcttggtagaaggtataggaagtatctttctatgcattttccatcatcatgggttcatattgagagaaatcattctattttttttgtcaatgatagtgtctcattgctaaaacaactgcttgaaaacagttttcaaaaactagatttcactttaaagaaaaaataaaaatctacactatttccacttatttacattttaaataataaaattacgttaagaaacaaaacaaaataaatacgtttgccaaaatctatctgtctttgttcttcacatcacttcattttattttaacaaatttactgaggtaattcacatgccatacaattctcctatttatgcacattacttcttgaataagatattcctatgcctatccaatctaagaatcccaagaaaaatcaaaataaacatatcgatattgaatatcaactctgtaaaaacgatcagaatagactagaataggtgctggggtgagacaattatttatatgttttttctctcaaggtattaactttcaaattagaagaattggacataggtacattaataaaatatttaaataaaatattaaaatatgttatatataatagaagagatactataacatactcaatgactaataataaaataggggtcataaaataaaagtgatttaggaatttcaaggaagaatatatattttacactatattagttgataaaaatttcctagatgagataaaatttaagttaggagttcagagaaggccagaagagaaggggagttttcctgggtaaaggggaaagaaggggtcaaaacatcaacaaaagcaaaggagtagaaaaccataagactccctcaaggagcaatatgtgaaaaataatcagctggaacagagtgttgcctttgaggagaattataatgtattctccagctgggactcatgggcaaggttgttagccagaagatatacctaagcccatccaatctaagaatccaaagaaaaatcaaaataaacatacaaatattgaatatcaactctgtaaaaaaggttagaatagactagaataggtgctccaaaaagccacaggatatgcagcatagcttatcatatggaaataccatatttccttgggactaattaattgaagatgtgatttttgtttttgaaaactcatataaattggaattttatgtcattttcaagtgtttcagctgctctccttaaaaatcatgagtatgggtttattctccttaatcatttcagctttttagtggaaaaagctgattatcaagaattaaaaaagacaagattacgagatcaattgggtcctgttggtggaaaaacttaaatgtcagattaaagagcttggactttgtgttagaagtaaggagccttagaagaatgctaaactgtgggaaagtatactaaaaaatctttcaataaattaatatggcaacttaatatacaggatgtatgaatgaggaaattattattattattatactttaagttttagggtacgtatgcacaacatgcaggtttgttacatatgtatacatgtgccatgttggtgtgctgcacccattaactcgtcatttacattaggtatatctcctaatgctatccctcccccctccccccacccacaacagtccccggtgtgtgatgttccccttcctgtgtccatgtgttctcattgttcaattcccacctatgagtgagaatatgcggtgtttgtttttttgtccttgcgatagtttgctgagaatgatggtttccagcttcatccatgtccctacaaaggacatgaactcatttttatggctgcatagtattccatggtgtatatgtgccacattttcttaatccagtctatcattgttggacatttggcttggttccaagtctttgctattgtgaatagtgccgcaggaaacatacgtatgcatttgtctttatagcagcatgatttataatcctttgggtatatacccagtaatgggattgctgggtcaagtggtatttctagttctagatccctgaggaatcgccacactgagttccacaatggttgaactagtttacagtcccaccaacagcgtcaaagtgttcctatttctccacatcctctccagcacctgttgtttcctgacttttttatgattgccattctaactggtgtgagatgatatctcattgtggttttgatttgcattttgaatgaggaaatattataggctgaaaccagcttagaatgtgcaaacacaaatgatttattaaggcagttgcatcattttcagagccaattctattatgtgatttataaaaattgtttaaggtctgctacagtttgaatgtctcccacagaatttatatgttggaaacttaatccccaatgtgacagcattggcaggaggagccaaatgggaggtgtttaggtcttgagggcaggatataaatggctgtcaaaagaggatttgctctcttgtgcactttgacctcctgccttgtgatgacacgggaagaaggcccttaccagttgccaatgccttgatcttggactttccagcctccagaactctgagggaataaatttctttttttttatattttactcggtttcaggcattttgttatagcagcacaaacgaattaagccaaggcccattgtccttgactaattcttgaagattagagggctcacttcattggagtccaatattgctaatttaaaatctaataattgtatatcatcaaaaaaaatctgtgaaggcaataaactttcctttatggaaataaaaaagacactaaattagttatgccatatcatttcaaagttgaactaatagaaaatgttacccattaatgatttatgttgtctttatcagaaacaaaaaatgccttccaaatacattttatcaaaaatcatttaagaaatacatctcgttttatataagaaattaaagtgagtctaatcccaaactattataaataacaagtgttgatctcctcctcagtcctccaagaaacagaaccggcaaatttctgaaattgttctaaaaaaatcagtgattatttcaaaagctggtaacagtttttgaagattagcattcttggtggaatatttaatgagcagtttagctgtagttccctagcaaaatgaagaagtccagaaattgtgaaaaacatatggaggcaaatggcaaggttcaccatcccctgcccagtgggatctcagctacatccatgtgatccctcagccatatttaggtctttcgatttctgcagatgaaagaacattctttcacaagaaatagagaagctaccatgataataaaagctctttgggtgccccatcagatgtaagctctccttgatgatgatgtcgattatcatcctgttatttttggcatttattcattttctctcaggcatgggactttgcctcataataagtaggagggcctcaatttcttgaagctgccagagcaaccatattccaactatcatttttttcacaaatgcttacaagataatgtatagtgaacttcctggttgagaacgtgaaatgtttttgtacatttctgaagaatggcaaactacctagcttaaataccccgtgcctaatttccactaacattgttcaagagtcaaacctcataaaccccaaagcatatatagctaagggtggaataaaggtgggctcagaatgcttaaagcccgttatgtcccatgttataaaggactcagaactaacttctacccctggtactttccttatgcttctcttaatgaggtctttccaaaagatataggtgtcattaactcctggaaatcaattcttccttcaatattgttgcaggcattaaaccagaagtgactattaatatcaaaggaatatttaagttacaggagaattagtatgaaatatacattcatatacattaatatgaagtatacactcatagggtattgttaggtgccataggaaattgagaaacctgttatctttccacaatccaaatatttaagaattaactatagaaacatatgtacataaagaattgtaaacaacagtatgacaaattttctatcaaattttaaaaatgtaggaagtaacgacaatctaagtggtataatgcatatttaatattttctagggatgtatgtatgcttgatatatttaccaactttgatttttcaatgtaatatatacactttgagaagtaaatttaggtgttcataaattaaggagaaagtagccaataaaaatgaagtgtcagtttcatttgaatagggatttttaaatgaataatttacaatatgtagagagagttataaaacatgaaaaatatttcaaatagtataaaatatatgtgaatatttatatggtgccagaaagaatatcttagaagaaatacaaaggaaataacctattttactacaaaaatatgaacgttttaaaacccaaaacaaattaatggcttattgctagctggaaatttctatgcactctggaataactatgaagcaagaccaacattctaggagaaaattatcagtatttgttaagagcagaaaaatgatcattttaaaaatatattaattctcaatctaagagtattctagagagtactaataaatgtaaggaaagataaaacatcaaaatatcaccttaatacaaaaaggagtggaaattttataattgactaacaccaggttataggttaaattaattgtgctacatcttataacagatcaagagtcaccattgaaaaatcattcttgaaaagagcatatcttgctgtgaactttgaagagactatttatttatatgaacaaatacaatataaccttaaatgacatcaaggaaaaaaaaactatttttcagtacaattccaatttcaaaaccttaaatataatgaatgtcacatgctagactattcctagatactcttgcgtttggggtttatcctcctaataattatgtaacaggatgttataacactatcgaactaccctggttttagtttcagctaaagccccaagactattattgagaccaccatacagaaattgtaaagaggagtcattaacccttattaggaacacttagcctgtgaagataaaaagacccaggattagagagaacagtttgttgatgtgtaatgagtcctacacacttgtaagatggaggggtcagtgtgcttgcccttcaaatcatgctttaggaaaggggattaaaggagatgtgcaaagagtttaatatacaagccgaatactttggagaacacagtggacttgcgtctgccttacagacacacctgagacatctaacatggaaggatctggttggctggtttatgacagcagagggaaggagagttggtgtcactcgccaactgacactcctagagtctttctggacaaaagatgcattagtgttaatggcgaagctagggatgagcgacacatgtgagtgagagttaactttggtactctatagtgaggtgaattgtcagatttctcacggccaaggaaagagccagcagcagccagagatgaattgccccgcatgaagagaacgcttgttaagaaattcacagcaataagttggtatctccaaagagctataataacactcagaaaagtaagggtcagcttaaaactctgtccattcccaggaacacctcatgacaacccgaaaaagagaagtaggactttccctgcctctttctgccactctaaacttgctcacccacaatcctggtgaggatgggagctgagaatgacaagctggagatgaagatactgcagagtaagtcaggaaagagaaaagaagccaacggggcatccttgttggaaattttacattttatttattattaggctgaacaaattcattactataccatttttattattagaaatcaattagaaaactagtacgatttattccatccaaatttcacccaaaggaaagggagaaatttagcttcaaatattagacttaaaaggttagcagcatacaaatatagttgctttcacattgaatatcacgtcatgcttgatcaatgcagctgctatataaaaataaagttgtccccatttcttgtattttagagaatccaatatctacctatctcccccaccacagtgtgcccaggattttcctggatatagatgattttattcctgttcctgcctcatcacttatagctgtttatttctctctgcccagcactaattcaaacattacaatacaagtcctctaccttgatatttaaaaaatatctctcacaaagggagttatatttaatagactcctgctcacaacttggggttataggcagggtgggggagtacttttttgtgtattataaaagttagcataaaattaaatataaggcacactagattttagaaattccttggccatattcacctcactgaacttcattctggttagttttcaaccctcaagttgcccaattcccggctgtgttgctgaccttcacaatcctgggagatcatcctatatgtttcccaacttttccagtattagttatggggcctgggtcaggttacttagcatcttcctatctttctttccttttcccttaaattgggatactatgagtagctacctcacaggattactgggaaaattaaatggactgacatgtataaagcaattagcttagtgcctggtacagagtttatgtttcataaggtactcagcttgcattttgtttcttctactcatcataagtatgccctagagggtaaggtagaatgggagtggtttccttcttacatgaaaagaactcctcaaaatgttttcctaagtgaaacagttctcactcccaatacaatgagttacctccttgaaaataatattattttcctctcctggacttgtatgtcaaaaaatacagtcaaaagaattgtatgaaatagactaaaatattatttatgtgtatttctggatataaagttgtgaaagttatttttatgcatattgtattttatatatcaaatctgaatttcttttctaaaaacagagatcttacttattaccaccatgccttactaacaatttcatgaatataggcgatcaatgaacttaatcaaagaaggtctgggacattgagagtggtgacttaggaccctccttcctacattagatgctcacttctggcccagagcaagtgatgaggcctccaaggagggttttgcagtgttatataccacagcagagtgagggttcagtctataaaatatctctattttatacagtttgtatgacagtttccagggagtcatgcctcataaattcatatgttctgtatttatttataagcaatacttagggatagcctattaaagaattaaataaagaaggcttatcctagtaaatatcattagtctaccttgtggttcaattattatgttcacaagaacattcatttcaatcatcagtcttcttttcatttcccctgggtgcaatctcctggtattgggggagaaatagatttctggccagttgctttaacagcatctaccaattcactgtctgaactcagttaatatcttcttgccacacatttctctagttattattatttgttttactatattttaacaaagaattaaggcatctaataccttaaaaaaccccaaaagaattggaggaaatagactaaaatattatatatgtgtatttctggatataaggttatgaaagtttatttttatgcatattatattttatagatcttgttcaaatcaacaagattttaactacctaatagggactatgaataaaatatatccatagtgaaaatatttatttaaaagtcttttgatacatttattccatttaattagtgtttatcttcaattgcacattttatatgatttgatggagacacttaattgaacaatgcaatgtttataaggtcaaattcactttcttctctggacaatccattttaacatgtttttaatcaatgggaggattcaatccaacctctcaaagtgtttccttttcctgggaagcatcatttgcataagtctagttttcacttacttatattaataaattacaaaccctctaatacaccttgtagctatgatagagagattgatgtagtgtttgacacaccatacattagtaaaacttacagtatcaatcagggcaatgtgtctcttcttttctttagattacagattactaagaacccaatattcctttttcagagaaaagaagtccaaggattttctttcaatattggccattagtcagcacccagatctgagagagatgtccaacagtgttattcttgagcttatttattttgcataactgaaactttattccaattgaagaactcccatttttccctccttttaacttttggtaaccaccattctattttctgcttctaagagtttctcatacctcatatgagtggaatcatgtagtatttgtccttctgttgctggtttatttcacttaacggtaatgtcttgcacattcatccatgtcgtgagaaatagtaggatttccacagacatttttaaatgattttctctgttgactgactgtggggtgcagtttcttatctcattagccagtgcatggcctgagaacccagtgcctgctcacttcaagaagcagataataattctggaaatctgactaaagcatctgccttattccaaatctcttctgagtcaacaactagttatttctggtagttatgtacatgacacacttgaattcttccctaaattccatgaaatttgttgttgttgttgttgttgttttttaatgaatgcccattcccttgacaacaacaacaaggccattggctataagtgaaaagtctttgaactgctttcatctctgtccaatgtgcaggtgtgcccttgtcttcttccattaagctttccccatctgcagggtgtattgccgttgttttccaaacaagtgacataatccagaaactctcatcagtgaaccagacaacttactttgcttcatggggagcaattcgcaagacacagaacatgcagcaattaacctggaaaagtctgctgagggctttatttgatcggctctatagtcagtgaggcaacctgcttgatatggtttgactgtgtcctcacctaaatctcatcttgagttgtagtttctatagtccccacaagtcatgggaggtgcccagtgggagatacttgaatcataggggtggttacccccatgctgctgctctcatgatagagagtactcatgagatatgatggttttataaggggcttttccctttttgctcagcacttctcttgctgctaccatgtgaagaaagacatgtttgcttccccttttgcgatgattgtaagtttcctgaggccttctcagccattctgaactgtcagtcaattaaacctctttcctttataaattacccagtctcaaatatgtctttattagcagtgtgagaacagactaatacactgctcctgtatgcagtgattcccttctgtgtacttgcccacttcccaaagtatgctttttaacatcccatttctaatttctgagtgaactttggctgtgctgtttgatccctatatgaatgtttctgacatcatccaagacaaagttggtttccctagctttggagttatctgatgcccttctgttagggcacagttttgatgaccaccactcagtaagaagcaatcaattgtcttttaaatggtttattaggaatagctattttgcctaacatttgttctcaaaaaataagaggtcttcactgaactctttcatttctgcagatagctctagtctgtgtatgttctggtttcgggtgcatctaatattatctgtgcagtcaaatcatacaatcctaatagaccttcctgcatcaccaccctccaaaaatcctttagcaatttcttctgctcagagcctctactcaaattcagttatctttctggtgactttgtgaacagaggtcaatagcattcttagattgaagaaaacaaaaacaaaaaactgcaaaagcctaagtaagctctatttatctctaggtctcttactcatttgcagattctgtaagcgataattttttatggtttcaaaaaatgtctctagttgctccagtcaatgtaattccaagggctatggatattatctgagctcatcagcctggctctatttgtcatgtgagtcaccacagtccttaactcctctttaattcttatgagaggagaagcttttataatataatcaatttactaacttgctttgcatatttgttaagtccaggtcccacttcatgaaattatcaattgtgcaggcaaattcaaacatacttctggcaatatagtaaatgtatactgagtcctattctgtgagaatgcatattgtacctggctgttcctggaaattgagatggagaagaaagcactaggcaagtttctaatgacatagccatcctccttggcttgttgtgcatcctatacagtgtttaccacatcaggtacagttgaagcaattaggacaactacttgttgaatgcttgataatctacagttaaccttcagggactggccagacagctctgttaatggggaagctaatgggaaccaataatcatacctcaagtattcccttaatcagggcaataatctcttgtacgttcctggaattctgtattgtttacaatttattctaggacaacataggaaattccaaaagtcaccgttcagcatggccagttaaaactccaggaagggtgattaggcaatatacttccccaacaaaaacggaaaaagggaacattctctattagcacataatatctatcccaattatgcattcagctaaaggccattaaccagtgaaaagtctccccagtcatattcttcactcctaaacttattctgatgctagtccccccaacatggcatctccaaatcctgctagtttcagctttgggtctttcatagcactgccttgatttatcataagtgctactgaacattgaaaacctctatctagtcattttagaggctttgcctaccagttcctggcttttttaccaggatttgctggatttttaccaaatatttgcaaaaggcctatgattgcttgtttggggtaggataagaatatctcagtctctcagccaacctttttcagactcaatgactttatctatggaaacacattcaggctgctgtttaagtactttccattttgaatcttgattctcatcagttgatttgatttttctagactataataatttgagtgaacttgcagtgacactttaagaagtgggagggaggatcagagcagctccccaccttccaaatgtggatactgttgttctaacttcttagtagaaacagtaagattctttctctctctttttacactgctttttataaaccatctaaagagctccactaagttgaggggattcttatttcctttttctcttcatggtcctttcttttgtgtgcatagatctttttatcatcatgcagccccctctgcattacctgagctggcaggttcatcatcatctcctaaatattcccttggtttcccattacataaggagaacaggagacagaagctctccaaagtagcacgtgtttcattatctgtgccagaaacattaaattgattgcgtctttctgatcatcaaatagacaggttggtgttggtcattcacaccatgcctgaagcatgaaaagacatatgacacttgtgagtcatatgtctcatatgtctcacaatgagtcatgttgtgagtcatattgtgacatctgtgagtcatgtgtctcatgtgtctcacaatgagtcacattgtgagataggaaattacctatctcacaggggaggggatagggaatttacccctctcaggagagggttgctatgcttctacttttaccggttatatagattaattattataccacatgaaaatacctgcttacagaagttttcagacactggggattagccttcaacttacatagctctaaaattagtgaaatttcctagacaggtgaagaagccctgcaagtaatgatttacctggcttctactggtatttttatgtaaaacatttgaaaatttacacagaatatccttgggatttagtagtcacctgatcttaacctccagttatttgtgtattttttgagtaatcaatggccttgtttatgctactttgtgaagaagtgggacatcattccaagtagtcatataagtacaagtatgccttccatgacaggaaagaaaaggctcacagcaaagaatagtagaatttggaaattttttttcttaggattgggtaattataagcaatacatagattttattgttctttgcttgaagggaacttataggtcttactttatcagcaccactagcactagccaggggatagaaattgttctatcttcccctcttccagccacccttcatcaatccatttagccatttccctcatatctaagtgtacttcctccacattccattgcatcaaagatttgctatcatcaatgtcctatcatcaatgggtaggactcaacttgtaattagatcttcactatattttttatatactttttattgctaaaaatgacccagcccattaagatttatgagattaaagcatagttctgcttgcactgccaatctgtgctaacacaaagtctcagactggcaaagaaacatggttcaaaagctttaccagttctgaaatgtactaataatttcaagaatacaggcaaccaagaggctcagacagccctggggggttgtctgcgagtagaccagttccctggcactttccatgtttgagatgtagtctcaggttcgaatagaagatgaggtctcctggtggagttttgcttggttgactcacacagcagaggaatatttagtctataaaatattgccaccttatacctcagtttaagggacattttccagggagccaagtattataaatccttagggtcttaatttattaatgttttctacaggcaatcctttaccagggacattctgttaagaacttttcatagataaggacttttctagaaatatgaatagactatttgcccagagcttcagttatcatgttgacaaggagattatattgggtcacttgccctcttattttctcccagggtcagaaatgaatagccagtcagcagctttaactccttcctgttcaaaaaagtgtgcataaatataaaattcattgaatttttaaaaactgaatatatgcttgtaaccagcacacagatcaagaaatatccctattccagctgcccagaagcctcccctcatgcttgtttcctgtgactacttccatccaggggcaagtaatcaccatgatataattttataattaaaaatgtgttatttgaaattgttgattggtacccctataagaattcatatctagataatcacatatacacatgtgtagatagtaatctcttaaattatagaatggggtctaacttctgtctgttatgtgaaaatatgaagctttctaagcatgtggctttcaaaagttttcttaggatttggcaaatgtaaataatgcatagatcctgtcgttctttgtttatattaattatttgagtacaacatgaatatatttgtgctgtaaaaagattcaagcaataaaaagtagtaaaatgtaaaagctttttcatcaccttataacacaatcttctcctgaccccagaagtcacccctactaatagatatttttctattagagttttgcttttgacatgaacaacatgttatagaccattatgtgtcagaataattagactcttcctattgattgtaatggctttattttattatagcacaaaggttaccataaagtctctgaagtcagactatctgactttaaatcttgaccttgctacttccctgctgatgaccttgtgccagttacttgctttttccccagtttcttcacctaaaaatgggaacagtgataatcatagtattttcccagaggattaagtgaattaatagggataaagtttataacagaccctggcagaggtcaagcattggatatattttgccattattaagatgttatcatattgcacatttgattattaatattgctataattcacttaaatttttgtctgttcatggccaatatgttgtttctaaacttttcctataacaaagttacaatgaatataatgctttcatggctttttactcatggatgtatttatttcaataaattatatttgtagaaatgaaaaggtcaagtggaacataatgcacattttgatttgactggcattcccaaattcactttcaataagtcttatcattgtatccctaacactgtatgaaaatatttgcttccctgcatctgttgtcagccaacatcagatatcattaatcttttaaatttttgccagtgggatggatgtgaggtttgattattagaaatatgttcgctgtgactgggagggcatgggaataactgcgtctaaacaaggtcttagaccaagtctgagcatgtgtgtccttggtcttataggcagaggtgtagtgggtactattgggttcagctgatccaaaatcagcttccaagtttacctcaaataactcccctgggttgtctcctatttctgtatattgtaattctgatcttggagccatctctaaagcctccattttcatgaaagttctttcttagatgagttttaacctagaatttcctgcagtcttgtttctctttattcaaccttaacagccttttgtgttctggtcctttaagagcactcttcttttgttttccaatgtatctatagattgtttattaatagtcttcactattttctttagaacttttaatttagacttcataaaaggtattgttgcattaaagtggttctcactttcgaacaagtcattaaaattgatcattctagtttgggacaatattaatatctcttggattgtatgggcaatgaaactgtagtattctaatacacacattagaattaaaattaaaaattagtcatttttacacattgatttatacatttattaaaataagaatgaaaggatgccagagtaggatatccctagcaatatgtttttccactgcatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaagggaaggaaggggataaagggtgaaaaactacctattgtgtactatgctcactacctgggtgatgggatcattcgtaccccgaacctcaccatcacacaatatacccatgcaacaaatctgcacacgtacccctgaacctaaaataaaagttgaagttaaaaaagaaaaaaatagtacttttgaaataaaaagcaagaagaaaaatacttcactgacactataaaattaagagggaaacctataaacagttcacttgaggtgtaaaagtataacagtcatttaattaatgggcttatttcttttatgggcattcgtttgattaaatcttttgttcaggcatatttataattttatattatactgtcactctggtcttctacattgcctcatttactgtacttcttttgtttgtgttgtatcttcttttcagtttagttgtagttgttagggtccacccaactggacagtttccccctcctatagacctaagccccaaaggccaaaagtaaaaccccctaccccaaacctgcctgtatctgtctgaccagaggccagctgttccaggatggggtcaagacgtctaccttacacaacagaactggcaagaaaaacatctccaggaagtggtcagacacctggcacaaaggaccccccacccttttctttttccttcaccctgacccagttctatgccctataaaaccttgctatagcctgtaagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagcaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaacaatttcggtacccagtccttgagataactttctgaaggaatgatgttaacattaatgaataaaaaaggaacaaataaaaagtacaccacacatactttgcttgtgttctggtagcactagccctaaacacaatatgagtaaggtaacaaaaaagtaacctgagatatattaaaaatggttttaaagccaaaagggaggaagaaaggaaaaaaggaaggaagggggaagggcgaaagtgaaaaacatatggaggaaggaaaggaaaataatatcaaatgttcacagagtgcttattctgaattatgtaccctcttatgtgctttatataaattatattgtaaggttgaaaatatgtgctctggagaagagctgcacggaataaaatcccacttctgctttttactgatggtgtgacatttagcggattagttaatttggtcattgcttcagtttcctatttgactgtcctaccataagactataataaaccaatgcatataaaaatgcttagcactgagtctgacatatggtaagcatacaataaattttaactacaattatccaatgaaaacctaacaacaacactatgaagtttgtataattattatttttacttttttgataaggagtctgaatcacaaagggattaaataatttactcaaagtcacgcaggtattaatcatgaatctatcttccagtaaatatcaatagaaaacaagatgtgggatttgagtgcaggcaattagactccagagcctgtttttaaactctatgttattacaagaagacatgcacgtacctttaaaagaagaaaatttgagacagcaaatgcttaacaaccaagaaattacaaaagaaaaaaacctacaatctatgaaacaaaaattatatgatgagattaattaatacatttaacaaatacttattgagcaccaattattggttcaaccatgcttttaggtactgagaattcaactgtgaactggtctctactttcacagaatatactttataatacagtataaaatggcataacaaaatggaaatggggttggtaaaggcagcaaaaatcttcaacagaaaaataaatatttttataaaccaataatttttgaaagataggatatagcatataagcatatggaaaataggtatccatgatagagaatataatagtggaacagttaatgacttctgacatgaaggaagtactgagatgagaattgaacaggatttgttttccttcagaaaaaaaataatcggtagaaaaaatatatgctggtatagctaaaaaaatttgaggattaaaaaatctcttctatacaatatataaaaatgcatagcacctgtaagaaaacaaatatattgggttggattcaaatttttttgtaccaaaatttccaatagataatggagcaagtctgcaaggatatgggcaaaaaatagtgggatctaaatatgttgtacatagattgttattcctgtcaaagggatgaggagttggtctcatatatgtactaacacagcagatacaataattcggaaacttcttgagaagctttgtagttatatatacactgtaattatttataatactattaaatgcaatataacaatttaatacatagagaagctgccttattgaaatattgaaataagcattgaaaaatctaaatgtagctggcaagatggcctaatagaaacagctctggtctgcagctcccagcgagatcaacacagaaggcaggtgatttctggatttccaactgaggtacccagttcatctcattgggactggttagacagtgggtgcagcccacggagggtgagctgaagcagggtggggcatcaccccaccagggaagtgcaaggggtttgggaaatccctctcctagccaagggaagccctgagagattgtgccttaaggaatggtgcattctggcccaaatactacacttttcccatggtctttgcaacctgcagaccaggagattccctcaggtgcctatgccactagggccctgggtttcaagcataaaactggggatcatttgggcagacacccagctagctgcagtttttctttttttcataccccagtggcaccaggagcccgagtgagacagaacccttcaatcccctggagagagggctgaaatcagggagccaagtggtctggctcagtggtcccacccccacggagcccagcaagctaagatccactggcttgaatttctcactgtcagcacagcagtctgaagtagacctgggaggctccagcttagtggggggagggacgtccaccattactgaggcttgagtaggcagttttcctctcccagtgtaaacaaagcctccaggaagttcaaactgggtggcaaagccacagtagccagactacctctctagattcctcctctctgggcagggcatctctgaaagaaaggcagcagcccaaacaggggcttatagataaaatctccctgggacagagcacctgggggaagagcggctgtgggtgcaacttcaacaaacttaaacattcctgcctgctggctctgaaaagagcagcagatctcccagcacagtgctccagctctgctaagggccagactgcctcctcaagtgggtccctgacccctgagtcccctgactgggagacacctcccagcaagggttgacagacacctcaaacaggagagctctggctggcatctggcaggggcccctctgggacaaagcttccagaggaaggaacaggcagtaatctttgctgttctgcagcctctgctggtgatacccaggcaaatagggtctggagtgaacctccagcaaactctagtagacctgcagcagaggggcctgactgttagaaggaaaactaacaaacagaaaggaatagcatcaacatcaacaaaaaggaagtccacaccaaaaccccatccataggtcaccaacatcaaagaccaaaggtagataaatacatgaaaatgaggagaaaccagcacaaaaattccaaaaaccagaatgccttttctcctccaaaggaccacaactccttgccagcaaaggaacaaaactggatggagaatgagtttgacaaattgacagaagtgggcttcagaaggtgggtaataacaaactcttccaagctaaaggagcatgttctaacccaatgcaaggaagctaagaaccttgaaaaaaggttagaggaattgctaactagaataaccagtttagagaagaacataaatgacctgacggagctgaaaaacacagcacgagaacttcatgaaacataaacaactatcaatagccaaatcgatcaagcggaagaaaggatatcagagattgatgatcaacttaatgaaataaagcgtgaagacaagactagagaaaaaagaatgaaaaggaacaaacaaagcctccaagaaatatggtacaatgtgaaaagaccaaacctttgtttgactggtgtacctgaaagtgacagggagaatagaaccaagtgggaaaacacttttcaggatattatccaggagaacttccccaacctagcaagaaaggctgacattcaaattcaggaaatacagagaacaccacaaagatactccctgagaagagaaacaccaagaaacataatcatcagattcactgaggttgaaatgaaggaaaaaatcttaagggcaaccagagagaaaggttgcattacccacaaagggaagccagtcagattaacagccaatctctctgcagaaaccctacaagcaagaagagagtaggggccaatattcaacattcttaaagaaaagaattttcaacccagaatttcatatctagccaaactaagcttcataagtgaaggagaaataaaatcctttacagagaagcaaatgctgagagattttgtcaccaccaggcctgccttacaagagctcctgaaggaagcactaaacatggaaaggaaaaaccggtaccagccactgcaaaaacataccaaattgtaaagaccatcaacgctatgaagaaactgtatcaactaacaggcaaaattaccagctagcatcataatgagaggataaaattcacacatatcaatattaaccttaaatgtaaatgggctaaatgccccaagtaaaagacacacactggcaaatcggataaagagtcaaaatccactggtgtgctgtattcaggagacccatctcacttgcaaagaaacaaataggctcaaaataaagggatggaggaatatttaccaggcaaatgaaaagcaaaaaaaaaagcaggggttgcaatcctagtgtctgataaaacagactttaaactgacaaagatcaaaaaagataaggaaaagcattacataatggtaaagggatcaatgcaaccagaagagctaactaacttaaatttatatgcacccatacaggagcacccagattcataaaacaagttcttagacacctacaaagagacttagactcccacgcaatagtagtgggagactttaacaccccactgtcaatattagacagactgatgagacagaagttaacaaaaatattcaggacttgaactcagctctggaccaagcagacctaacagacatctacagaactctccagcccaaataaagagactatacgttcttctcagcaccacgtcacacttattctaaaattgaccacataattggaagtaaaatactcctcagcaaatgcaaaagaacagaaatcataacaaacagtctctcagaccacagtgcagtcaaattagaactcaggattaagaaactcactcaaaactgcacaactacatagaaaccgaacattctgctcccaaatgactactggttaaaaattgaaattaaggcagaaataagtaagttctttgaaaccaatgagaacaaagacaccatgtaccagaatctctaggacacaattaatagatcttcctgctttctcctgtgtgcatttagtgcccataagagaaagcaggaaagatctaaaattgacaccctaacatcacaattaaaagaactagagaagcaagagcaaacaaattcaaaagctagcagaagacaagaaataactaagatcagagcagagctgaaggagatagagacatgaaaaacgcttgaaaatatcaatgaatccaggagctggtttttttgaaaagattaacaaaatatgtagaccactaggcacattaataaagaagaaaagagagaagaatcaaatagacacaataaaaaattataaaggggatatcatcactgattatcatcactgatcccacagaaatataaactaccatcagaatactataaacacctctgtgcaaataaactagaaaatctagaagaaatggatacattcctggacacatacaccctcccaagactaaaccaggaagaagttgaatccctgaacagaccaataacaagttctgaaactgaggcagtaattaatagcctaacaaccaaaaaaagcccagaaccagatggattcacagccgaattctaccagaggtacaaagaggagctggtaccgttacttctgaaactcttccaaacaatagaaaaagagggactcctccctaactcatggaatgaggccagcatcatcaggataccaaaacctggcagagacacaacaaaaaagaaaatttcaggccaatatctctgatgaacattgatgcaaaaatcctcgataaaatactggcaaaccaaatgaggcagcacatcaaaaagtttaccaccatgatcaagttgacttcatccttgggatgcaaggctggttcaaaatatgtaaatcaatcaacgtaatccatcacataaacagaaccaatcacaaaaaccacatgattatctcaatagatgcagaaaaggcctttgacaaaattcaacagcccttcatgctaaaaactctcaataaactagatattgatggaatgtatcttaaaataataagagctatttatgacaaatccacagcaaatatcatactgaataggcaaaaactggaagcattgcctttgaaaactggcacaagtcagggatgacctctctcaccactcctattcaacatagtgttggaagttctggccaaggcaatcaggcaacagaaagcaataaggtgtattcaattaggaaaggaggaagtcaaattgttcctgtttgcagatgatatgattgtatatttagaaaaccccatcgtctcagcccaaaatctccttaagctgataagcaacttcagcaaagtctcaggataccaaatcaatgtgcaaaaatcacaaacattcctatataccagtaatagaaaaatagagccaaatcatgagtgaactcccattcacaattgctacaaaaagaataaaatacctaggaatacaacttacaaggtatgtgaaggacctcttcaaggagaactacaaaccactgctcaaggaactaagagaggacacaagcaatgcccatggataggaagaatcaatatcatgaaaaatggccttcctgacaaaagtattttatagagtcaatgctatccccatcaagctacgactgactttcttcacagaattagaaaaactactgtaaatttcatatggaaccaaaaaagagcccatatagccaagacaattctaagcaaaaagaacaaagctggaggcatcaggctacctgacttcaaactgtactacaaggctactgtaactgtacagttacagtacggtttggtaccagtaaacagcatggtaccagtaccaaaacagatatatagaccgtggaacagaatagaggcctcagaaataatgccacatatctacaaccatctgatctttgacaaacctgacaaaaacaagaaatggggaaaggattccctacttaataaatggtgctgggaaaactggctagccatatgtagaaggctgaaactggaccccttccttacaccttacacaaaaattaaccaagacggattaaagactaaatgtaagacctaaaaccataaaaaccctagaagaaaacctaggcaataccattcaggacataggcatgggcaaggacttcatgactaaaacaccaaaaacaatggcaataaaagccaaaattgacaaatgagatccaatgaaactaaagagcttctgtgcagcaaaagaaactatcatcagagtgaacaggcaacctacaaaatgggagaaaatttttgcaatctatccatctatccatctgacaaagggctaatatccagaatctacaaggaatttaaacaaatttaccagaaaaaacaaccccatcaaaaagtgggtgaaggatacgaacagacacttctcaaaagaggacatttatgaggctaacaaacatatggaaaaaaagctcatcatcactggtcattagagaaatgcaaatcaaaactacaatgagataccatctcacgccagttagaattgcaatcattaaaaagtcaggaaacaacagatgctggagaacatgtggagaaaagggaatgcttttacactgttgtggaagtttaaattagttcaaccattgtggaaaagaaaacctccaacctctcaactatgtatatagaaagtccaaggaaaagatctcaggtaatactacaaaaattgggaagtataggtggtctattgatttcctattagtgcggtaccaagttgtcacacttagtgtctaaaatagcacacatttgttatcttgtagttctgaaggccagaagtctggaatggtttccactaggctaaaatcaagatattggcaaggctgcgttttttttcttaaggctctacagaagaatctgacttcttgcttttcttttccagctactacacgttgtctgcattccttggctcatggtccttttaatctttaaagccagcaaaggcccatcaagttggtctcacctggaagagctctaatactgatgcttctttgtctcttccacttttaaggactctcacgattacattaagcccacctatataaccaggatatcctattttaatataagctaactagcaaccttaattcccctctgtcatgtaacctaacctattcagaagttctggagatttggacagagacacttgggaagccattatgctgctgaccataggtggtaggaagtttaaattttatagctaaggacaataagcattcattcatttctgaggtagattaatattgaaatattttacatttatggaatttttctaatttagaaattttctaatatttcctcaggataagattatgcatttttgacaaaaatattgctaaactgatgttgaattctcatgcattacatcaaggagcatatgatatacttgcatctcattatccaaaacgttatcttggatcatttaactacggtagaatctgcccagttttttcactgaaaagttacaattttaactttgaaattaataaagtatcttgtgggtagataatttcagactatgtaactatcctgtttcaaatttttgtccactgctttaagcagtcatttataattctttgctggaacacaccaacagtgtggggaggtcaattttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcatcctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcggtggctcacgcctgtaatcccagcactttgggaggctgaggcaggcagatcacgaggtcaggagatccagaccatcctggttaacacagtgaaaccccgtctctactaaaaatacaaaaaaaattcgctgggcgtggtggcgggtgcctgtagtcccagctactcgggagggtgaggcgggagaatggcgtgaacccgggaggtggagcttgcagtgagccgagatcgcgccactgcactccagcctgggtgacagagctagactccatctcaaaaaaaaaaaaaaaaaaaaaaaaaaaagtcatacagattctaaataatttcttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaataatttcttgatacattgtgtaagaacagaattatgctaagtgaaaccaagacaagtaacctagccctatattaagagactcacaatatggtggctgtgtctgcatacagaaatataaaaaaataatattcaggccacgcacggtggctcatgcctgtaatcctagcattttgggaggctaaggtgggtggatcactcgaactcaggagttcaagaccagactgggcaacgtggcaaaactccatctctactagaaatacaaaaattagctggtcatgatggcgtgcacctgtggtctcagctacttggggggtgaggcaggaggatcacttgaacctgagagatcaaggctatagtgagctgagatggtgccactgcactcccatccaggtgacagagtgaaacccctgcaaaacaaattaataatattaaattaattgagtcagagcagaatatggcaaatacaagaagttatttctttaggagtttcaaaaatgtagacctcgtatcttcttcagattatcaggaaagctagaggcatgtgagttagctttaaattaataagtgagtcttgacagaatatgatacctggaggtagagggaaggagagttttggaaggcaagggaaatggatagagtgcatgccaaaagaagtgaaatatagagtgtattagaaataaaatataataataaccattacttatggcacaaattggaattttcaaatgctcttggttaaaatcctaataatttcagtgccttatttataattcagttttatgtaaaacttatagattattatagaaagaccacaaaaattccatggcattttacaagtgttcctcttaaactcaggcacagaatttatgctttactggttcctaattatgtttttcttttctgtctcttctttattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggtatgttggcttttgtgcagtttgaagataatatgaaatatttgtcccatatttcagcagccattggcagggctgttcattcattcatttatttacatatatttatggaattccaggaactgatccaggcacctgccctcattggatctgcattctgaaggactagatggacaataaataattatattagagaatgagaaggattctgaaggaaagtaaaagtgatataatagaaacagaaagtggaggctgctatttttatagagtattcactggaggtcatgagaaaataagatttattatgtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcctgcaccgcccttaatccattcaactctgagttgacacagcacatgtttcagagagcacggggttgggggtaaggtcatagattaacagaatctcaaggcagaagaatttttcttagtacctaacaaaatggagtctcctatgtctacttctttctacacagacacagtaacaatctgatctctcttgcttttccccacaattatgtcttacctgaaacctttgtattttcttaataaagttcagggcacatgtaagatgatagaaatatcactatgaactgtaaggtccaaagaactgacacatctgatatgattatgtcttcagtctgacataagtagaaatttaggccctcatgtggttagctagagagatttccaacagtttttgagagaagatgcaacaatattaatgatttttcaaaaagtggtagtttatgtgtgcaacataagtttacattgtaaagcttagggtagcaccctaaagtacttctgggcccacagaagtactttaccttactgcatagatctgagtttttgtgatgtttatcattaaaaaaaaattttattgaggttgtgatgaaaggacccttcccttgacccctgcttgggactggtgaaggggcggctcccttactccacctgcaactctcaagccccttgtgggagggggagcatgcaggtgagagggtgcaggagctagggcaagtgcttttgggtgccagcagtaactaatcctgtaccagccccagggctgtgtctagaggttgcctgtgacccctggagccccagaaagcagacagctaagtgttaaccagctcagtggagggtcagggtgacagcattttgcacctgtcctcttggtacctgagttcctgtctggcattcaggaagaatcaggtcgcatgaacgaattgaagtgtggtgaatgtggaggattttattgagcggtggaagtggctctcagcaggatagagagctggaacggggatggagtgggaagatgattgatggtccctggttgaactcctctccaaccatagtctccaatgcccagctgttttttttctcgatgttcagatgcttcttgtcttctctccttctctgccgcaccactctgctgctgtgccattggaacctggggtttttataggtataggatgcggggcgtggcagggcaggatggttttgaaaaaggcaaatttcaggtgggaaaacaggattgcatgttctcacttagagcccaaggtccaagcttgaaggtggagtccttgccagggactgcgcccttttctaactagtatttccttgcctcctgtccatatcagttacattatcaagatactgtgctaaacaaaaagagggtgtacaccgcatattctcactcataggtgggaattgaacaatgagatcacatggacacaggaaggggaatatcacactctggggactgttgtggggtggggggaggggggagggatagcactaggagatatacctaatgctagatgacgagttagtgggtgcagcgcaccagcatggcacatgtatacatatgtaactaacctgcacaatgtgcacatgtaccctaaaacttaaagtgtaataaaaaaaaattgctaggagttataacatttaacattataacattatataacattataacatgtaattcagactactggaaatagatttacatgggtgatttgtaagaacagtaaaatgtgattttactaaaagattataaaaaagcatggaaatgtaaatttttgcctagggttgaaggattgttttgaattagataagataaagctgaaggtttaaacaaatgatggaaggattctaaaaactaatcttgcaaaaactgtatgtgtgaacatatttactaaattcaaaggggtattataggatttttctgtaaattgagcattgaaataaaagtacaataaatgttaaaaaaaaaagagggtgtacaaattgataattattgttatcactcccagacaagtttttttttaatttaacttctatttttaattcaggggtacatgtacaagtttattacacaggtaaacttgtgtcatgggggtttgttgtacagattattttgtcacccaggtattaagcctagtacccattggttttttttttttcctgagtctcttcgtccttactccctctaccctctgataggccccagtacgtgtcgttcccctctatctcatcattagctcccacatataaatagtaacatgtagtattgggtttcctgttcctgcattagtttgctgcagataatggcctccagctccatccatgttccgtcaaaggacatgagctcattctttcttatggctacatagtattccatggtgtatatctaccacattttctttattcatctaccattgatgggtatttagattgattccatgtctttgctatcgtgaatagtgctgcagtgaacatacacatacatgtgtctttataatagaacaatttatattcctctgggtatatacctagtattgggattgctgggttgaatggtagttctgtctttaggtctttgaggcattgccacattgtcctccagaatggttgaactcatttacatttgcaccaacagtgtgaaagtgtttatttttctccacaattttgccaacatctgttactttttgactttttaatagtagccactctgactggtgtgggatgatatcccattgtggtttttatttacatttctctaatattcagtgatgttgagctttttttcatatgtttgttggccacatgtatgtcttcttttgaaaaatatctgttcatgtcctttgcccactttttaatggggttgtttattttttgtaaatttgtttaagttccttttagatgctggatattagaccttagtcaaatgcaaagtttgcaaaaattttctctcagtatgtaggttgtctctttactctgttgatattttcttttgtcatgtggaagctctttagtttaattattaatagattccatttgtaaatttttgcctttgttgtgattgcttttggtgtcttcctagtgaaatttttgcctgttcctatgtccagaatggtattgcctagttgtcttccagagttttcatagttttgggttttacctttaagtccttaatccatcttgagttaaattttgtacatggtataaggaaggggtgtggtttcaatcttctgcacatggctagccagttatcccagcatgatttattaaatagggagtcctttccccattacttgcccattgtttttgttagctttgttgaaggttagatatttgtaggtgcatggatttgtttctgggttctctattctgttccattggtctatgtgtctatttttgtactagtaccatgctattttcattaccatagccttgtggtatagtttgaagttgggtagcataatgcctccagctttgttctttttacttaggattgctttagctattcaggctcttttttgcttccatatgaattttaaaataatttttctagttctgtaaagaatgtcattggtgatttaatagggatagcatggaatctataaattgctttgggcagtatggccattttcatgatattgattcttcctatccgtgggcatggagtgtttttctatttgtttgtgtcatcatggatttctttgaacagtgttttgtagttctccttgtagaaatctttcacctccgtagttagctgtattcctagatattttattctgtttgtggaaattttgaatgagattgagttcctgatttggctctcggcttgactgttgtggatgtataggaatgccagtgatttttgtacattgatttttttttaccctgagacttttaggaaagttattttgccaataaaaagtgctctcaatattttgtcccatacatattttaaattacattaattagtttaaagttcttgcatacaaattacccatccttggccaggcagagtggctcacacctgtaatcccagcattttgggaggccaaggcagacagatcacttgaggccaggaattcaagaccagcctggccaacatggtgaaaccccatctctatgaaaaatacaaaaattagcctggtatggtggcgtgcacctgtaattccagccactcaggaagctgaagcatgataatcacttgaaccctggaggtgaggttgcagtgagccgagatcgtgccactgcactccagcctgggtgacagagagagagactgtctccaaaaataaaaaataaaaattacccatctttagctctttgtttgccttctcaggaggcagccaccttcagcaatttttgctttttttttgtaattactactatatttctaaataacatgttttcaatatttttccttcaaactctcatagatgtaaattgagttgtcatcaactttcaccacatcagcacaaacatacattcatacacttcaccttctcacattctcctggtataattatatcacaatttttgtttgaatcaacatacagaatatacattcttattttacatatatcttatccgtgctgagccttggaaagtgctgtatcaatttctctcttataaaatgtttttcattttcctagatttattaagggtatattttgatttgcttagtttgggtgtgtactcattagtaatgtatcctcaaattctcttccagaggtgttactctcttgtcaatacctttaaacatatcaggtatctataaatatacgtgcaggtacgtttcccggtgttttctgttctctttataggaacacgttactcccagggcagagcagctcctgctctgggataccccttcactgataccctaacaactctcttcacctctctttgtgtacaaccccattttctggatgccatgtccccttctttttttggtttattcctttctgagaaatggtttattgagatgaaacgtttgagctcttatttgtctgcaagtatctttattctgccctcacacttaattagttagctgtatgaagaagtctaggttggaaatttcttctgtcagaatttcaaaggaattactctattgctactgctataaaatatggtattactgctgaaaaaacatgatatttaattctttcttcttttgcccatgatttgtattttgtttttcttatggaaatcttttagaacttccctttatccctaatgttctcaattccatgaaactatgctttgaagtaagcctttttattttgtatttattgtgctggatataaattcgggctttgcaatctgaaaatgagtggcctttaatcttagggaattttcttgtggagttcttttctgtttttctttcttctactcatattaatcagatattagagattctggattgctcttttaatttttttcatctttttactttaattttttgcccctcattcttctattttcaaggattgtctcaactttctcttttaaactttatgttgaactcctcaatactgttaccgttatcttaaatattttgagttatttttattttctgcatatttctgtagttcccaccatgatacaacagtatcatgatacaagcagtatcatgtacatgtttcacggacaaagtgcattatatctctggtgttattagtaatagttttttctgttttctatttttcatatgtctgactcaatttggttttcctataagtatttttcttcctatgtgtgttagtctttttcttttatgtttgaggtttccctagtgttaactgcttatttttcattgcatttaaaaattgttttaatttgttttttttttagttaatatgggtacatatgtgtatatttatggggtacatatgatgttttgatataggcatataatgtgtaataatcatattagggtaataatcatattagggcatttgggatatccatcacctcaagcatttatcatttctttatgttaagaacatttcaattctactcttagttattgctaaatatacaataaattattcttgactgtagtcactctgttgtgctatcatatactagctctaaggctaggtgcagtggctcatgcctgtaatttcaacacttggggaggccaagatgagaggattacttgagcctaggagttcaaaaccagcctaggcaacataatgagaccccatctctactaaaaattttttttaaaataactggtgtggtggactgcacctgtattcccagctactcaggagcttgaggtaggaggatggcttgagcctggggacacagtggtggtaggagcagaggggttaaggctacagtgaaccatgatcacgccactgcactccaccctgtctcaaaacaaagaaacaaacaaaccaaaacaaaacaaaacaccaccagaaaaaaaaagactagatctagttaactgcttcttagcttctgtgtttcagagtgaggcatagcgtggctgcctggaagttctgcatgcctggaggataaggttaggactactgtccacttcattagtctggactattcattgggaaattcccaactgtaaaaatctgcatatcagtgttattgaacaggtcactttttccagaaggagattttctaacatactgccgtaggaatgtagggctggctgttacattccacattgccatgcagtgcagcggtatactttcgcttaatccttctgcatcacagtggcactcattacccccgcacctggtgactcggggtttagagtacttatggttctgcctcctcagagagtaaacctccattcttctatcaacatgaggaaaaagccagtggcatctaattggatttatatataatttccaccaatcatgttgttttctcaatctcacatttagtagtatctggcactttaatttctaaggatttatgctcttttatcctacacctatcatttcagtggaattgtgtgagggagataaggtaaaatatatgcttaatattccattttcaaccaacggctagacacagttttttgcatttttgttgacaaataatactatcataagctaacacattttagaactgaaaaagacattctcttttagtttccactcactagagtcactcaagcatttattataatatgatctggataggtgacttttaaaagatatacttgaattatttaggttatttaaaaatactttatgtgtaagaatattttgtttcagaaaataaattgcagaaaaattaaaaaaataaatttcaaaactctgagaaatgcataatattcatcttttgagaaatgagaatatttgctaggagaagaatattgttccttttctgtaatagcagatgggtgtttagaatagcaaactactacaataattttattattttcttttataaactttacagtagctaaggtttagtaggaaagtaatacttttgttcatgcaaagtgctctttattctggatgtgtctctggggttaattgtctcatttcagtctatattaataaaaacattttattctgtatgtaactcctgattcctcataattttggggtgcctttccaaactagaaaaccgacgttctgactgtttattcatttaaagggcattattgcatcagagtcaatggtttagactctggagtcttacttcccaggttcaaattcttaaaatgctcctaactagccgtggcaaagtatgtaatatttgtttatttgttacctcgtctatattgtgaggaaaataacaaagccttcaaaagcctgttgtgaggattagatatgttaatagacagagaccacttatagtgcctggaatgtgataactactatgtaagttttgacattattgttagtgtactgaaaagcagagctctggagatattaggggaaatactgagaaacattgatttttctctgcctatcatgtagaaaacagttacattagtctcgtttccacaactttctattttcattttcagtgagattttgaaaatatgatcttttgaaagactgtttcattttcctttcaggatggccatttggaaacacgatgtgcaagatcagtggattggtccagggaatatctgtcgcagcttcagtctttacgttagttgcaattgctgtagataggtaagtctgcaccaaactctgaatccagaaaaattggcatgtctgcaactagtataccagaaaaatatataacctactaaatttggacatatcttttcaaattgtattcacaatatctacctctttttttaaattattatactttaagttctagggtacatgtgcacaacgtgcaggtttcttccatatgtatacatgtgccatgttggtgtgctgcacccatcaactcgtcatttacattaggtatttctcctaatgttatccctgcccctgcccccccacccaatgcaggccccagtgtgtgatgttccctgccgtgtgtccaagtgttctcattgttctattcccacctatgagtgagaacatgtggtgtttggttttctgtccttgtgatagttagctgagaatgatggtttccagctgcatccatgtccctgtaaaggacatgaactcatcctttttatggctgcatagtattccatggtgtatatgtgccacaattttcttaatccagtatatcattgaaggatattttggttggttccaagtctttgctattgtgaatagtgccacaataaacatacgtgtgcatgtgtctttatagtagcatgctttataatcctttgggtatatacctagtaatgggattgctgggtcaaatggtatttctaattctaggtccttgaggaatcgtcacactgtcttccccagtgactgaactagtttacactcctaccaacagtgtaaaagtgttccaatttctgcacaccctctccagcatctgttgtttcctgactttttaatgatgacctttctaactggtgtgagatggtatctcattgtggttgtgatttgcatttctctgatgaccagtgatgatgagcattttttcatatatctgttggctgcacaaatgtcttcttttgagaggtgtctgttcatatactttgcccactttttgatggggttgtttttttcttgtaaatttgtttaagttctttgtagattctggatattagccctttgtcagaagggtagattgcaaaaattttctcccattctgtaggttgtctgttcactctgatggtagtttcttttgctgtgcagaaattctttagcttaattagatcccatttgtctattttggcttttgttgccattgcttttgttgttttagtcatgaagtccttgcccattcctatgtcctgaatggtattgcttaggttttcttctaggttttttatggtttcaggtctaacatttaagtctttaatccatcttgaattaatttttgtgtgaggtataaggaaaggatccagtttcagctttccacatatggctagacagttttcccagcaccgtttattaaatggggaatcctttcccattgcttgttttcgtcaggtttgtcaaaaatcagatggatgtagatgtgtggtgttatttctgaggcctctgttctgttccattggtctatctctctgttttgataccactaccatgctgttttggttactgtagccttgtagtatagtttgaagttgggtagcatgatgcctacagcttggttcttttggcttaggattatcttggcaatgcgggctcttttttagttccatatgaactttaaagtagatttttccaattctgtgaagaaagtcaatggtagcttgatggagatggcattgaatctataaattaccttgggcagtatggtcattttcacgatattgattctttctatccatgagcatgaatgttcttccgtttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagattatggggttttctaaatatacaatgacgtcatctgcaaagaggaacaatttgacttcctcctttcctaattgaatacactttattgctttctgttgcctgattgccttggccagaacttccaacactatgttgaataggagtggtgagagaggtcgaccctgacttgtgccagttttcaaagggaatgctttcagtttttgcccattcagtataatgttggctgtgggtttgtcaaaaaatagctcttattattttgagatacattccatcaatacctagattattgagagtttttagcatgaagggctgttgaattttgtcaaaggccttttctgcatttattgagataatcatgtggtgtttgtcattggttctgttcatgtgatggcttacatttattgatttgcatatgttgaaccagccttgcatcacagggatgaagcagacttgatcatggtggataagttttttgatgtgctgctggattctatttgccagtatttcattgaggatttccggatcgatgttcatcagggatattggtctaaaattctcttttttttggggggtgtctctaccaggctttggtatcaggatgatgctggcctcataaaatgagttaaagaggattccctctttttctattgattggaatagtttcagaaggtatagtaccagctcctctttgtacctctggtagaattcagctgtgaattcgtctcgtcctggactttttttggttggtaagctattaattattgcctcaatttcagagcctgttattggtctgttcagagattcaacttcttggtttagtcttggaagggtgtacgtgtccaggaatttatccatttcttttagattttctagtttatttgcatagaggtgtttatagtattctctgatagtagtttgtatttctgtgggatcagtggtgatatcccctttatcatttttattgcgtctatttgattcttctctcttttctcctttattagtgttgctagtagtctatcaattttgttgatctttaaaaaaaaaccagctcctggattcattaatttttttaagggttttttgtgtctctatctccttcagttctgctctgatcttagttagttcttgccttctgttagcttttgaatttgtttgctcttgctcctctagttcttttaattgtgatgttagggtgtggattttagatctttcctgctttctcttgtaggcatttagtgctataaatttccctctacacactgctttaaatgtgtcccagagattctggtatgttgtgtctttgtcctcattgatttcaaagaacatctttatttctgccttcatttcattatttacccagtagtcattcaggagcaggttgttcagcttccatatagttgtgctgttttgagtgggtttcttaatcctgagttctaatttgattgcactgtggtctgagtgacagtttgttgtgatttctgttcttttacatttgctgaggagtgctttacttccaactatgtggtcagttttggagtaagtgtgatgtggtgctgagaagaatgtatatgctgttgatttggggtggagagttcggtaggcatctattaggtccacttgttgcgagctgagttcaagtcctggatatcattgttaacattctgtctcattgatctgtctaatattgacagtggggtgttaaagtctcccattattattgtgtgggagtctaagtctatttgtaggtctctaaggacttgctttatgaatctgggtgctcctgtattgggtgcatatatatttaggatcgttatttcttattgttgaattgatccctttaccattatgcaatggccttctttgtctcttttgatctttgtcagtttaacgtctgttttatcagagactagggttgcaacccctgcctttttttgctttccatttacttggtagatcttcctccatccctttcttttgattctatatgtgtctctgcatgtgagatgggtctcctgaatacggcacagtgatgggtcttgactctatccaatttgccagtctgtgtcttttaattggggcatttatcgcatttacatttaaggttaatagcgttatatttgaatttgatcctgtcattggcgagagtgtcccgattttccaggtacagtctgtcatggcttcccttggctaggaaagggaaattccccaaccccttttgcttcccagctaaggtgatgccccgtcctgctttggctcaccctccgtgggctgcacccactgtccaaccagtcccagtgagatgaaccaggtacctcaggtggaaatgcagaaataacccatcttctgcatctatcatgctgggagctgcagaccacagctgttcctatccggccattttggaacggaacctgagaatatctacctctttaaaagcaacatacctactaaagtttcagtaataagaaaatgaaactattgaattttccatactttaaaaataaataattggagatggtaaaatttccctatttttcacactacaatatagacgtttctaacagcagaaatgcaaatgagctaaaatctgaaattttatctagattttaagattgaaaatcattcatccattcattcattcacacatgttgttgagcatttatgatgtgccagatactgggctgggttggtaacatctaaaacaaattagaagtgctgcctcaggaaggctacaatctggcggagcaggcaaagtcattaacaaatatttacaaataatgctttctaataggtgaccagtgtttgacagctatgcaaaagagataataatcaattctacctattaggacagggagtagtggattcacaaaagaagtgagaccttctgattcctggagaagtcagaaatttacccttagaagaaactgggaaaagggcatcccttaagacaagtatatacttatggcattgaaataggaggcacttgttcagagaaatgtagagaggtagttcagctggaacaaggcaggtgaagtggtacatttgtccacaaagagagagatttattacgagaaattgactcataattatgaaaactgagaaatctcagaatatgctgcctgtaaattggagacctcagaaagccagtgatattattcagtccaagtcccaaagcctgagaactagggatagccaattgtgcaattggccatttgtgtaaattgcatcctgtgggcaggagaatatgatatgagatgtcctagctcaagcaatgagtcagggaaaaaagggggcaaattcctccttcctctacttcttgttctattcaggccctcagatgactggatgatgcctacccacactgggagggcaatccactttaccgaatccactgactaagatgctaatcttatccagaaacacttttataggcgcatccagaaataagattcaatctcagcaccccttggcccagtcaagtcgatagattaaattagccatcacacttttgtagcagagactgtcagtgctctgccagatctcttaaactttcagtgggttctgtcttacatccaactgccagtatcttcatctctgtatctcaaatccaaattgtgcaaagtcttagttcctaagcagaacagacaagaaatgtcagataattaatacccctagaagtagccctcaactaaaatctcatgagagttgatgtactcaccattctctccccttgggttgaataattctgcaacaaatggtttgattcacatccctcgttacctaccttcccattaatgaatgacttctctatactttcagttatctattgatatataatgaaccacccccaaatcaaaccacttagtgagttaaaatgacagcaatatttattatgtcatgaatctgtgatatgtacagatttagaaagtacagcttgtctctgttctacttgatgtcaggtggagcagcttcaaggttagggctgaaccttctttcactctcctgttggtacctagtccagggagaacttgaatatgtgggggcctaagagagctttgtctctattggtctctccaaatgggctctccagcaaggctacttgaaggtacctggacttcttatatgtcagttcagggctctgacggtttgtgtcccagaagagagtaccagcaaaaatcatgatgtggtatcatttttgttgcattctattcatgagactgagtcatcaatccttagccaaggaaaaaggaatagaatttggaagcaatgtcaaagaacttggaaatgttttaaaactgccacatctttatttcttgcacttgcactcaaatgctttttttttcagggctagcttttgcaggaagccaaactaaaaaaattcccaagctgatttctcctgactgaatcctttgcctgaattttacagttacgttccaaagcacctactgtacaacttcaactgcacattcaacaaaaggcaccttaaattaaacatgcccagagctgaactcattattccaagccccacaccatacacaaacaaaataaaaggcagctgtttttttcatgctccccaaatcagtgaaaggcaggaccactcactcaattcaaacaaaaaacctgagctttatccttgaatcttctttctgtcaactttgctggcactctccaaattctattatttctgagtgctaactagttctgaaccaggccactgccctttgccacttggaatactgagattgttttctaactggccttcgggctcaggaagccaacctccaatttattttcttctcatagcagcccaaataagcttcttaaattgtaaaaatgatcctgccttttacaatgtaaatccttcaatgaatccccattgctctttaaatgaagtccaaactttttagcagaattttagtaattattatacagtttttaatatttttatatttccattgactttctcagcagggactattctctatcttattcatctttgccttcctgaatatatacacacaaacacatatatatgtatgtttacaaatatataagtatatatactcatatatgtacatttattaaacaaatatgtaagtacatatattgttataaatataaatatataaatacatatatttgttataaatacaaatatataaatacatatatgtacagataagcatatgtacttttatatttgttcattattacttttattgttaatagtgtctgctatactccatttattcaaattttgagttaaaatttatctcctatataaatatatgtacttatatatttgtttaataagtaaattgaacaataatatccaaaaccctattagtaggtattcaaaaagagcaaaatacatacgtttgtgtctatgaaattacccataatttcacggcaggtgaatgggagaattcttggattagaagactggaagaacgcttgaagttgaagagagaagatcttacacatgaaggagttataaagaatgacaacagagcagtcaaagcccaggctaactagtcattctatgaagataagttagataagttaatttggagttgctgctcagccacttaaagctctacattttcttatctacagatctggaatgtaacaattttcataacatttcagttttatggagtcataaaaatcaaagaagattaaataggtaatagttactttgaaaaaatataaaatgttacacagttgcataatagtgtgattatcttttgattaacataatgaaattcaataataataacaagatccacaatatcaaaatcatagtaaaatgaatcaggcttactctacatactgatgctgaatttttgtactcaccagaggacatagaatgttaggaaggctcataatcagaactcataatgaatactctcagatttttacagctgtaaagcaaatcagcaaaacatttagtggcttcaaacaatattggtttattacatctcatgattttgtgggttaattgggcacctctttgttcatcctcctgctccatgtgttataactggaatcactcatgttgcagcattaatctgggagctaaactggggctggaacatccaaaatggctaagctcttatctcccggaatctttctctacatgcctttcatctaattcaagcttcttggaaattgaagtctggattttaagaggaagcattccagaaggacctgccccacatgcaagtgtataaaaagcttctgcttgcatcatgtttgctaatatcctattggtcaaagcaagttacacagataatgcgtaggggaccacacaagagcctgagggataaaaggttgattgattgctacagatcagcagtctaccacagcctaagagctacccatctaaagaggacgatgtagaggttgagtttgagctctgaagccaaactacttgtgttaaaatcctgtgtaattattggtaagatttttacatttccaagtctgttttgctatcttttaagcaaggaggcttaaagagacggtccatgcaaattaatggaacagagtctgaaacggttttaggcattcatgttcattattactttttattattaatagtgtctgctatactccatttgttcaaattttgaattaaaatttatctcatatcaattacagaaaatgacaatgcatgcctttctactacaaatggtaactttctatatttttgaggagactgtagggtgagaggcctgtaactacataaataaatttggtgtatgacttggtcagaagtgatgaagcagtgcctcatttatatttgtgtttaattgcaggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaagcctcatctttccaaacttaaccatttgtgtatgcgtcaaatcaagcctgcacgcgtgcgtgcatgtgtgtgtgtattttccccaaatggtgatgatgagcagtgctttgcatgaaactagattttatcaattt

SEQ ID NO: 973 - DNA, 109070 bp, Homo sapiens
cactgcaagctccacctcctgggttcacgctattctcctgcctcagcctcctgagtagctgggactacaggcgcccgccaccacgcctggctaatttttttgtatttttagtagggacggcgtttcactgtgttagccagatggtctccatctcccgacctcgtgatccacccacctcggcctcccaaagtgctgggattacaggcgtgagccaccgcgcccggccaatttcctttcttagttgcctctgcccacctcttctcttctgcttccatattacaggtaaccaatcttaattgggttctattatgttagatttttctctactcttatacccattcacatatatacactctcaaatcaatctttttgtcatcatttaaaaaatatatgcatcttgttttctaactcatgatgaccttgtggaaagccctccatgttgattgttatggataaaattcaattctaaatggctgtatataatataccgtgatatggataataagaaacaaattcaaccattcccttcttgataaacattcactttgtttccagaggtttctatcttgttgggttttgtcacaaaacaaggctacaataaaagtagttatttaaaaactactttatctccaggtttaaagagcaaagctatttttcaattttaatgtatgttgccttattgctttctaagtactacaaataattacatttttaccagaagactatgacactgttctttactcatgtccttacagcaataggtgttgtaactgtttatgttattagttgttaaattaatttgaatttcttaactacttgtgaaattaaatatatttttatcttcttcagatgtttggacttcttgtgtaaatcatttattaatattcttgctcattttactgagatattagtctttttctcaatttatacattctttgaatattgtaattattaatgcttatcatagtaggtgttttccatattgtcggctgcctttgttcataactttatcatgcacatttaaaatatttgtatagacaatatatttattattgtatacattttggattccagtgttgattaatatgattttttcttattgctgcattagacatgtagtcttctagattttactgaaggatttttatttttaaaaattttagcatgggtttttaattcaagtggagttttaaaacacatgccataaatagtgagccaactttcacttcttccaaacagcttactaaatattttattcttccccttcgaattgaaaacacacttttgtcatattttaaaatctcatatataatgggatctatatttgtatccttgattctgtttcactgaccaatttgtccatttctatggcaacaccaaattgctttgattatatttgccatagattatttttctgatatcctaaaaagcatatctccttactgtttttcttcacaaatgttcttagcttttcttgggcacattttcttccctctgaacttttaaaaatcatattccaaaacaaatcctgtcactgctttgcaaatatttttaccaaacgaactgtttgtctatacatattttaaatgatattatattaaattgatatgttaatttggggagatgacctataaagtattaaaatttatcttccaaaaatcaggcatgttgttcaattttaaagaaattttaaaatctttcagtagggttttattttttatgtcatcattttatattccatcttttgcctgttaaatttatttttatatatgctacattttagtcactgctgtaaaatatatatatatatattcattttaatttctaggtgctattgctaatattaagaatggctacttttaaaaaatttttaacttattttatattcagggggtacatgtgctggtttgttacaaaggtatattgtgtgatgctgaggtttgggtacagttgaacccattacccaggtagtgagcgaactacccaatacgtaatttttcaacccttaatcccttcctcccttccccttcttgtattccttagtgtctattgtgcccatctttatatctatgcgtttccaatgattagctccctcttataagtgagaacatatggtatttagttttctgtttctgcatttatttgcttaggataatggcctccagccgtatccatgttgctgcaaagtacatgatgctgttcttttttataactgcatagtattacatggtgtatatgtatcatattttttaaatccaaaccactgttgatgaacgcctgggttgatttcatgtctttattattgtgaatagtgctgcaatgaatatatgaatgcaagtgtcttcttggtagaatgatttattttcctttggatatataccaagtaatgggattgctggtttgaatggtagttctatttttagttctttaagagatctgcaaactgttttccacagtggctgaactaatttactctcccaccaacagtatataagcattcctttttctccacaacctcgtcagcatctgttctttttagactttttagtaatagccattctaattggtgtgagatgatatctcactgtggtttgatttgcatttctctgatgtttagtggtgttgagcatttttccatgtttgttgactgctcgtatgtcttctcttgacaagcatctactcatgtcctatgttcactttttaatggagtttattttttcttgatttaagctccttatagattgtggatattagacctttgttggatgcatagtttgcaaatattttctcccactctgtaggttgtctgtttacttcgttgagagtttcctttgctgtgcagaagctctttagtttaactagagtctcacttgtcaatttttgtttttgttgcaattgcttttgaggtttataaattctttgccatggccaataatatggcttggctgtgtcccccacccaaatctcattttgaattatagttctcataatccccatgtgtccctgctgttcttgtgatagtgagttctcatgagatctgatggctttataaggggcttttcccccttttgcttggcacttcttgctgccaccatgtgaagaaggaaatgtttgcttccctttctgccataattgtaagttttctgaggcctccccagccctgcagaactgtgagtcaattaaacctgtttcctttataaattacccagtcttggctatattcgtatagcggcgtgagaatggactagtagagtatattaatatccagaatggggtgctgctataaggatagccaaaaatgtggaagcaactttggaactaagtaattggcagaggttggaacagtttggagggctcagtagaagataagaaatgtgggaaagtttggaacttcctagagacttgttgaatggctttgaccaaaatgctgatagtgatatggacaataatgtccaggctgaggtaatctgagattgagatgaggaacttgttgggaactggagcaaaggtaactcttgtatgctttagcaaagagtctggaggcattttgcccctttcctagagatctgtggaacactcaacttgagagagatgatttagggcatctggcagaagaaatttctatgtggcaaagcattcaagagaaagcagagcataaaagtttaaaaaatgtgcaggctgattatgaagtggaaaagaaaaatccattttctgaaaagaaatttaagccagcagcagaaattttcataagtaacgaggagcagaatttaatcaccaaaacaatgagaaaaatgtctccagggcacatcagagaccttcatggcagccctcccatcacaggcccagaggcctaggagggaaaaatggtttcttaggccaagtccaggcccccttgctgtgttcagccttgggacttggtgccctgtgtcccagccactccaaccgtgggtaaaaggggtcaatgtacatttcgggccattgcaattcccaatccttggtagctgccatgtagtgttggtcctgcaggtgcacagaagacaagaattgaggattgggaacctccacctagatttcaaagaatgtatggaagtgcctggatgtccaggcagaggtatgctgcaggggctgatcgcttgtggagaacctgctagggtagtgcagaagggaaatgtggggttggagccctgagagagtcctcactggggcactgcctagtaggcctgtgagaagaggctactgtcttctagacctcaaaatggtaaatccactgacagcttgcaccatgcacctggaaaaggtgcagacactcaaagtcatcccatgaaggcagtcagtaagggggctgtgccctgcgaagccacaggggtggagcttgccaaggccatgggagcctacatcttgcatcagtgtgacctggatgtgagacatggaaccaaaagagatcattttggtaatttaatgtttaataattgccctattggattttgtgcttgcatggggcctgtagcccctttgttttcactaatttatcccatgtgaaatggtgtatctacccaatgcctgtaccccattgtatctaggaagtaaccaacttgcttttcattttataggctcataggtggaagggacttgccttgtctcagatgagactttggacttggacttttgagttaatgctggaatgagtcaagactttaggggactgttggaagggcatgattgtgttatgaattgtgaggacatgagatttgggagggtccaggaccagaatgacatggtttggctgtgtccccacccaaatctcatcttgaattgtagttcccaaaatccccacgtgtaatgaaggagatgtggtgggaagtaattgaatcacgggggcacttacttccatgctgttcacatgatagtgagtgagtcctcacaagatctgatggttttataaggggcttttccctgttttgcttggcatttcttcttgctgccaccatgtgaaaaaggacatgtttgcttccccttccaccatgattgtaagtttcctgaggcctccccactcatgcagaattgtgaatcaatcaaacctctttcctttataaattacccagtcttgagtatgtccttatagcagcatgagaatgaactaatacagccaatgtcaagaaatgtattccctgggttgtcttccaggatttttatagttttaggtcttacatttaagtctttaatccatcttgagttactttttgtatattgtgagcagtaagggtctaatttcattcttctgtatgtggtttgccagttatcccagcactactttaacaatatagattctttgaatctatgaacatggaacgtttttctacttgattatgtcatctgtgatttctttcaacagtgttcccttttatccacattctcaccagtgtcagttattttttgtctttttaatagtagccattcaaactagggtaagatgatatctcattgtggttttgatttgcattttcctgataatcagtgatgttgagaattttttttcatgtagccattggccatgtttatgtcttcttttaagaaatctctatttgtgttctttgtccactttttactgggattattatttttttttctgtggagttgtttcattccttgtatattctggatattagtgcctttttggatgaatagtttacaattattttctcccattcagcagagtctctatactgtgttcatttttttcctttgctgtgcagaagcttttcagcttctactaatcccatttgtctatttttgtttttgttgcctgtgttgaggtcttagccataaaatctctgcctagacaaatattctgaattgtttccctatttttttctagtaattttatagttttaaatcttagatttaagtctttatttcatgttgagttgatatttgtgtatgaaggatatgggtccagtttctttcttccacatatggatatccaattttcccagtaccatttattgaagagggtgttctttcctcaatgtatgttctagtccctttgtcaaaaatcagttcactataagtatctgatatactgattttgtttccttcggataaatacacagtagtgagattgcaggattgaatgatattctatttatagttgtttttgagaaatctccacattgttttccatcatggctgtactaatttacattcccacaccagggagtatttccacgttctctattctgttccattgatctatgtgtctatttttataccaataccatttcctcttttggttactatagccttataatatattttttaatcaaatagtgtgatacttttgcctttgctctgtttgctcaggatatctgagcaaccaagtacagatgctcctcagcttatgatgtataataaacccatggttaagttgaaaatattgcaattcccaaatgcatttagtacatctaaccttctgaacatcgtagcttagcctagcctaccagaaacatgctcagaaaacttacattagcctacagttgggcaaaaatcatctaatacaatacatattttgtaataaagtttgaatatctcatgtactttattgaatgctgtactgaaaagagaaaaaataatggttgtgtgggtactcaaagtatggtttctgttaaatgcatatggctttcacatgatcataaagtagaaaaatcctaagttgaccctttgaatgttggaaactgtgtgtattgatggtgcggagtaatgaagatttttacttgctttgatcaatttagaaagcaatctgatttcatacaattaaaaatgtatatgccctatatatgcataaggagatatatataaagatgtttattgcagtattatttataataaaataatgaaaaattaaaccattaattaaagaatgggtaagtaataggtaatataatcatgtggtaaataccacaggtaggcaaaaaaatagctgccatgacttggttaaatgaaaagactggatagatttgagtcctggccctgtcataactttggatagttacttatacttttcctgcttcagcactgtaaaatatagataatgctatggtttggaagctctctccaaaactcatgttgaaatttaattgccaatataatattattgcaaactggggactttaacagatgattaggtcatgggagtttcaccctcatgagtggattaatgccatcattgcagaagtgggctagttattacaggagtgggctcctgataaaaagataagcccagccgccttttgttctctctgtctcacatgcttgcttacccttccacagtgggatatccctcaccagacgctggcaccatcctcttggacttcccattatccagacccatgagccaaataaatttctgttctttataagttactcagtgtgtggtactctattataacagcagaaaaaaagacatactattcatactgaaaagtgaggctgtcattatagcaaagtgctgaaaaggtggaagcagctttggaactagataatgggtagaggctggaagaatttggaggagcaggctagaaaaagcctagattgctgtgaatgtagcattaaaggcaactctggtaaggggtccaaacaagaggagagctgtagggaaacatgaaactttttagagattacataaggggtggtgaccaaaaggctgattgaaatattaaaggtaaaggccattttgatgaggtttcagagggaaatgaagaacaatgttttagacactggggtaaagtccatccttgttttacagttgtaaagaccttgagtgaattgtacccaaagcctgagggctttgcagaatgcagagctttaaagtgatgaactaggatatctggtggaagacatacccaagcagcaaagcattcaggctgctgcatggctgcttttaaccatatacagtgagacgtgagggatgacttcaataaagattgtataataaaataagaaacagagtgaaaggatttggaaaattcacagcctggttatgtaaagaattaaaaaaaaaaaagaaaatttcagaagagagcactaaggatgtggccaagtgacaattgccaaagagattaatatggataaaagccaggtgctatatatcaagaccatggaagaaagaccctgaaggcatttcacttatcactgaggttgccccttccattataggcccagagctgtaggagggcagaatggtttctggtgatggtcttgaagcatcctccatgggctcactgcccagggttaacttgggtctccactcattgtgattctagcaatgtgcccctagtctgcactgggagcatctcatatctaacattttgatttaacccttttccaagtgggcatgcccagtcagggatctggtttagctctccctgatctactttgccccactgcccaggtttcccaaatcacagaactcataatccttgtgattacttgctcaatgctttgtcttttatataggattgttagcttaatgaaaactgttaagcccgaatattgtgtttaattcacagcagaagatcctaaatgagtaatgaatgaataaaaattatagaaatatatgcgtatatgttaataatagttgggtcttacagagtatttcaaatagtagccttctttccactcatctgaatttggagctatttagagatagacacacaagcatatatgcttccatttaggatagatgcaaacatatagacatcaaaatatcagctttatttctgttgaaactatttgagaatgtgtctagggactgtgggcaaggagtaaagttattcctaaatttgacagatttcccccactcaatctctcattacagggagatggctaacttcgtatatattacagttcatatcatattatgtgtgtatgtattacacacacgtatattacacacacacacatatatgtttatgtataggtcatctccctgccatatatatatacacacgtacgtaaatgcacagagagcatatgcactttattggcagcaagattcaatggggagcaacgaaaaggccagagacactcaagttcagtttcttcttcccaagttctggattcttggagaagtgagggaggagtcaggcaacttacccaagagaagatttcaggaatagagaataagttatctctagaagggggtaatttgggtttttggtttttggtttatattttctatgttttccaatgatcatgcactatttttaatcagataaaaattcctaaaacataaattgcaatcttaatttttcttggcctcttattttctcacaagtgttaatttggccaattcacaatatacatatatgcctgtgtaaaattgtagatctcctgtgtgggaatgaaagaagtatctgatggagaaaatgaacaaatagcttaaaaatatataaaagagaaacatctatattaactattcacaattacttggggatagcttcttgtgtgagaaaattatattttaaatgaagtggctggtgccaagtgatatgagtactaatttttttttaatgatactttggtaatgtggtcaaaatgtgaaataacttatctttttttttcaatatttttctactacttctcagtaagcatgagttttgttggaattattgtgaagttttagagttagaatgtaatctttttcgtaatttcacagatcatattaaaatttacaaatagttatattgcttatagagccacagtgaggggtcaggtttcttattctgccagttaatgtagtgtctgctttagaatactgtcatctaccctagttcacaatttttgaagatcttgtgaaagaagatatgtagggaagtcaataacaatgaatcttccaataaagaaaaggaagaaagttctcattcccttattttttgaacctaccttttaacagatggttttactgctctattacacagcataattggattgttttatctgaaagtgaataataaagacaaaactttaaaaatagaactgtttgaactgagagctcacttttattaagagaacttgtcctatgaaaattattatttggaaacagaaaccaaagtacatatattaaatagcatcttttgcaatcaatgtcaaggctgtgttgtgtctttggttgtcttttggtaaatctacaaaggagcatcaacttagtgtcctcataaaagacatatatgtgttccactacattcagtgtgaacaatattttaatttagcttgccaagatatagtgaaatagaatttttgcagggtgattgttctgttaaaaatatataaaagggcctagaaaatgatcttttggctaaagctgtagaaaacagactgccattgatttgcagaatatgctgtttgatgtttagacagctggaaaaagtttggtaggagaactttaaaaacctgttataattgtagccttgagtatgatatgatttggcaactaagagatcacctcacaaagctatgatccacaggcaatgcagtcttaggtattataaattcatatttatatcaaaaattccaaatatctattgagatattgtgatagaataagaatacacattttggtcttctttcccagctcctggccagacctcctgaaactcttgtaagtgctagtgataagagctataggagcaccttttattataatgtaattggtttttgttcctagctcttgaaatgcttctaaaaatgtgaaagaataaccttttgctagtcataacaagccccattcaactacacttgaatttatgtcaacgaagtgacttgtggaaagcccctaagggtgggggtcactggttgtgaaggaaatcaacaccatgattagagggttggaatttttagcactcccatccaaacctccaaggatgggagaggggcttgaggttgagttaatcattagtggccaatgatttaacaaatcatgcctatgtaatgaatatcctaatccttcatgaatgtcctaatcaaaggagtttggagattttccatgttagtgaacacatggagggctgtaagtctcaatctccaaactatacaaaccaagaacaaataatttcacacaaatcctttgccattgacattaaccagaagacagggtactatataaacccaaactaatattttaagcccccctaaccaactgaatggaaccctcttctttgccaagggcattcaaaagttaaactgaaaaactagttcagtctgtgatgggaaggggggttgtacgtgcttcattatacactcctccctttacaattcgggcacaactgaacagcattaacattaaaactgacaccttaagaatgacaaaacagactctttgcagcaataaaataccaaattccaacccgactctattataacatgacatggcaaatagcaggccctgaaggaaagcaacatgttttacctcaaaatacatttctttgatgtatttttttaaattatactttaagttttagggtacatgtgcacaatgtgcaggttagttacacatgtatacatgtgacatgctggtgcactgcacccactaacttgtcatctagcattaggtatatctcccaatgctatccctcccacctccccccaccccacaacagtccccagagtgtgatgttccccttcctgtgtccatgtgttctcattgttcaattcccacctatgagtgagaatatgcggtgtttggtttttgttcttgcgatagtttactgagaatgatgatttccaatttcatccatgtccctacaaaggacatgaactcatcattttttatggctgcatagtattccatggtgtatatgtgctacattttcttaatccagtctatcattgttgtacatttgggttggttccaagtctttgctattgtgaatagtgccgcaataaacatacgtgtgcatatgtctttatagcagcatgatttatagtcctctgggtatatacccagtaatgggatggctgggtcaaatggtatttctagttctagatccctgaggagttgccacactgacttccacaatggttgaactcgtttacagtcccaccaacagtgtaaatggaagtaaagctctcctcagcaaatgtaaaagaacagaaattataacaaactatctctcagaccacagtgcaatcaaactagaactcaggattaagaaactcactcaaaacagctcaactacatggaaactgaacgacctgctcctgaatgactactgggtacataacgaaatggaggcagaaataaagatgttctttgaaaccaatgagagcaaagacacaacataccagaatctctgggacacattcaaagcagtgtgtagagggaaatttatagcactaaatgcccacaagagaaagcagggaagatccaaaattgacaccctaacgtcacaattgaaagaactagagaagcaagagcaaacacattcaaaagctagcagaaggcaagaaataactaaaatcagagcagaactgaaggaaatagagacacaaaaaacccttcaaaaaattggtgaatccaggatctggttctttgaaaggatcaacaaaattgatagactgctagcaagactaataaagaaaaaaagagagaagaatcaaatagatgcaataaaaaatgataaaggggatatcaccaccgatcccacagaagtacaaactaccatcaaagaatactacaaacacctctatgcaaataaactagaaaatctagaagaaatggataaattcctcgacacatacactctcccaagactaaaccaggaagaagttgaatctctgaatagaccaataacaggatctgaaattgtggcgataatcaatagcttaccaaccaaaaaaagtccaggaccagatggattcacagccgaattctaccagaggtaaaaggaggaactggtaccattccttctgaaactattccaatcaatagaaaaagagagaatcctccctaactcattttatgaggccagcatcattctgataccaaagccgggcagagacacaaccaaaaaagagaattttagaccaatatccttgatgaacattgatgcagaaatcctcaataaaatactggtaaactgaatccagcagcacatcaaaaagcttgtccactatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggaagtatctcaaaataataagagctatctatgacaaacccacagccaatatcatactgaatgagcaaaaactggaagcattccctttgaaaactggcacaagacagggatgccttctcacaccactcctattctttgagatattttgaaaaggccctgcaaaactgtctcttgtgggaaaaatctacattctgtagagaatccctttccctttccaggtcttttccctgatttaggagagattaactaagagtctggcacctttttaagcctaataagaaacatttacaatctattctctttgaagcctgctacctggaggcttcatcttcatgataaaaatcttgctctttacaatcgcttatcttaagcagacactcctttctattaatttcaggtcttacataataacttaactctttcaaccaattgacaatcagaaaatctttgaatctacctatgacctagaacacccctaccccttgcttcaagttgtcctgcctttctggaccagccagtgtacatcttacatgtattgattgatatcgtgtgcctccctaaaatatataaaaccaagctgtagctcgaccaccttgggcacatgttctcaagacttcctggggctgtgtcgttggcaatggtcctcaggtttggctcagaataagtctcttcatatattttacagaatttgactcattttgtcaacaacttcaaaccaagttatctgtaaatagaaaacaataataatgacaacaacaataccaatttcaagcagagatgtttctcaagctcccagatctccaggctatgtggagaacaaagtgaatctgggggaaagaaaacagcatggaagagataatgagagaacagagagcctatgagtgaactaaaattgtccccagaaagagaaagtttaccctaggaacaaaaatactataaatagtactggaaattctataagaaagttatttttttaatatccaccagcaatgttttgtagttttaagcatatgcattttatacatcttttcttaaatttattaccatgtattttgtttttttatttatgataaatcaagtactttaaaaaaatttcttccaggttatccattgccaatatatagaaatacaattattatttgtaaattgactttatatcttgagaacttactaaattattatttatgatgactttcatatagattcaggattttctatgtacacaatcatgcattatgccaataaagacagttttagttccttctttctgatctgtatgtcttttatatttttttctaatgcactagctatatctccagtacagtgttaaaacagaaagaacagacatctttgcctattccttatctaagagcacagtattcaatcattttaccattgatgactatagtaactgtatgttttgtataggtctcctttctcaaattcccttttctcctagttttaaaaatcataaacagtattgaatagcatgttcatattttgagtctacatttatgagaaactcaatattattaagattttgattctcaaaattgatctatagattcagttgatctatagacactattgatctccattcaatctatagattcaatccaacaaaatctcagcatgctttttttgaagaaaataataagctattaatgtatatggaaaagcaaacaacctagaagaaacaacaattttttttaaatgaacaagtttaattagactacttggtttacagatttgctgtaaactacagtaattgagacagtgttgttggtgtaagcacggccatgtagacaaacagaacacaatcaccagtacagaaatagacccacacttatgtggccaatttattttagacaatggatccaagataattcaattagaaaaggttaatcttttcaataaatagtactggaactaccaaatattcctataaaaaattaaccttaactcttacattacaccatacacaaaaattaaattgaaatggaacataaatgtaaacatataagctaaaactataaaccttctataaaaatcataagagaaaatttttgcaaacttttacaggaaagatttcttaaatataacacaagaatcacaaaccatgaaagaaataaactgacacaattaactttatcaaaacttaaagaaacaatttttttgctctctgaaagacacagttgagaaaacaaagagacaaaccacagaatgggagaaaatgttttgaaaatatatattttacaaagtactttatccagaagatataaacaattcttataactcaatgagaatacaaagaaccttcacaaatggagatattaatagctaataaactcatgaaaaactgttcagagttctgtcttcatgaaaaagaaaactaaaaaacaatgagacatctctacaccatcatcctcaacaagggtgatatcatccccaaggtagcaaaaattagttcttaggtacagaggaaaattttctatattgtataatatacagattttatatgtacatataatacatatacacacagtataaaacagatactattaaactactaatatatgcaaaacatcaatgaatcttaaaaagcattagactaagtagaagaaaatcttaatatccacatacaggtatacctcatttgattgcactttgctttattgtgcttcacagtattgtgtttgcaaattgaaagtttgtggtaaccttgtattgaacaaggctatcagtgccatgttcccatgttccccaagcgcataggctcacttcgtgtctttgtcacatttcggtaattcttgtgataataaaaaagtttgaaatattgcatctgtgaacatgatctgtaatgctattattgtaattgttttggggtaccacaaactgtgactgcataaaatggcaaaggtaatagataagtgttgtgtgtattctgactgctctaccatagcacatagtagagcagatattctcccctctccctctccttgaggcttcctattatatgagacaaaacgatatcaaaattaggccaattaataaccctacaatggcctctaagtgtttaggttaaaggaaaagttgcacatctttcactttaaatcaaaagctagaaataattaagcttagtgaggaaggcatgtccaatgccaagacaggccaaaccctaggcctcttgagccaaacagctagccaagttgtgaatgcaaaggaaaagttatcagaggaaatttaaagtgctgctccagtgaatacatgaatgataagaaagcaaaatagctttatggctgatatggagaaagtctgagtcatctggatagaaaatctaacaagccacaacattcccttaagttggagtctaatccagagcaaggccctaactctattcaattctatgaaagctaaaagaggtgaggaagctgcaggagaaaagtgtgaagctagcagaggttggttcatgagattcaaggaaaaaaattctctccgtgccataaaagtcaaaggtgaagcaacaagtgctgacacagaaactgcctcaggttatccagaagttctcactaagatgattgatgaaagtggctacactaagtaatagattttcaatgtgcatgaaaacaccttctattggaagaagatgccattgaggactttcatagctagagagaagaagaaaatgcctggcttcagaacctcaaaggacagcctgataaggcagctggtgactttaagttgaagccaatgctcattgattattccaaaacccctaagttccttaagaattatgctaaatatactctgtccatgctctataaatgaaacatcaaagctttgatgacagcacttctgtttacagcatggtgtactctatactttcagcccactatggagacctactgctcagcaaagaagattcctttcaaaacattacttctcatttacaatgcacctggtcactcaagaactctgatagagatatacaaatagattaatgtagttttcatgcctgctaatacaacatacattctttagtccatagatcaatgagtaattttgactttccagtcttatttaagaaatacattttttaaggctataaatggcacaaatagtgcttcttctgatggacatgggcaaagtaagctaaaaaccttctggaaaggattcaccattttagatgccatgaatatttgtgatttatgggaggtagtcaaaatgttaacattaacagcagtttggaagaagttggttcagatcttcagggatgattttgagaagttgaagacttcagtggaggaagtaactgtggatctgatggaaataacaagagaactagaattagaagtggaacctgaagatgtgtctcaattgctgcaatgtcataatcaaacttaaacagatgaggagttgcttcttatggataagcaaagagagtggttttttgtctgttttttagagggaatctactacaggtgaagatgctgtggacattgttgaaatggcaacaaaggatttgtatataaatgacatgagtaaaaccacaataaagtgatatattgaagcctattgaataataaaagaatatattggttcatactgaaataaacaaatagaagaaagctcttccttatattggattgccaactaacaaatacaaaagaaataatagaatttaaaaattaccacttggcaatcatcatcatcatcatcattgactcaggtgggaaacatcaattaaggctaaaactggtgggtgcaggtttgctgaccatgtgagtttcctagggctgctataacgtatcatcataaatgtggtggcttaaaacaatagaaatttattttctcacagttccagaggccagaaatctgaaatcaaggggtaggaaggaccaagttgccttgaaagatctccgagaaaattcttccttgcttcttccagcttgtggtggctccaggaacaccttcgcttaaggcagcataactccaacctttgcctttgtcttcacataaccttctttgttgctatgtctgaattttcctctgcctttctcttacaaggatatctttcactggatttagggctcaccctaaatttcgggtgatatcattttcagatccctaattatgtttgcaaagaccctttttccaagtaaggtcacatacatagattccaggtggacaaatctttggaggagtcacaaaccaatgcacaacagtgaaaataggatatttacagagtatctcccacaatatacttattaagtgccaagggaaaagtagatactccataatggagagacctggcaaatcaaggtcaatgtcatcaatagtagtacaaatgtatattgcatccctccatgcgtgatgcactatgaagagtaccgtgtcacttctaccacatttctgccaaaaatgcataatgtgaatctaattctgagaaaacctgcacaaatccaaatggagtggcattctgatacttccagaaacctcaaagttatgaaagacaggaagagaggatggagaggcttggctagttaaaaattgtactagaaaaacatttcttcagctctaaaagacattgccaggaggtaataatatttgagtaaggtctttgggtagagacagcgttttatcagtgataatttcctgattttgattatcgtgttgtgtaggagaatgtgtttattttatggggagtacacactaaagtatttatgggcacagggacattatttcaataacttactcctagagagtttagaaaatactatgtatatacagaaagaaaatttagtaaatatggcaaagtgtgaatatttggggattctgaaaagtatgtggcagttctttgtataactgctgtaacttttctctagttctgaaattatttcaaaataaaaagtaaaaaaaaaaagacttttgaagaaaatatctacttaccccagaggagtctggttcccaaaattcattgtggctggaacactgatgtgatatatgttttaatgcatataagctggtccctggcaactaagccagtgacctgactggttttctgaagcagcagtgaatatttagaggattgtatgattgttcttccttatcagtctttgaatgggcttatggaaaataagacaacttctggattgtttataatttaatgtgaattatttgactgagttttctacttagggtttcatctaacatggatttttttgtaaaacccatgggattggctgtttttcctcattctagggtcaccaggactttttcagtatcatgtctgtcacaaacctttcaagtacaattggatcttcatgattttaaggcccaagaggcacagcagctcacaccacagcatgtacctgctgcaaaactatctcctgctctgggccttactcaaacttcatagctctagcaaatacaccagtaaatccgttacaaaatattgttcacataagccaaataagcctatcaagtgcagtacttctttgttgttgaggatgtacaaattaatggaactctctttccctttggagggaatagctattctggccgtagaccattgttctcctagaaactttattcaggtggcaatttactattttggggtgtgtgagaattatctcctatcctctagtactcatgtgtcttatcaaggcatctcatgaattagctaatttctgcttaccaggtctgattaatatgatttcattgatttagtagggcagtgtaatgacaagatgggcaaggtctgcaagatagattatgacagagttaaagaaaagatatagtttcacatagcgctgagagaaaatgtatactactatctctgcacactgaaaacaaaaaactggttttttgactagtttgataatttgcatagagaaaacatatttgtcagactaagagctgcacaccagattctagggtcttctatactatgggatttaaatttgcagtaagtccctgtcattttccaagacttatctgtcttcttaaataggcaatttaacagggatgtaagaggaatcaacaactctgtgtctttgaagtctttgatgatggcactaatctctgtaatgccccagtgatatagtaattgcttttggtttactatctttggggaggagaaaattacagggtctttaacttggcccttcgtattcttatagtattaactctatggtgctgtgaaccaaagtggggtttcttctaattgctgagtatggatattccaacttatattaatatttagtcactaaaggaagaaaagagcatagcatgtttgcagacctactgggtctactgtgagacagactcaggctaatgttctattattatctgacctccgtaagtctccgctataacttgtggcccagaattaacttgggaacctgcacattaacaatgaccacaaatcctggaagacctggttatttttccccccagataattatcactttaataattagctgcagtttcctttattaaaacatctatggaaatatttgaggcagtgatatatgatgctttctcaagtagatccagcttcccatttattaaagagattttatgtctatgaactggttcaggtctaaaaattgggtgagagactatagttttccattgtagtgacttgagacagatgtccaatctttattcctaaagtataactttagtggaaagtacacctacttcaattcttgagtcaatggcattttgtaataatctctgtgtgtcagacgttcttactaccttattcaacctacctcccattagaataagcacacccatctttgtctggcagttaagtgtctgtctgtccaggattccataatagctattgtaatcaaggaacctctttcaatgacaccatctccagctattatgtatctactgatttcagaatataaccatacccaaggatgctggcatttcactgaccaatgcatttcccagtgctttggtaaaatagaaagttctctgggccctcctagtgatacaatgaagaggtagattccctcctcaatattataacaaaagtgttcaagaatataattttatttaatgtagattaatgttgaatttaatgaaccaagaaaacagatttattccagttgcgtaaaacagtatattaaattctgaacctttgggggaaaacaacatatgtaagtatagacgttgagctgagaatttagaaccccgagcttgtcattcttattattatttggggatttttccgatgaggtcagaagccaacccacctgagtccccttcatcatcacttttctactaaagtccccatttagtagctgctgagttgttcattctaaaccttgcctttaatggacatttcattctattaaaaaacctgtgataatttaagtaacttttttgccactgcatgttagagattacaaatatcacatttttcactgcaagccatttatgtaccttatacaatatcagtcaacagtctcttaaaggagagtttcgacagcagaaagacatttaagtcagagaatatatgctcacaaaagcattagaaatattggaggatcaaagatcagggaaagctgctgctggctgtaggttttagaaatctctatcaagttttagaaaaaaatcaggaaggtgtggaaccagtgtcttcactgcagcactgacagtcatgatttgcaaagcacctggaggctagtgaaacactttctatctgctgaagctcatagagctgactgtcactgctggaggagcaaagtagagctttctgcctgtctttcaccttccaaatctcataactgctttttgctgttgcacctaacccagaactaaagaagttacttgtttccagccctgcgatacaggaatattagagaaaagctgagactgtgctaatctatcactagacaaactgacatagtggttaagagaatgggctttgaagctccggagccagatcacctgggttcagagccaggttcctccacctactatttctatgaccttggcagggtgcccaatttctttgtgcctcagttgtgacagttttgaactgtagctaatctccctacctcaaagatttttaagagttagttcaatatactatatgataatgcctgacatatgtatttctttgcaggaacatgggtaaagctggaaaccatcattatcagcaaactaacacaggaacagaaaaccaaacacctcatgttctcactcataagtaggagttgaacaatgagaacacatggacagaaggaaggaaacatcacacactggggcctgttgcggggtgggaggcaaggggagggagagcattaggacaaataacataatgcatgcagagcttaacacctagataatgggttgataggtgcagcgaccaccatgacacatgtatacctatgtaacaaacctacatgttctgcacatgtatcccagaacttaaagtaaaataataaatacataaggacagaaagaaagaaattattactaaaatatatgaatgtagaaaatggttttgcaaaaatgcaaataaagtgattaggcattgcataatctgtttggaactctttggtactcaatttttttttttatttgaggtatttctttccacgggaaccataactatttaactattttaggtttacgttatgtttgaggctaaatatactagcagctagcttatgtttaatcagcattgcttttacataaaggacactcatctgaaagctcaaggtagtatacttaagtcattatattttactttttcatgaaggccaaggaaaaatgccacaggtctttttactcttcttggtaggatcataattttgttaaatgtccataaataattaagatgcctctaaaggtttgctccataactataaagtaataaaacaaaatcttccaatttgaatttctctggaagcattgattgcaacttaatcaattaaacttttcacaaattgactttataatttcataatgttttaaattcattcaagactaggtatactgtaatagattgtaaaaaaaaaaaaaaagaagtcgtgagtcttcattctttcccgtatctatgtcctttccaatgtgaaattgtagcttcttgcataaagacgtgaaatcttcccgatccctttaatatgggctgcacatgtgacttttttttcccaacaaaatgtaatggtactccaggttgaggctttgtgattctttcttgctcctctgcctttatcatgagaagatgctcaagctggcctgttagaggatgagacttgtggaaccatatggagcagagctgattcagcccagttgtctcagttaaagccccagatgtgtgagagaggccagttgaaattagcaaagccagcctatagctgaccaatgatacacagatgagccaaaccaagcccacttcatattagttgaatttctaggagacttttgagaaaacaaaacaaaacaaaaaacactgtacgtcttgaaggttgtgtagttggttgtaattattgcagcaacaggtaactgtacatacacagtgacatgattacaaactgagcagtaagtatatttaaattcaaaaagtatttttgtttagcaatgttataatagtagcagtttcatctttttgatgctttttctaaatatacaatataatgctttcaaaaacattaatttagggaaaatttagagcatctgcattcataaccaaaagtatgtttatatttgttattctaccaagggtctataaaacaagtctaaagaatttattcattggcaaaatgaattttgcatggcaaaattttatggcaaaacatacaaatcagaagcaattattcattccttgcattttgcattctacactaacttgctgcctacgtcgaagcaaacaaggtaatttgaataaataaatggtttctctttaataatgttgtgcagcagggaagtcagcttctaaagaaatggttttgaagtgattaagaagaaaaagctttataagtattttaaggctattgagttactctgaggataagtaggataaatgttatgagtagaaagcagagcaaggtttcaagcattcagcaggcaaggtttcaaaacataatattagttggcataaataaaaataaaagttcttttcagtattgcttgagaaaggcaaaagtggttatttccagtcagcccactttaattcagtacctggtgaagttttccagctggggcatatggcgcatagaaatgacttatcaaaagaggggcttcaagatagttcaagaaaagttaatcttttacctataatgtgttagccattctgctaggtactgagaacagagctggccaaagacaatgattttaaatctgtgtgaaatgcagaataatagtatatgcaagacatgagaaacaaaatttgtctatgtggctagagaatgattcacagaggagaaaaccaatgactgggtctcgatttacgtttatagtttaccatttaggaaaaaaggatgacagtaataaaaaggaacagtataaacaaaggcatagggatgtgaatgagtgagtcacaatggaaaattccacccaccaggaacatggataacccaggacagaagaggatggaggtaaaatatgatagtactgatggtatattagttatttatttctgcaaatgaattagtgcaaaacttactggcttaaaaacaacaatattaatctcacagtttctgtgggtcaggagctcagcatggctcacctgggccctctggctcaggatctctcaggctgccatcaaggctgctgtcagcctcatctggagggacagtgcagggaggatccacttccatgctcactggtcatcagcaggatccagtttttgttggctattggcctgaggccaccctcagttccctgccaccctccgtaggcagttctcaacttctcagcttgtaagcaagcatggagagccagagagagtgtgagcaagatggatgtcaatcttttgttacctaatctcagacgtgacttctgtcacttttgccatattatatccattaaaagcaagttactagatccaacccactcttaaggaagtgggaaggaatataaagcaaggacatagatagtaggagggagggatcattgggagccttttagaagcagtccccaaaagatggtaaaagtaattccatccatcatgagtgacagtactaggaaaagaggtcggtgataaggatacatgaaattgatgagacagacagttggtaaatgatagggaacattttagtgttctactgaaatgactagagagcctgcataggtaggatacattgatccctgtgagtagggctaaacaatgctaacaatgatcacctgagacatctaggaaaagaagagcttcgaatgcccacgtggtggagacttgtttcttacttcttctacacaggcaagatgctgctggagggatgcttgcagcctaacctgactgccaaatatgaaaagagaaaagaggaggtgaaggacagagcacaatatcaatgcatccaagttgtccagtggccagagacagaaatctgaaataaaacaaccagcactggttgctcagagaaaaaaaaaaaaacaaagcttatgacaaaggcaattttcacaaaaataatatcaagaatattttaaaagataatttagaggattaaaaaacttcattaaaaattatttttgaatgaaataattccataggcaagtggaaagaaatgacattaacattgagaactgaatcagaaactgaaatatcaagttaaagaatcaggtctctgaaaaaaatcagagaccaaaaggaatgcgatggaaataatgaatgcaaatatgtaaataatcttaattcttaaagaagaaaaacatatcaagaaatgacaggcaatcactaaatatatgagagaaataagctcttggtctcaaaaagactttcttctccaaaagattgaaaggaaaatgaaattccattattaatgttttaaaagaaactcctgatcatatgttagtataattactgaattctgagaataaaacaatttatcctattgtaaattatacaaattgacccaaggagatacacattttcttctaagacactctctttcagccaaagtggtttatttgctattcattaaatgcagggcaccatcattcctagtcccattttcttctagtaggagcagcctttccccaactacacagttggaattggagagccaaagagagtgctgtaataattacattaagactagcagcagggtacaggaactatcccaggcaaatctggtcctgtggttctccctacccagatcttcagaaggctcatccttgcgatgcccttaggactttgcttaagtgtcagcttatccacttccctgaccatcccctagtgaattaatgaactactactcatgcaagcccccttaccctacttgatattttgcctcatatattatgcatttatttgttatatctctccacctgtcttagttaatttgtgctactacaacaaaataccagagacaattgtaaagaacagaaatttgttttcccatagttccggagctttggaagtccaagatcaaggaactgtcaggtttgattgtctggagagggctgctgtctgcctccaagatggcaccttgttgctgcatcctctggagaggaggagtgctgtgtccttacaaggtggaaggcataagggcaagagggccaaacacctagtgaaggctctttcataagggttttaattccactaatgaagaaggatccctcatgacctaatcacctcttaagagccccacctcttaataccatctcgttggtcattaagttttaacacctgaatttttgaagcaatacatccaaatttatgtccctcttagatgaaaaatatattcagtccattcccatagcccctaaagtattaactatttctagtatcaacttaaaagtctaaagtccaaagtctcatttaaatatttctcaatcagatatgggttagatgcaaaggtgtatatcatctgtaggcaagtgtccctttagctgtgaatctgtggaattaaaaaagttatgtgcttccaaaataggtggtgggatgggcacaagttagatgtttctgttccaaaagggagaaacaggaaagaagaatgaggtaactggtgttaagtaagtctaaaatccaacagggcaaacaacactctatcttaagccttgagaataatctttgactccatgtctcacattccaggaacaatggggcaagggttaggtccccaaggctccaggggactacaaccccatggctttactgagtgtaccccaagcagctgccctcacagattgaaattgggtgcctacagctctcccagactggcattccgcattggtgacagatctaggctctctgaggtggctctgctcccatggctccattaagaattgctctactgggggctctctgcagtggccccaacccctcggctctgctgggcttttcccaggttggggccttattcaacacatgagcaacagtcctctccctgggccccgatcctctctgaggggcgtcctttgaaatcttggtggaggtgaaatcatgccaccacaggtcaaggactctgtgagcctgttgaattagcatcgtgtggatggattctcctgtttatagcattgtggcttacagatcatgccttgcagagcagtggcccgagttctacctggcccactttagccaccgctgaagtggccagtgagcactgtaccagaatatggaaagaaaggacttacagtaacgttgggtggaaagccctgaggccccacagccaccctgggctcctctcttccagcttttctgttctcaaggcctagcactctgggtgtttgatgggtactgcagcttctaaaatgccttcagtgtcgtgctcccattatcttaatgaataatacctggcttccttctattcataataatcttatcaaatggtctcttgggtataccgttggttttctctcctaaacaagcttttaaaattctgtacatggccaggctgagcattttttcaaatctttatattttacttttgttttaactataaattccttcttcagttttttttctctcttctcacattttactataaacaggagaatccatgtagcaccctgaatactttgcttatagagatttcttccaccaaatttcctagttcattgcttttaagttctgcctcctacaaagtcctaggacatagacactgttcagacaaattatttttcactttataatgaggacagccttttctacagtttccaataccttgtttcttatttccatctgagacttcattagaatagtcttcgctaaccatgtttctaccagcattctgttcacaaccactttaagtaatctttgggaagaatgaacctttccctgtagctctgctcttcttctgagccctcatcagaatcacccttaacactccattcatggcaatacaggcttttttcaacatttacttcaaaagttttccagtctgtagccattacccaattccaaatctacttccctatattttggtatctgttatagcaacacccacttctttggtactgatttctctcttagtccatttttatgactataacaaaatatcacagactgagtaatttttaaagaacataaatttatttcctcacacttctgaaggctgagaactccaagatcaagatgtgggcaggttagttgtctggtgagggctgttctctggttccaagatggcaccttgttgctgcatcctctggaaaggagtgctgtgtcctaagatggcagaaggcatatgggcaagagggccaaacactgagtaaagctatttttataaaaggcttagtcccatttattagaaaagagccctcatgctctaatcacttcttaaaggccctacaatagtacttaataatatcatgttgcccattaagtttcaacacctgaattttggaggagacatgctcaagccatagcaccacttctatgagagcagggccctctctgtttagtttactgctgtatctatccttgtgcctagaacagacagtggcatgtcataggcattcagtaaatacggttgaatgaaccaatttttgaattaatgaatgaataaatgaacaaagcagaaaaattatatagatcaatttccatagaaaaaaattggaaggggattagcagatggattcaggtgagaccgcatagaataacggttctatgctagagaatagaacttaataatgcttaagttctagaatatgaatgcctgaggttcttagtttttttttttttttatcttatcttttttcctgcatggctctagacacatatggtttgatttctttatttccaggtctcctcagttgcgaaattaggatgttaattatagcttttgacatacaagaaacatcaaaaagattgaatgtcttaataagagtgaagcatgtagatcagtgactgctatgtaagtattctaatattattttgatcttttgaaaaagagataataccaacactacttaagctattctgatgaggaaaagataagaatagcataacagtaatgctaagccttataaagactgactaaatctcacttttaactagagaaatatcatttatgactacagatttttaaaaggcaaactattagcaatctggaaattagctgtgtgtcaaaagaacactggattatgacctatgaaaaaatatgaatgcaaaggtagtcaatagtaaattatcaaattatatcattatgtaaacacaacatagcattttaaaaactataattgtacaatcacgttctaaaaaggcatttcaaataattcagcagtctttcctgattaaagtgctaaataaaatataaatttaaaaaacttttaagtataaaacagggtcttcaccaaagtccaaccggaaaaattctaaaaagtgaacttttaaagccatttttattaaaataggaatcagacaggtatgcctatgatcactgcagatgttgttattactattagtcaacatgaaagttttaaaacgtttgcgataagacaagacaataaacaacactgacaaaagatataataaagtcaaaagcttttccatagattagaaaaatatttaatgtacagaatatttctgcaaattaataaatgacaattagtaacagaattattggaaatatgaataggaaattcacagtaaagtaaatttaaatggcaaataaacatgaaaatatgttcaacctagtaataaggaaatgtaaattgttttaaaagttacagaataccttttctatatcagattggtaaatataaaaaaattgatcatacaaactgttaataatagccgacatttataatcaagtactgatttatgctagggactttttcatgttctatgtatatcaagtcatatattctttgtaacaagcatatgactaaaactaatattagtctaatatatcaatactggtattattattcctattttacacccaattaaaccaaggaatatagcaatttagtaatttactcaaggtctcacaggtgaaaagttgaagagctataattgatccctagcagattgaccctagagattgctcctttaaccactacactaaattttctcattgctatcagcaacataagtaaagtgtccttctcatatatagctcattgaaataagaattattatagtttttatagagtaacccacactatttattgaaattagaactatggcctttggcccctcacttcacttctaggtttgacaatatttatttgtgaataagcattccaataggaataaccataagcaaattcagggaggtagaggaacacacagtttttaaaggaaaaatgaggagggtcacatacatttttttaagaaaattatccttggctacaagtatcaataatacgggtggcatcagtccaaagttggacaggcagttgctgggcagatatcctcatggaagtatcgtgtgtgtgtgtgtgtgtggggggggggggtggggctctggtggcctttgtgcaagattgtgtttttatgcagagtgttttgtgatagttattttatcagacacaaatgcctgaggaccctcccctcatggccttccgcagctccatttgtcagggaagtggctccattttgattctgacaactttcacacactttataggaaaaaaaagtacatgaatgtaaagatgtgtacaagattgtttattgcagcatgtagtactaaggggtggatgcatagcaataggtttaatgattgaaaacgtattgtatacttgtaatgaactttgtggttgtttttataatatccattcccattttcttaggatcaaatttatttcgacaatgtttcagccttcaccctcttgccaatagttcatgttctttgagagggagagtaacagttgactgcatttctagttttaaaagtggtacatgtgactgaggctttatcactgttagcaaattatcaaaagcaaataatgttgaacattgactgagaaaaaaacataattctggacatcatcttcagaaagtatgattcaatagctctagagttactcctccaagaatctatgttttccttttttgttaaccaagctctccaggtgtttctcatgcacagacatgtttaaaaacaagcatgaatatcgtaaatgtcaatgctgtatggtaaatatcacctagctgagactatgaattcatggaggaaagtgtaattaattactaaggtcagaggtacaggcaagatttgacactttattgatttttgagtattaagtgagattttgtttttgtgaggagcgtgtatgaccccccaaatagaagatagtacagagtggattcttggaagatggtgcagcataaagcatgtgaaatctttctccctaactagacaataattgcactggcacaatctgtctgatgtaactattttggagctctacagtgtattgaaggcttgcagttgaagacttggatgataacttgcagttaatttcagtaaatttcaactcttggcacaaaaccatccatcccctacctctcagccacatgacaggtagatctgcacatgtacctggaatagcttgaacatagcttgaagaagcctgggtgcacaaaaaggaccctttcctttatatactggggatctatgccctgattgttacttctgattgcagatgcacaaagaggctaaagccattgttgttttacctcctcccattgctgcaagcccttccccttctgactgaagtgactgccagggccaatgacttccccttcaccttcatttttctctttttccactttgtgagccagacattgaagactagctcattgaaaagaaaccacatacacgagaaaattagaaagtcaccactcatgcccaggggaaggcactggctcagaaaaggccagagaatacattaagtttgcccctgtggtttattcttggcacagagatagatagcctacaacaatcaagaaacaacaacaaaaaaagcagcaaatcctggtgaagaggaaggattcagtttccagcattgctgtaccattagattaacatgtctagttttcaccagaaatcataaagcatatttacaaaccaggaaaatatggctaattcaaaggaaaaccgcacaaacttcccctgacaaagaactgatagtggagctatgagacacagactttgaacaactgtctcaaagatgctgacagaaccaaagcaagacatgaagaatgccaagaagtcaatgtatgaaaaaaatagaaacataaatgaagagacagaaaacctaaaaagaaagaaaaaaagagaatttggagctgacaaaaaaaataactgaaatgaatagtcactagagggattcaagagcaaatttgatcaagcagaaaaatcagctaacttgaagataggaccatagaaattattgtctgagaaacagaaagaaaaaagattgaaataaagtggacagagactatgagtcctgtgggacaccatcaaacagatcaacatatacattatgaaaatctcaggggggaagagaaggaggaagaggaagagagaatatttgaagaaatcatggctgaaaacttttcaaatataatgaaagatatggaaataaacatccgagaagttcaatagattctgagtagaataaactcaaagatactcaaagtgagatacattatgatcaaagtatcataatcccaaaacagataatgttgaaagtagctttagaggagtgacttaccacataaaaaggatctcaatactattatcagcaaatttctcatcagaaaccttggagcatttcccctatggataagaggaactaaggtgtagaaaaaaatagcaaaatggcagcagtaggtccctatttatcagtaattgcttttaatgtaaatgaattaaattctccaaccaaaaggtagagatcagcaaaatagagtttttaaaatgattcaactatatgccatctacaagagactcattttagatccagaaggcagtggactgatatattcaaacttctaaaagagcaaacaaagaaacaacatgtcaaccaagaactgtgtaactgatttaattgtatattttgaaataactaaaaaagtataattagatggtttgtaacaccaagaataagtgctttagggaatggataccccatttttcatgatgtaattattacatattgcatgcctgtatcaaaatatctcctgtaccccataaacatatacaactacaatgtaccaacaaaaattaaaaatgttctatagctggcaaaactatctttcaaaagcttaccactagaactgccctgcaagaaatgcttaagggagccctgcaggttgaaattaaagaacactaaataataagacataaagatctcaataaaggtgaatacatatgcaattataaaagctaatggtgtggtaactttgatgtatgattctactttttgttctctactctatttaagagacttacacatttaaaaaaattattagtgtcaaagttagtattataactttagtttgtaaattaacatttttttctacataatggtagagatgaatatattaaaatttattagtttatgtttcttaaaacacaatgtgtaaagatataattttataacatcgacaactaaaaaaggtagtgctgaagctgttaaaggtgcagaatttttatgttattaaaatgaaatggtataaattcaaattggtgtaacaactttaggatgttacatgtaatccccatggtaactacagaaaaataactaaagagtatactctaaaggaaatgagaaaggaatagaaatatttcactacaaaaaaattagctaaacagaaaaaaagatggtaatgcagaatatgaggaagaaaaaagctataaggcatagagtggtttcactttccatgggtttcactttccagggtttcactttccatggtttcagtttcccatagtgaactgcagttcaaaaatattaatcaatactcttgtgcttttgaaccagaattaagtaaaataagggttacttgaacctaagtactgcaatactgtgacaaataagctgctaaccaagatggttattaggtgactaatgacaatccaggtaaagatttcatcctgctcttcagaatgacatgcaatttaaaacttatgaattgtttatttttggacttttcaattatgtcacgatgcctacataattcacctcataaatctcatcacatagggattttgtcatctcacttcatcacaagaagaagaagggtgaggacagtgcaataaatattttgaggaagaaacaccacattcacataatttttattacagtagatagctataattgctccattttattactactgtatttttgttaatctctttctgtgcctaatttataaattaaactttatcttaggtggttatgtgtaggaaaaaccataatgtatatagggtttagtactatccatgattttaggcatccactttgggtctgggagcgtatcccctatgggtaaagggggactactatatagaaaaaaaatcaaaatgacagaaataagaccctactacttatcagtaattacttttaatgtaaatgaattaaaccttcccatcaaaagacagagattggcaaaatagatggaaaaaaacatgatccaactatatgctgtctacaacagactcactttagagaccaagatacaaataagttgaaaggttgaaaatggatattctatgcaaacggtaataaaaattcagaagaatggctaaactaatgtcagacaacatagactttaactttaaaagattatgagatgaacaaggacattacatattaataaaagattcaatatggcaaagagacaatataaatatgtttattttttgtgatggttaatactgagtgtcaatttgattggattgacgaatacgaagtattgatcctgggtgtgtctgtgagggtgttgccaacgaagattaccatttgagtcagtgggctgaggaaggcagacccacacttaatctagtgggtgcaatctaattagctgccagtgaatataaagcaggtagaaaaacatgaaaaggtgagactggcctggcctacatctttctaccatgctggatgcttcctgccattgaacaacggactccaagttcttcagttttggaagtcaaactggctctccttgctgttcagcctggagacagcccattgtgggaccttgtgattgtgtgagttaatacttaataaactccattccattagttctgtccctctagagaaacttgactaatacatttaataacagactaccaaaatacatgaggtaagaaatgactaaagaactaaagggagaaatacacagttttacaataatattcagagacttctatgccctactctcaataatggagagaaccaccagacagaattataactaaggaaacagtggacttgaacccataataaaccaactatatctaacatacatatgtggaacattctacccaataacaataggatacacattcttctcaggtacatgtaggacataagccaatcacaaaataacaaatactgtatgattccacttatatgaggtacattgagtagtcaaaatcatggggactgaaagcataatggaaattgccacaggctgggaggagaaaggaatggggagtaattgtttaatgaatatagaatttcagctttgcaaaacaaaaatagttttagagatgaatggtggtgatggttgcacaacaatatgaatgtacttaatatccccaaactttacacctaaaatagttgttactcaaaataataaaaagtaaatcaatctctctctctctctgtcacacacacacacacacatacacacacacacacacacacacacacacacagagagagagagagggcagacagcacaagccaaagcaggaaggaacaaagcactttctatacttgggaaataacaaaggaccggtaaggctagacggcatagatagtggagataagtctagaaagttgggtaaatgtcaaatctagaaaaataattgatgctatgttatggagtttttttttccattataatttaaagcaaatacatttttggattaaaaaaataaaatgaccttatttgctctatgtcttgggaaaaaataatatggaaatatagatgggagaggaaagagaattgagtaagatactttgtatttttggtattttgagaaaaactatttcatctatattatatataaattgttatattctaacaaaagttgatttttatgtactcatttatatctccttttaataatattgagtacaaaccatttccctaataagcatgtacccccaaccagaatattaagagaatacagggctttggagtgcccaagaaagacatcatgatttgatatgaaaataagccattgttttgaccatcagcaaatgatcttagcaagtacagattcagtggaaaatagaggcagaagccaaactgctgtgtgtggaagaataaatggtggttgaaggggtaaagacagcatcatttttcttcaggatgattaagagtgactgctagagcaggaggccagcttgagggtaaccagatcattttagcacaaatacaacctaatgtagccaagtcctgagagagcaagcaaattcattcaacagtcatccagcaagaatgtccctcatcactcctttggtgctgcactttcacacagtatatctgtaatgtgatcatgaaaagtaattaaagaaacagtctgcactgtcagtaaagcattacatctaagtgcttattcaatgttactgcctttagtcatcagtattttcaagaaagagtaaaatattgttcttttttctaaaaagtagtaaatcatctaaattaattttatcttattcttattttcctccaaatgagaacatgtgctactccccttatcagttaatgatttgctgaggtacataggataaaatagtctttaaaaaatcttttgtttatgttcattggtttccattttctacctctatcttcatcctcatattcagcctattttaaaatacttctttcctgagttccattcttccaggctttcactaatgtaaccctgtacattacactggatatattggggatttttgttggctggcataaacttaccacaagaaaattttgtttctacataatattttatgaaagtactaaaagctaccactatcatctcttctagggcctgtcatgggccaggaaaatgacaaattagctgccaaatctaatgaaaggttgattaaatataaagggaagaaaaattcaaccatcctcatacactgacaactgaggtttcttgcttttttctttccaaatgcccttccaatgaggggaagacaaaattaatatctcatccacgatttcagtctggcagaaaatgaacctcttttacaaacaggttgattattaattagcattcctaaaaggttgttcattttgctaatcttaaacactgaaattgaaattgctgcagatcttgacaggcacccactgaaagtcctcactccttaaataagagcttcatcagaaactatcaaatcttttagcacagatttgtcccgatttttaaggcatacttttcttggggctttaattttcacttgattctattttactatttttttgtattaattccctcacacattttagctattagaaagccagcatgaagcgacgtgtttttgtaaaaaatagatttgcctcaacaaatttttactcagataaagaaagtgaaaattagatttagtttgcaattttgaagtagagattttaaaggtcatttatgttgtgtgcatgtgtgtagtggttgtgtggtggtgtcatttcctttttttgtttgccagaaccattctgaaataaaaaatgagtgcaatatattagaaataaaaggtatctgctctctcataatctataattggtgtgctatttcttaatgtttgttccatagtagatgccatgggtaatcagccataattatggattaagattcatattttgcatataggtaccctattgttccagcagtatttgttgaaaatattggattagaagttttaatgtagcaacaaaattgctgctgtgacatgataaagtaaatgaactgaatatataagaatgtcttctaaaatcaagctttcaaagatggtgtctttgaaagaaatcaagagaaagggttgaagaaagagagtgacatatgtactaaagctatcaatgaatgagtgagagcagatagcaacaaaaaacgattagcatgaagctttgtcttgtggcatgagtttcaaaagatctggtgctttttgaaagaggacagaagactccccaaatggatctgtagaatattgtaatttctatcaaaatgcacacaaggatttttgtggacataggcaagttcctcctaaactttatgtagaaaagcacaggactagaatagctaaaacaaccttgaaaaataagaataaagtagaaggaattactctacctgctattaatgcttactatatggctacattgataaaaaagcaatgtggtattggtgaagaaattgacacatacatcagtgaaagagaatagaaaaagcagaacttgacccctacaaacatacccaaatttttgacaaaaatgtaaaagcaattcagtggaattatgctgagtggaaaaggccaatcccaaattttccataatatattattccatttatataacattttaaaatgacaaaattataggatgaagaatagattagtggttgccaggtttatggaagttggagggtgggaggtggctgttgctatagaagggtagcacaaggaatacttatgataaaactgttattttgactgtagtcatggtcaaagaatctacatgtgttataaaatgcatagaactaaacacacacacacacacacacacacacacacacacatctgttgaaatctgaataagctcagtggattgtatcagtgtcaaactcctgcttgtggtattgtactgtagttacgcaggatgttacctttgagtgaatggcacataggctcttcattgtatgatttcttacaactatgtgtgagtctatagttatctcaaaataaaatgttaaaaaaaagcaggagacagactataaatggtttgatcttcgtcttctattttttttagttcctattgaaaaaaacattgtaagctttcaaatactacatttggatgatagccttatgaaagattttgtggtttgatgcatgcaaattattgctttaaaaacatatgaccagttagtcaacataatcaacttatgttaccaatcagcactataattaagaaataagaacatgataccaaaataaactcaaaatagatcagagacctaaatgtaaaactttaagcaataaaatatctagaataaaataggaggaaatctttgtgaccttgtttaggaaaagataaaattcatagatcagacctcataaaaattaagaaattcaaaaaccagtactgagggaatgaaaagacaaaccatagatagggggacagtatgttcaaactacacatctgataaacaacttgtattcagaatgtatcaaaacatctcaaaactcagtgtacaaacaacccagaaaagtacttacagccagattagctttgcagcatatgtcccctgggccctgcaaccctgtagattgatgcagtgagagccaaatggagacatctcttacatgattgtcagattttacttgttgaatgaggaaaacagaaaaaaatacatttttgtgcttttaaagggaaaagaaaccaacttcccctcttcccttctgagagaggctccttggatatgtaatggaagaaatgcacactctagctctttgatatataaataattctctctaggaaccaaataagttcagtatctccaggtttcacaacatagagatgtctctaaagttctgggaccaatttcttttgaaatataaatacctgttttttgttgttgttgttgttgtttttttgttttgtttttctttttttgagatggagtcttgctctgtcacccaggccggagtgcagtggtgcaatctccgctcactgcaacctccacctcccgggttcaagaaattctcctgcctcagtctcctgagtacctgggattagaggtgctcaccactgctcctggctaatttttgtatttttagtagagacagggtttcaccatgttggccatgctggtctctaactcctgacctcgtgatctgcctgcctcggcctcccaaagtgctggattacaggtgtcagccaccacgcctggcctaatctaaatatttctaagagaagtgaaacaaacattatttatcttatactatacatatttccatgtttcatggacctgcagctttgaaacatgggaataaatccaggtttattttctcacagtgacattatgctaaaattagaatatttgttcctcaatttcagctgagatccaaagatagaacataccaatttgttctagtgtcaactgtattgaactaggagctatgttctccataatctccttaatctgtatacttccagcttagagttggataagagaggaaatcccatattaggaggttaaagggaatcaggggcctttactctcagaaagatctaagtttgagagtcactgacaactacagaggcgctcggcttttcctcactttcctctactccaccagctcttcttcccaactgttgaccttgaggaccaacagcggttccaagcctgcccccagttgcagataacagaggccacactgagacatcttccccatagatccctccacaacctcccttatacagtccctctaaggaagctcaacttgcttgtctactcagatgtcactgccaactcctagtggtcctctgctccagtgcttcaagatgactgtttaatgactttatctgcaatactccaaaacttccctctgaaaattcacctccccagcaattcctactcttgtctaagacaggaacgggcaaagtatctacagtcccattgcttattttttaaaagaaaattttattaaaacgattattcccatttgtttctgtatcatctgtggctgctttctgctatacaacagaattgagtagttgtgacagaagccttcgggcctgcaaacccaaaatatttactgctggctctttacagaaaaggtgttgatgtctgctgtaatgtataattcctataaaaattccatattccattatgtttctcccttcctgactgaaccttcactgatgttctcacttaaataggacatgtaaagaagatggctaataattgatttaagaattgttttttttttttttgagactgaggtcttgctctgtcacccaggctggaatgcagtggcatggtcaagctcactgcagcctcaattgcccaggctcaagcgattctcccacctcagcctcctaagtagctaggactacagatgcatgccaccacacctggctaattttttctatttttttgtggagatggggatcttgctatgttgcctaagcttgtcttgagcctctgggctcaagcagtcctcccgccttggcctccagaaatgctaggattacaggcatgagccaccacactcagcctgatttaataactgttagttcatctccaaataggcacccctaaaaagttttacagaggtttagagtccagtgaacaattggagagggaatttccttgaaaaacattttgttgaacagctgtggcattctcccttgcccacagtttttccatcccactaccatattcttacacattttataggcaagacacagggatattctaagatcaagccttgtcagggagtgggatgagggttggagtagctttaagtagaccacataagtttgatactagagacttgtaactgcagacttaactggcaagagactggctatggtgcctatggcagcaaagtacataattgtgtttggaaagtaactgtattcccatcacaacttcaaaaaggatgcatgtctcccagataatacatatggaacctgatgtagagacatcagcataagactaatttagaaagaaccactttcaagacaacttccttcaaggaataggaggagctcagcaaaaagactggaattgttccattcaatgaagaagccaaggggctaggtatatcctctctgagtctctctttaattcattccaatcaggctgtctgcctacctgctctagcaaagataatcttttctagttcatctggaatatctattttgccaaattcaatgactactctttggtcctcattttactcaacttgtttttcttaaactgacattttattttatttatacactatataatttgttatagatttttattgtttatatttatggtgtacattgatggtttgatatatatgtattgtggaatgattacatcaggctgattaatatatctatcacctcatataaatctgcatctttttttgtgatgagaacatttagaatctactatcttagcattcttaagtatacgctacattattattaactgtaattacctcgatgtacaatagatatccaggcttaatctcctaactaactgaaaccttgtatcctttgatcaacatctccccattccacctgcccaccccagcccccactccctggtagcccctattttccaatctacctctctaagttagacttctttatattccacatataattgctatcatgcagcacatttctttctgtacccagcttatttaacttaacataatgtcctttaggttcatctgcgttgttgcaaataacaggattttctttaaaaaaacaaaacctgaatagtattccactgtttgtatgtgtatacattcatatgtatatgtgtgtgtgtgtataaacaacagataaattgataaaaagtgacatatgtatcacacttgaataatggctactgtgaataatgctccaatgaacacagaagtccagttatctcttcgagatactgatttaatttcctttgactctatacccataagtggaatttctgaatcatatggtcattctatttttcattttttgagaactctccatactgttttctataatggttgtattaatttatatttctaccaacagcatacaagggttctcttttgtccacatccttccaacacttgttatattttgtctttttgataatagcccttctgatagatgtgaagtagtatttcattgtagttttaatttgaatttccctgatgattactggtgtttggcagtttttcagtaccttagcagcatttgagtatttgccatcagtgacaactgtctcctttttgaaataactttattggctttaggaacaccatgttctcctggttttgttgtacctcactttctgttctcaatttcttttgctggattcacttcctctgcctaaactctaaatattgcaggactctgagcttgactctgggcccctctcttctcatcgaccttcttttcataggtgatgttttctgattccacagtttaaaataccatcaatatgctaataattcccaaattgatctcattatcttctatctctcctctaagctctcagctcataaaaccaagcactttaagtctccactaggctctctaaaaggcatcttatatttagtacggccaaaacataacaggctttccaacataggtaaatgttactgcattccattcagttctcaagtcaaagctagagcgtgtttgcttgctctcttcctttctactcaagtcagatccaatacattgtcaaagtcaacactaccaccaccaaagatcacccatccatccttttctctatatttataatgctatcacctaacctaagacagcaacatcttccatgtaaactactagaatcacttcttaacgactttcctgcttctattcttgctcctctcctctgcccaaaccattctatataacaatcagaaacatcttttaaaaatgtaaagcaggtaattttctccccagtttgaaacacttcatattaggaaaaaattcatttcctttaccatggcttgtaaaaatttacttaaaactgatttgatatttgcagtctcttatctcaactccacaaaagaatagaaaacagtatgttgtagctgggaaactgcaaaacattaatatggctgaggataaaggtagatatgtgaaactttggaaggtgatgagactgaaaatatagaaaggatgaaattgaaaaagacttaggaacttagaagttgagactttcctcaaggaatttgaacaataaaatgactatatcaaaaattacacatttttaagaccaactggcaataaactaactttggtttatcaatgataaacagtgcctcagattaatcattttagcagatgttttaggtgacccactcattctttcagcccacgtctgatttcagcaacagctgtggtgaacaatttctgcaaacaatgtcaacttttcatctcaaaagaggcccactctcagcgtttgtgcttcagtgctttcctgaaagcagcaggtctctcaacctggaatgagggacactgaatgccttaagggtgtctggagtcagtagataaatgccctggccacaggtcatgatttccacatatttactcagagagctcttttcgcccacagcactaggcagctggaaaactggactttattgagttttcttctttcactttctcatttaccctgttcactcactcttgcttcctgtaattgcctcccaaatatggcatccaagtccttgttttagactctgcattaggtggaatccaaaaattacagacaatcatgctgttctttattcgagaactattagttgagaataatgtgcttaaaaaaaaagtcattaagacatttcataaaataatggtaaatcttctaagagtaaaactagaaatgtatgggatgaaaagacagataccaacaaatgttaatactagttagtactattttccacattcttcagcccatattagtttttttggtagctatttcaactgacatgaggtggctctcagctgaacatggagttattgtttgctctcagtttcgtatcttatataatagcagtgtcaaaatcctgtgaaatctgagcaatcttcagctgtgaaggacaagggaagaaagtcttttgagacaaagggctcgtaacttggattcttgttttttatatgtatattttgcatttcaagcttcagccacaagcttttttttccccagcatatattttatgttttttctctttctcttacatgccttaatctacttcttcttttgttcaactaaatgtatgccatgttgagatcctcatagcataaaacctttcatttcagagttgtttctgcataattgcctaggcaaatggtattctaccattaaattgtttcactttttattgacatcattactgattaaggaggacaactaaattatgttaggttcaattaagtaggctgatgggacaatccagatgtaaagaaatgctagttatgtaatttttaaaaaagcctctgaaccctcctacactgactacatttccatcccactcttcagcacatgatttttttacagcaaactaaagtttttaaatgaaactaatggttaaaaattaaattatctttttggtaagtcctaaaagtacaagtttagtgtatatacatattgtcacagcaagccaaaatctaagaagaaacaatggagggaaaacatggatttctttgtcttataaactggaagagagcaggtgctttgtctgatttgcttgatacataccaagaagatgctcaataatgatcactcgttatcaatgtgccattggttatcacatcacaaggttattatgagcattctttatattaaataatggatagaagattactaaataccaagcacattgtaagtgtaaaataaatgtgttttccttggtatgccctattctcatttgttgattaatgcagcaatcattgctttatattgaaggttgaaaataaatttaaataaatagtctgtgaactagcgaagtccataaaaaaaggtttagatccttgttgttttgcagtgtggtaatggtttcagctttcttaagctctcctaagtaggtagcagtcatcttacgtagatagcagtctgatggaccagaacatggatatcactaataactctgtatttctgtctcactgtaagcaggctacgttattttcagctatttttgccacctatagtgctctatttagaacctcttagaatgtaagctagcaaactgacaattaaaaattaggtcttaattaagtaagggtcttgtgaaaatttagttattaaatatgtaatttatatgtttattctgattttcttgatgattataaggaaataactatatgtctattcacttcagtatttttaactagttaacagagaaaaaagttgaaattaatgatttacattagttagttctgtttagtatccagaatactttaaaatctcattaaccatattgtatgctatccttcaataatggatccccttaaataaaaaatattttggaacagttgattgctaatgcagaataaatagtaaaacaattgttggtagagattgagctccatataaatgtaagatgacaccatgtttaataaagagttatgcatcccatgggaacacaaaaatatatttcctagattactgaactgttgataaactatgatatgcacatttaataataataaagttagtaagtattttgtcaagtctgtaatatctgcataaacattctgacagagaaattgggagagaaaaagaaaataaagcctttattttcacatttagcattagaagagtggtagactccaccagaaataccaacttgggttgaaagagaccattttgcgctaagcttatattgatgatgtacgtattttggtgtgaggattttgccttgaaggtacatgccagctcgtaggagttcgatttaacattcacctctaagcactgaaaaatctgggttatggtcaacgcagcagcttgctacaaataaaattaagactcacctgagattctatgaattgctttactaaaagcctggttgtttaacattgttgctaaagttctgggaagaaaatccaaacacaacatataaaaataaatttccatggctcctactgtttcctttggaaaggcagataatacaattcttattgccttttatttacagatattgttacaggaaagatagatttgactaaaaatgtcatctaggaaaattttaaccaaaattagaaattttgctagtgatctgggttgctaagaatctaagcattaatacatgatggtcttgtgtaggtaatcttcttcagttgtgatggatgagagcccctgtataggatggggaaggaaagaattcagagaaataagctaatatctgagtaataaatttaacagaaatttgagaatgtccctagataaggctgaagataaaggagaactttgctgctttttagaaaggagtggtcaggactgatggaagaagggagaaaatggaagggactggagagtgtgagaacggttcccacaggctgagattaaggaaattaacttttcccttgaagaaaacatttttttcatggtagcaatgacagaagaactttgtgaaaaatgttatctaaagtccaatttaaggctgtttcatttctggttctgctgcatttttctggcatcatccccccaaaaatagccatgcaaaagtgtaccttgaaaattaaatgggaggtcaagaaagccaaagaggggagaatttagtgagagccagaacctgggaccagaagagagaccaaatacctcttttcactacttaatttcctcaaattccgagagagagagaactggatttatcacagtccactgggtaggataatagcgacttaaaatagacattaacaaaaaggcttatctcagaagtatagataaaagtaaagtacacatttttttgtatgattattagttaggtaatgaatgggtgaatttcttgggctgcctcactaatttgtgaactatgttgcgtatttatttaactctatatttctaccacattcttcttttctttcctgagtgtctctaacatattgatgaaaatgtgtaggttttgacctttaagggaagatgaattttaaggagcagattttaaaaaaattattcaaagtaagtaatatagcttacattttaaagatagtttatagaatatacatatatatatagacatatgtagagagactatatgaaggcatacatacttctatgtgtatgtttgcttttgtagatttgaagaattgtatttcttttattttttaatttataaagaaaggaggcttaactgactcacagctccacatagctagggaggcttcaggaaacttaccaatagtggcagaaggcaaaggggaagcaacacgtcttacatggcagcaggagagagagagagtaaaggagggagtgccacttttaaaaccatcagatttcccaagaatacactcattatcacaagaacagcttgggggaaactacccccatgatccaatcaccttccaccaggcccctcccttgacatgtggggaaaacaattcttttttttttcaataggttttgggggaacacgtggtatttggttacatgaataagttcttcagtggtaatttctgagattttggtgcactcatcacttgagcagcctacattgtacccagcgtgtagtcttttatccctcaaccctctcccaccctttccactgagtcctcaaaatccattgtatcattcttatgccgttatgtcctcatagcttagctcccacttatgagtgagaacataacgatgtttggttttccatttctgagttacttcacttaaaataatggttttcaatcttatccaggttgctgcaaatatcattatgttgttcctttttatggtgagtagtattctatggtatatatgtaccacattttctttatccaattgttgattgatgggcatttggctggttccatatttttgcaattgcgagttgtactgctataaacgtctgtgtgtatcttttccatataatggcttattttcctctgggaagatacccagtagtgggattgctggatcaaatggtatatctacttttagttcttaaaggaatcttcacactcttttccatagtggttgtactaggttacattcccaccaacagtgttaaagtgttcccttttcatcacattcttgcccacatctattattttttgatattttgattatggccattttggcaggagtaagatggtatcatattgtggttttgatttgcatttctctgataattagtgatgttgagcattttttcatttgtttgttggccatttgtatatcttcttttgagagttgtctattcatgtccttagcccactttatgatgggatttttttcttactgatttgtttgagttccttgtagattctggatattagtcccttgtcagatgcatagattacaaatattttctcccactctttgtgttacctgtctactctgctgattatttctttggctgtgcagaagtttttttactttaattaagtcctatctatttatctttgtttttgttgcatttgcttttgggttcttggccatgaagtctttgaataagccaaggtctagaagggtttttttctaatgttatcttctagaatttttatggtttcaggtttcagatttaagtctttgatctatcttgatttgatttttgtataaggtgagagatgaggatccagtttcattcttctacatgtggcttgccaattatcccagcaccatttgttgaatagggtgtcctttctccactcttatgtttttgtttgctttgtcgaagaccagttggctttaagtatgtggctttatttcagagtccactattctgttccattggtctattgcctgtctttatacaagtaccatgctgttgtggtgactatggccttatagcatagtttgaagtcaggtaatgtgatgcctccagatttattctttttgcttcatcttgctttggctatgcagggtcttttttggttccatatgagttttaggatggtgttttctagttctgtgaagattgatgatggtattttgatgtgaattgcattgaatttatagattgcttttggtagtattgtcatttttacagtactgattctacccatccatgagcgtgagatgtgtttttattagtttgtgtcatctattatttctttcagcagtgttttatagttttccttgtagagatctctcacccctctggttatgtatattcctaagtattttatttcctttctctgcagcaattgtaaaagtgattgaattcttgatttgattctcagcttggtcactgttggtgtttagcagtgctactgatttgagtacattgattttgtattctgaaactttactgaattcatttatgagatttagaagctttatggatgaatctttacggttttttaggtacacgatcatatcatcagtgaacagcagcagttttactttctctttaccaatttggatgccttttatttctttctgattgctctggctaggacttccagtactatgtgaaatagaagtggtgaaagtgggcatccttgtcttgtttcagttctcagaggaaatgctttcaacttttccccattcagcataatgttggctgtgggtttgtcatagatagcttttattaccttaattatctgccagttttgctgggggttttaatcataaacgttaatctattttaatcataacgggatgctggattttgtcaaatgttcttctgcatctattgagatgatcatataatttttgtttttacttctcttgatgtggtgtattacatttatggacttgtgtatgttcaaccagctctgcatccctggtctgaaacccacttgatcaaggcgtattatctttttgatatgctgttgaatttagttagctagtatttcgttgaggatttttgcatgtgtgttcatcagggacattagtgtgtagttttctttttgtattattctttcctggttttggtattagggtgaactgcttcatagaacgatttagggaggattccctctttctctatctcttggaatagtgtcaataggattggtactaattcttcttttaatgtctgatagaattcagctgtgaatccatctggtcctgcactttttatttgttggcaatttttaaatcaccaatttaccactgctcactgcttgttattagtctgttcagtgtttctacttcttctggtttaatctaggagggttgtacatatccaagaatttatccatctcctctaggttttctagtgtatgtgtgaaaaggcattcatcgtagccttgagtaaacttttgtatttctgtagtgtcggttgtaatatatcctgttttgtttttaattgagtttatttggactttctgtcttcttttcttggttagtctcactaatgttctatcaattttatttaccttttcaaagaatcagctgtttgtttcatttatgttttgtattttttgttgttgtttctatttcatttagttttgctctgatcatgtttgtttcttttcttctgctgggtttggttttggtttgtttttgtttctctagctccttgaggtgtgaccttagattgtctatttgtgctctttctgactttttgatggaggcatttaatggtatgaactttccttttaacactgtttttgctatatcccagatattctgatagtttatatcactattatcattcaattcaaataatttttaaatttccctcttgattttattgctgactcagtgaccattcaggagcaggtcatttaattttcatgtatttgcgtggttttgtgggttccttttggagtggatttccaattgtattccactatggtctgcgagagtacttgatataatctcaattttcttaaaattgttgatacttattttgtggcctatcatatggtctatcatggagaaggttccatttgctgatgaatagaatgtatattctgtggttcttgggtagaaggttctgtaaatatctattaagtccatttgttcttgggtaccatttaagtccattgtttctttgttgactttctgtcttgatgacctgtctagtcctgtcagtggcatattgaagtctcccactattactgtgttgctgtctatctcatttcttaggtttaatagtaattgttttataaatttgggagctccagtgttagatgcatatgtattttggattgtgatattttcctgttagactagtcctcttatcatcgtatattgtccttctttgtctttttaaactgccgttgctttaaagtttgttttgtctggtataggaatagttactcctgctcattttggtgttcatttacatggaatatctttttatacccctttaccttaagtttatatgggtccttatgtgccaggtgagtctcttgaagatagcagatacttggttggtgaattcttattcattttgccattttttgtctttcaagtggaatatttaggccatttacattcaacattagtattgaaatgtgagactctagtcaattcattgtgccatttgttgcttgaataccttcttttcatcatattgttttacagttcctgtgagttttatgcttcaaggaggttctattttggtatattttgaggattgtttcaagatggagagctccttttaacattttttatagttcttgtttggtagtggtaaattctctcagcattgtttatctgaaaaagaatgtatcatttcctcatttatgaagctcagtttaatggatacaaaattcttggctgaaaattgttttgtttaagggggctaaaaataggaccccaacccttttagcttgcagggtttctgctgagaagtctgctgttaatcagataggttttcctttatagtttaccttatgcttttgcctcacagctcttaagattctttatttcattctgactttagataacctgatgactaggtggtgaagcaatgacctttttgcaatgaatttggcaggtgttctttgagcttcttgtatttggatgtctagatctctagcaaggccaggtaagtttttcttgattatttcctcaaatatgttttccaaatgtttagatttctcttcttcctcaggaacaccaattattcttaggtttggtcatttaatgtaatcataaacttcttggaggctttgtttatttttttaaattcttttttctttgtctttgatggattgggttaattcaaaagcctggtgtttgagctctgaatttctttcttctatttgtttgattctattgctgagactttccagtgcattttgccatttctctaagtctgtacttgatttccagatgttgtgattgttttttattcatgctattttactggagatttttccattcacatcctgtatcattttttttatttctttaagttggacttcacctttctttggtgcctcttggattggcttaatagttgaccttctgaattctttttttttttttttgttaattcagagagttcatcttggtttggatccattgctggtaagctagtatattttgggggtgataaccttgttttgtcatattatgagaattgtttttctggttccttctcatttgggcagactatgttagagggcagatcagggactcaagggctgctgttcagattcttttgtcccattgggtacttccttgatttggtgctctccccctttccctagggatggggctttctgagagccaaactgcagtgattgttatttcttttctggatctagccactcagctgagctgccaggctccacctggtgcttgagagtgtttccaaagagtcttgtgatgtgatttgtcttcaggtctctcagctgtgtatactaacacctcctccggtggaggcggcaggggagtgaagtggactccatgagagttcttggttgtatttttgctaagtactgctgattttgtgttcgttggcctcaagccaggaggtggtgctttcaagagcacatcagctgcagtagtatagggaggatacaagcttggcctaggatcaggcggtgtgtggggccatggagctcccaggagactatgtcctttgtcttcagctaccagggcaggtagagaaagacaatcagtggagggcagggttaggagctcagactctccttgagtggggcttgctgcagctgctgtgggggatgagggtgtggttcccagagggattatggctgcctctgctgcctcacacaggttgccagggaagtaggggaaagccggcaacctcaggcctcacccagctcctatgcagcctgcagcctgaaaggctgatctcactccctctgtgcccctgacaacaggactgagtttatttccagggctgagaacttaccccaggttacaagcctcctagctgagaaagaaaagggactcagctcctctgctgccccacagagcctgcagcaacaatccatccacttcaaaaagtctgtggaagttctcagctttcctggtatgttcctgccgtggttcttggagaaaaggttcacaatttgggtctccacacactgtcctgcccatccaagtgggagctgcaagttagtcctgcctcctatctgccgttttccagaactgtatttctttacccactcatttatttgctgtttcctatattttgtacaaaaatgactaaaaattataactaataaaggttattttcctacatcttccctcttccaaggctttttcattgttttcgttaatgaattttttttgaaaaaagaaatgaatattatgttaactataatattaattttcagaaggatagtaagaagacgagtcccaaatcccaatcctcagaaataaacactgttaacacttgatggacataattacagatatgtctgctggtgtgctggaactggcttgtactggcttctgagaactaattgtgtgcatcttgtcccagctctgtacccagggacattacattagtagactgaaatcagtcatgatgggagtattaacaccacggaaatagactacactcagaggctctttttgtgttgctgttttttgttgttgttttgaaagccatttactaaagatttgcaagcccatacatcactgaatatatcactatgaacagatatagaaagacagctaaacattttctataaggagacagacaaaaattacctcatggtctacattataatatttaattaaatgtattcaatttaaaaatatttttaaattttagaagaaagagaaattgaagtgaaattaaaggaattgctaaattctggctggtggggagaggcactattatgggccctatataagccccagtactgctcactcttatcatttagggagggagaggacagttcactttctgtgcagctctcacctttccaggagtctgtcctgaagattttagctgccttggtgttcctggactttcaactgtctctttaactcagaaagttcacggggcttagctcattctctgctccgtagcctcaaaactctctcaaggcagtaagctaggcaggcagccatggggctctccttatttgttttccaactctcagtcatgagtgtcatttctacctgatgtctagtgttttagaaataattgtttcaatatattttgttcattatttgtttgtttcaggtgagagagggaatccagtttctgatatcccatgtggatagaagttctaaggatatgtgtgcaaatataaagtcttttttcaaattatgttgatactgtggatagtttaacattccttccaataattccctacctttacaaaggtctgataaatgccagcaaaatattagatggtgaaaccttgataaaatgaacggtaccaggtaaatattggtaattttaaaaaagatgaataggccatgacatctgttttgaacctaaagctgaatatcagaatgaatcttctgcttttgtattagcatccatggactgtcaagcctttacattttattagggtaacaataatcaacactgtatttataacatgcattcatgatcaaacatcatatttaataaatgctgttgaattaatgtagttttgtttagaaatgcagcctgaataaagtattacaagacaaacataaaattacatttttaatgtgcagttttgataactgtatattgttaaatatatatatacaattttgaggagaacacctatctcaattaaaattcttttcgagcatctacttttaatattgtatgaaggaagctacatcagtatcaaccaagcctcttttctttagaaatgtatgattttaatgaaatttaccaacctggggattgtgacaactaattaacatcttacttatatacactagatatttctgttcactcagttgtatattcatgtattcaacaaattgttttatacagatgctccttgacttacaatggagttacgtcacaatgaaatcatcaaaagtctaaaatatcataagtcaaaaatttaataccctgataagctcattgtaaaataaaaaaatttaagtaaaaccatcataaattgaggactgtctatgtaatacaaatattctgccataaataaaatattgttaaaagtttaagttgttctatagacaatttagaatgtaaaataatgcttataataataataaatgttctatcaggtattatagaatactagatggtcctacattttagttttctagataattgaagttttccctaaatagaatcaataatttccaaaagggttacctacttaccacatatctttctaaagtacattccatgtattttgttctttctacatagggcaaacttttaaaatttatagtttcactaataattcagtgtcaacacttgcattatcaaataccgtttttgtggctataatatattattgtctttagaaaatgtgtgaaattgatgttccctacatgaaattttccaagactttatgcctttttaaatatgtcagtgttttatagttttcctctgtctttctttattcaggcttttatatggcccttttctagttctgtagtgattctgtcttcatcagcttttcctctctcaattctaatctattgtgaccagctcataaggtaaccaagctaattagaataatgagtttaataaaattggtctgtgagtaatgccttaaaatatggactttatagtaaaagcttcactgtagtcttttaactactggagacttttccttgttttcttcctgcttctggattcttgaattgaaattgttctttgaagttttacatttaaactgcactttcacatctagaagaaaaatcacatctgtaaactacacccaagtccagggtgataaagccttaatctgaaagagaccaccatacttctgagatgtatctaataaatgtttagcttttcaagaagattgtgcagaatatacaacccccaaaatacacaagtgggaagagtgttttcaaattacctcatttgttggttgttgatgtaatttaatgaactgcaatatacccttcagattaggctcaaataacttaccttcttggaagcaatttctgacctttcagatagagctgatagattcttcctttatattcttcctacaccacaaattttttctctatcttaatcccattatatacatatttgtttacatacaagtcttgctttttagattgaaagtttccagatgacaagtagagtaacttaaagaatctctaagccaagcacagtgccaacataaagtaagagctcaatgaatgtgcattgaatagatggatattccctttagcaattatggaaacaacatgatattttatgaaatctatgggattaaacaaatagcatataacgtactgtgttatgtgactaaggtcacaaagatgagtaagatataagcccttactgtcaaaaactagacatatgtaaaaagagataaaatggtacacaaataaccgtggagctgtattagttgagataggccaagatatgctctagttcaagttggtccaacctgtggcccatggactgcatgtggcccaggatagctttgaatatgacccaacacaaatttgtgaactttcccaaaatattatgagttttttttgtcattttttttctttttcagctcattagctatcattagtgttagtgtagtttatgtgtggcctaggacaattcttcttcttccagtgtggtctagggaagccaaaagattgggcacccctgctctagtgagtaatgagtaaaccctcaaatctttgtggcttacaacaatagaattttctttctgcttcatccaagttggaggtgggctagaaactttactcactcctctccgaaccatgacacagggatctgggcttcttctgtcatgtatctgggccaactctgagtctttgcctccaagaaatggatgggagagacagacagagggaaatgggcaattacaatataccgttccatgaggagccagtttgaaatagacatgtgtcacttcttgtcacatttgtttggccagaacttgctctattactctgtattggttcaaggggctcagaaatatattcttcctgtctgcctaggaggagaaaaacaaatggtctgattagcactgtggtatgcagcatacagtattgcctctagctcagttgccaagtgcaagtatgaagtcaatatgtacaggcaacttataaaggaacaatttacttatataatacttcaacttatttcttatcactatactccaagatgttttcctgacgtgtcattaaattacaagtataaaaacctctctttagacaagaaagcataacaatcacatgcatcttagcactgctgagcttttatttcattcacctcctgataaattgctgtttgtaaatattgtgttaatgtctgttgagaccagaacaatggatctggtaaaaaattgattcaattaagagataaagaatgaagtttaccattattttacctttttggtgacaccaatagaaccatgtatttcgtcattcttgcattgctataaaggaatacttgacactgggtaatttataaagaaaaaagatttaattggctcagggttctgcaggctgtacaagcattgcactggcatctgcttggcttccagggaggccttggggagtttttactcatggtggaaggcaaagctagagcaggcatatcacatggtgagaccaggagcaagagagagggggaggaggtgccacaagcttttgaacagctcgatctcatgtgaactcactattgtgaggaaagcaccaagccatgaagaatccaccctgatgaccccaacaccgcccatcagtctccacctccaacaccgggaattacatttcaacatgatatttcaaaggaacatccaaagcatatcaaaccatttcttaaaaaaaacttggcattttattactttactatggtttagtggtataattctttatgctactatccctagagaacagacatatgtgctgtgtatgtgtcacacacacacagaaacacacaaggggcccatttccacacatatacataaatatcagtggtcttggcattgacccaatgtctgaatttgtaccttcagacatatgggaatattttcatctctaaaaatcattttgtacattaatgtttaaattatagcttcatatttgatataaaaattctgacttctaacttaatatgtggttattatgctgctactcagtgaatgtattttcaacatttaaacattttgtccttcaaattattaatcatttttcattctaaagatgactataagaagtacaagaaaaacattatagaataaaagtacgtatgatttggtctccatattttacaaatgaagaaatggcttactactggctaagacaagaactcaagaattgtaaaaaaaactgtataggttttggattcagacacacctggattcaaattttggctctgttgcttaatttctgtgtgaatatgtataagctacttaatcttcctaactttcagtctttttatttataaaataggtgttacagtacctgaatttcagagttgctgtgattagatgaaattagataattagatgaaagaagaagaaagaatgtagctgtataaaattcttgttatcagcagcaaatttctgactctctgataataataattggatattcttatactactactactaatactagtactattatcagtttctttctaaagtccttaaggacttatcagagcaacttcaaactaaaatagaatttaaaagtgtacttttctttttcatttgaatactattattaacaggttgagttttggcaaatagtttccctgttaatataatttcttgaatttgacaagtataacaaaatatgttatctgaacacagtggtaataacataataattgaacacatcacagagcagagaattaaaatgatgtagacttcagaaatttcttgtattgttagaaaaacgaataaatggcaagaaaaggatgatttattgtatggctgttatctttttaaatcatcttggtagaaggtataggaagtatctttctatgcattttccatcatcatgggttcatattgagagaaatcattctattttttttgtcaatgatagtgtctcattgctaaaacaactgcttgaaaacagttttcaaaaactagatttcactttaaagaaaaaataaaaatctacactatttccacttatttacattttaaataataaaattacgttaagaaacaaaacaaaataaatacgtttgccaaaatctatctgtctttgttcttcacatcacttcattttattttaacaaatttactgaggtaattcacatgccatacaattctcctatttatgcacattacttcttgaataagatattcctatgcctatccaatctaagaatcccaagaaaaatcaaaataaacatatcgatattgaatatcaactctgtaaaaacgatcagaatagactagaataggtgctggggtgagacaattatttatatgttttttctctcaaggtattaactttcaaattagaagaattggacataggtacattaataaaatatttaaataaaatattaaaatatgttatatataatagaagagatactataacatactcaatgactaataataaaataggggtcataaaataaaagtgatttaggaatttcaaggaagaatatatattttacactatattagttgataaaaatttcctagatgagataaaatttaagttaggagttcagagaaggccagaagagaaggggagttttcctgggtaaaggggaaagaaggggtcaaaacatcaacaaaagcaaaggagtagaaaaccataagactccctcaaggagcaatatgtgaaaaataatcagctggaacagagtgttgcctttgaggagaattataatgtattctccagctgggactcatgggcaaggttgttagccagaagatatacctaagcccatccaatctaagaatccaaagaaaaatcaaaataaacatacaaatattgaatatcaactctgtaaaaaaggttagaatagactagaataggtgctccaaaaagccacaggatatgcagcatagcttatcatatggaaataccatatttccttgggactaattaattgaagatgtgatttttgtttttgaaaactcatataaattggaattttatgtcattttcaagtgtttcagctgctctccttaaaaatcatgagtatgggtttattctccttaatcatttcagctttttagtggaaaaagctgattatcaagaattaaaaaagacaagattacgagatcaattgggtcctgttggtggaaaaacttaaatgtcagattaaagagcttggactttgtgttagaagtaaggagccttagaagaatgctaaactgtgggaaagtatactaaaaaatctttcaataaattaatatggcaacttaatatacaggatgtatgaatgaggaaattattattattattatactttaagttttagggtacgtatgcacaacatgcaggtttgttacatatgtatacatgtgccatgttggtgtgctgcacccattaactcgtcatttacattaggtatatctcctaatgctatccctcccccctccccccacccacaacagtccccggtgtgtgatgttccccttcctgtgtccatgtgttctcattgttcaattcccacctatgagtgagaatatgcggtgtttgtttttttgtccttgcgatagtttgctgagaatgatggtttccagcttcatccatgtccctacaaaggacatgaactcatttttatggctgcatagtattccatggtgtatatgtgccacattttcttaatccagtctatcattgttggacatttggcttggttccaagtctttgctattgtgaatagtgccgcaggaaacatacgtatgcatttgtctttatagcagcatgatttataatcctttgggtatatacccagtaatgggattgctgggtcaagtggtatttctagttctagatccctgaggaatcgccacactgagttccacaatggttgaactagtttacagtcccaccaacagcgtcaaagtgttcctatttctccacatcctctccagcacctgttgtttcctgacttttttatgattgccattctaactggtgtgagatgatatctcattgtggttttgatttgcattttgaatgaggaaatattataggctgaaaccagcttagaatgtgcaaacacaaatgatttattaaggcagttgcatcattttcagagccaattctattatgtgatttataaaaattgtttaaggtctgctacagtttgaatgtctcccacagaatttatatgttggaaacttaatccccaatgtgacagcattggcaggaggagccaaatgggaggtgtttaggtcttgagggcaggatataaatggctgtcaaaagaggatttgctctcttgtgcactttgacctcctgccttgtgatgacacgggaagaaggcccttaccagttgccaatgccttgatcttggactttccagcctccagaactctgagggaataaatttctttttttttatattttactcggtttcaggcattttgttatagcagcacaaacgaattaagccaaggcccattgtccttgactaattcttgaagattagagggctcacttcattggagtccaatattgctaatttaaaatctaataattgtatatcatcaaaaaaaatctgtgaaggcaataaactttcctttatggaaataaaaaagacactaaattagttatgccatatcatttcaaagttgaactaatagaaaatgttacccattaatgatttatgttgtctttatcagaaacaaaaaatgccttccaaatacattttatcaaaaatcatttaagaaatacatctcgttttatataagaaattaaagtgagtctaatcccaaactattataaataacaagtgttgatctcctcctcagtcctccaagaaacagaaccggcaaatttctgaaattgttctaaaaaaatcagtgattatttcaaaagctggtaacagtttttgaagattagcattcttggtggaatatttaatgagcagtttagctgtagttccctagcaaaatgaagaagtccagaaattgtgaaaaacatatggaggcaaatggcaaggttcaccatcccctgcccagtgggatctcagctacatccatgtgatccctcagccatatttaggtctttcgatttctgcagatgaaagaacattctttcacaagaaatagagaagctaccatgataataaaagctctttgggtgccccatcagatgtaagctctccttgatgatgatgtcgattatcatcctgttatttttggcatttattcattttctctcaggcatgggactttgcctcataataagtaggagggcctcaatttcttgaagctgccagagcaaccatattccaactatcatttttttcacaaatgcttacaagataatgtatagtgaacttcctggttgagaacgtgaaatgtttttgtacatttctgaagaatggcaaactacctagcttaaataccccgtgcctaatttccactaacattgttcaagagtcaaacctcataaaccccaaagcatatatagctaagggtggaataaaggtgggctcagaatgcttaaagcccgttatgtcccatgttataaaggactcagaactaacttctacccctggtactttccttatgcttctcttaatgaggtctttccaaaagatataggtgtcattaactcctggaaatcaattcttccttcaatattgttgcaggcattaaaccagaagtgactattaatatcaaaggaatatttaagttacaggagaattagtatgaaatatacattcatatacattaatatgaagtatacactcatagggtattgttaggtgccataggaaattgagaaacctgttatctttccacaatccaaatatttaagaattaactatagaaacatatgtacataaagaattgtaaacaacagtatgacaaattttctatcaaattttaaaaatgtaggaagtaacgacaatctaagtggtataatgcatatttaatattttctagggatgtatgtatgcttgatatatttaccaactttgatttttcaatgtaatatatacactttgagaagtaaatttaggtgttcataaattaaggagaaagtagccaataaaaatgaagtgtcagtttcatttgaatagggatttttaaatgaataatttacaatatgtagagagagttataaaacatgaaaaatatttcaaatagtataaaatatatgtgaatatttatatggtgccagaaagaatatcttagaagaaatacaaaggaaataacctattttactacaaaaatatgaacgttttaaaacccaaaacaaattaatggcttattgctagctggaaatttctatgcactctggaataactatgaagcaagaccaacattctaggagaaaattatcagtatttgttaagagcagaaaaatgatcattttaaaaatatattaattctcaatctaagagtattctagagagtactaataaatgtaaggaaagataaaacatcaaaatatcaccttaatacaaaaaggagtggaaattttataattgactaacaccaggttataggttaaattaattgtgctacatcttataacagatcaagagtcaccattgaaaaatcattcttgaaaagagcatatcttgctgtgaactttgaagagactatttatttatatgaacaaatacaatataaccttaaatgacatcaaggaaaaaaaaactatttttcagtacaattccaatttcaaaaccttaaatataatgaatgtcacatgctagactattcctagatactcttgcgtttggggtttatcctcctaataattatgtaacaggatgttataacactatcgaactaccctggttttagtttcagctaaagccccaagactattattgagaccaccatacagaaattgtaaagaggagtcattaacccttattaggaacacttagcctgtgaagataaaaagacccaggattagagagaacagtttgttgatgtgtaatgagtcctacacacttgtaagatggaggggtcagtgtgcttgcccttcaaatcatgctttaggaaaggggattaaaggagatgtgcaaagagtttaatatacaagccgaatactttggagaacacagtggacttgcgtctgccttacagacacacctgagacatctaacatggaaggatctggttggctggtttatgacagcagagggaaggagagttggtgtcactcgccaactgacactcctagagtctttctggacaaaagatgcattagtgttaatggcgaagctagggatgagcgacacatgtgagtgagagttaactttggtactctatagtgaggtgaattgtcagatttctcacggccaaggaaagagccagcagcagccagagatgaattgccccgcatgaagagaacgcttgttaagaaattcacagcaataagttggtatctccaaagagctataataacactcagaaaagtaagggtcagcttaaaactctgtccattcccaggaacacctcatgacaacccgaaaaagagaagtaggactttccctgcctctttctgccactctaaacttgctcacccacaatcctggtgaggatgggagctgagaatgacaagctggagatgaagatactgcagagtaagtcaggaaagagaaaagaagccaacggggcatccttgttggaaattttacattttatttattattaggctgaacaaattcattactataccatttttattattagaaatcaattagaaaactagtacgatttattccatccaaatttcacccaaaggaaagggagaaatttagcttcaaatattagacttaaaaggttagcagcatacaaatatagttgctttcacattgaatatcacgtcatgcttgatcaatgcagctgctatataaaaataaagttgtccccatttcttgtattttagagaatccaatatctacctatctcccccaccacagtgtgcccaggattttcctggatatagatgattttattcctgttcctgcctcatcacttatagctgtttatttctctctgcccagcactaattcaaacattacaatacaagtcctctaccttgatatttaaaaaatatctctcacaaagggagttatatttaatagactcctgctcacaacttggggttataggcagggtgggggagtacttttttgtgtattataaaagttagcataaaattaaatataaggcacactagattttagaaattccttggccatattcacctcactgaacttcattctggttagttttcaaccctcaagttgcccaattcccggctgtgttgctgaccttcacaatcctgggagatcatcctatatgtttcccaacttttccagtattagttatggggcctgggtcaggttacttagcatcttcctatctttctttccttttcccttaaattgggatactatgagtagctacctcacaggattactgggaaaattaaatggactgacatgtataaagcaattagcttagtgcctggtacagagtttatgtttcataaggtactcagcttgcattttgtttcttctactcatcataagtatgccctagagggtaaggtagaatgggagtggtttccttcttacatgaaaagaactcctcaaaatgttttcctaagtgaaacagttctcactcccaatacaatgagttacctccttgaaaataatattattttcctctcctggacttgtatgtcaaaaaatacagtcaaaagaattgtatgaaatagactaaaatattatttatgtgtatttctggatataaagttgtgaaagttatttttatgcatattgtattttatatatcaaatctgaatttcttttctaaaaacagagatcttacttattaccaccatgccttactaacaatttcatgaatataggcgatcaatgaacttaatcaaagaaggtctgggacattgagagtggtgacttaggaccctccttcctacattagatgctcacttctggcccagagcaagtgatgaggcctccaaggagggttttgcagtgttatataccacagcagagtgagggttcagtctataaaatatctctattttatacagtttgtatgacagtttccagggagtcatgcctcataaattcatatgttctgtatttatttataagcaatacttagggatagcctattaaagaattaaataaagaaggcttatcctagtaaatatcattagtctaccttgtggttcaattattatgttcacaagaacattcatttcaatcatcagtcttcttttcatttcccctgggtgcaatctcctggtattgggggagaaatagatttctggccagttgctttaacagcatctaccaattcactgtctgaactcagttaatatcttcttgccacacatttctctagttattattatttgttttactatattttaacaaagaattaaggcatctaataccttaaaaaaccccaaaagaattggaggaaatagactaaaatattatatatgtgtatttctggatataaggttatgaaagtttatttttatgcatattatattttatagatcttgttcaaatcaacaagattttaactacctaatagggactatgaataaaatatatccatagtgaaaatatttatttaaaagtcttttgatacatttattccatttaattagtgtttatcttcaattgcacattttatatgatttgatggagacacttaattgaacaatgcaatgtttataaggtcaaattcactttcttctctggacaatccattttaacatgtttttaatcaatgggaggattcaatccaacctctcaaagtgtttccttttcctgggaagcatcatttgcataagtctagttttcacttacttatattaataaattacaaaccctctaatacaccttgtagctatgatagagagattgatgtagtgtttgacacaccatacattagtaaaacttacagtatcaatcagggcaatgtgtctcttcttttctttagattacagattactaagaacccaatattcctttttcagagaaaagaagtccaaggattttctttcaatattggccattagtcagcacccagatctgagagagatgtccaacagtgttattcttgagcttatttattttgcataactgaaactttattccaattgaagaactcccatttttccctccttttaacttttggtaaccaccattctattttctgcttctaagagtttctcatacctcatatgagtggaatcatgtagtatttgtccttctgttgctggtttatttcacttaacggtaatgtcttgcacattcatccatgtcgtgagaaatagtaggatttccacagacatttttaaatgattttctctgttgactgactgtggggtgcagtttcttatctcattagccagtgcatggcctgagaacccagtgcctgctcacttcaagaagcagataataattctggaaatctgactaaagcatctgccttattccaaatctcttctgagtcaacaactagttatttctggtagttatgtacatgacacacttgaattcttccctaaattccatgaaatttgttgttgttgttgttgttgttttttaatgaatgcccattcccttgacaacaacaacaaggccattggctataagtgaaaagtctttgaactgctttcatctctgtccaatgtgcaggtgtgcccttgtcttcttccattaagctttccccatctgcagggtgtattgccgttgttttccaaacaagtgacataatccagaaactctcatcagtgaaccagacaacttactttgcttcatggggagcaattcgcaagacacagaacatgcagcaattaacctggaaaagtctgctgagggctttatttgatcggctctatagtcagtgaggcaacctgcttgatatggtttgactgtgtcctcacctaaatctcatcttgagttgtagtttctatagtccccacaagtcatgggaggtgcccagtgggagatacttgaatcataggggtggttacccccatgctgctgctctcatgatagagagtactcatgagatatgatggttttataaggggcttttccctttttgctcagcacttctcttgctgctaccatgtgaagaaagacatgtttgcttccccttttgcgatgattgtaagtttcctgaggccttctcagccattctgaactgtcagtcaattaaacctctttcctttataaattacccagtctcaaatatgtctttattagcagtgtgagaacagactaatacactgctcctgtatgcagtgattcccttctgtgtacttgcccacttcccaaagtatgctttttaacatcccatttctaatttctgagtgaactttggctgtgctgtttgatccctatatgaatgtttctgacatcatccaagacaaagttggtttccctagctttggagttatctgatgcccttctgttagggcacagttttgatgaccaccactcagtaagaagcaatcaattgtcttttaaatggtttattaggaatagctattttgcctaacatttgttctcaaaaaataagaggtcttcactgaactctttcatttctgcagatagctctagtctgtgtatgttctggtttcgggtgcatctaatattatctgtgcagtcaaatcatacaatcctaatagaccttcctgcatcaccaccctccaaaaatcctttagcaatttcttctgctcagagcctctactcaaattcagttatctttctggtgactttgtgaacagaggtcaatagcattcttagattgaagaaaacaaaaacaaaaaactgcaaaagcctaagtaagctctatttatctctaggtctcttactcatttgcagattctgtaagcgataattttttatggtttcaaaaaatgtctctagttgctccagtcaatgtaattccaagggctatggatattatctgagctcatcagcctggctctatttgtcatgtgagtcaccacagtccttaactcctctttaattcttatgagaggagaagcttttataatataatcaatttactaacttgctttgcatatttgttaagtccaggtcccacttcatgaaattatcaattgtgcaggcaaattcaaacatacttctggcaatatagtaaatgtatactgagtcctattctgtgagaatgcatattgtacctggctgttcctggaaattgagatggagaagaaagcactaggcaagtttctaatgacatagccatcctccttggcttgttgtgcatcctatacagtgtttaccacatcaggtacagttgaagcaattaggacaactacttgttgaatgcttgataatctacagttaaccttcagggactggccagacagctctgttaatggggaagctaatgggaaccaataatcatacctcaagtattcccttaatcagggcaataatctcttgtacgttcctggaattctgtattgtttacaatttattctaggacaacataggaaattccaaaagtcaccgttcagcatggccagttaaaactccaggaagggtgattaggcaatatacttccccaacaaaaacggaaaaagggaacattctctattagcacataatatctatcccaattatgcattcagctaaaggccattaaccagtgaaaagtctccccagtcatattcttcactcctaaacttattctgatgctagtccccccaacatggcatctccaaatcctgctagtttcagctttgggtctttcatagcactgccttgatttatcataagtgctactgaacattgaaaacctctatctagtcattttagaggctttgcctaccagttcctggcttttttaccaggatttgctggatttttaccaaatatttgcaaaaggcctatgattgcttgtttggggtaggataagaatatctcagtctctcagccaacctttttcagactcaatgactttatctatggaaacacattcaggctgctgtttaagtactttccattttgaatcttgattctcatcagttgatttgatttttctagactataataatttgagtgaacttgcagtgacactttaagaagtgggagggaggatcagagcagctccccaccttccaaatgtggatactgttgttctaacttcttagtagaaacagtaagattctttctctctctttttacactgctttttataaaccatctaaagagctccactaagttgaggggattcttatttcctttttctcttcatggtcctttcttttgtgtgcatagatctttttatcatcatgcagccccctctgcattacctgagctggcaggttcatcatcatctcctaaatattcccttggtttcccattacataaggagaacaggagacagaagctctccaaagtagcacgtgtttcattatctgtgccagaaacattaaattgattgcgtctttctgatcatcaaatagacaggttggtgttggtcattcacaccatgcctgaagcatgaaaagacatatgacacttgtgagtcatatgtctcatatgtctcacaatgagtcatgttgtgagtcatattgtgacatctgtgagtcatgtgtctcatgtgtctcacaatgagtcacattgtgagataggaaattacctatctcacaggggaggggatagggaatttacccctctcaggagagggttgctatgcttctacttttaccggttatatagattaattattataccacatgaaaatacctgcttacagaagttttcagacactggggattagccttcaacttacatagctctaaaattagtgaaatttcctagacaggtgaagaagccctgcaagtaatgatttacctggcttctactggtatttttatgtaaaacatttgaaaatttacacagaatatccttgggatttagtagtcacctgatcttaacctccagttatttgtgtattttttgagtaatcaatggccttgtttatgctactttgtgaagaagtgggacatcattccaagtagtcatataagtacaagtatgccttccatgacaggaaagaaaaggctcacagcaaagaatagtagaatttggaaattttttttcttaggattgggtaattataagcaatacatagattttattgttctttgcttgaagggaacttataggtcttactttatcagcaccactagcactagccaggggatagaaattgttctatcttcccctcttccagccacccttcatcaatccatttagccatttccctcatatctaagtgtacttcctccacattccattgcatcaaagatttgctatcatcaatgtcctatcatcaatgggtaggactcaacttgtaattagatcttcactatattttttatatactttttattgctaaaaatgacccagcccattaagatttatgagattaaagcatagttctgcttgcactgccaatctgtgctaacacaaagtctcagactggcaaagaaacatggttcaaaagctttaccagttctgaaatgtactaataatttcaagaatacaggcaaccaagaggctcagacagccctggggggttgtctgcgagtagaccagttccctggcactttccatgtttgagatgtagtctcaggttcgaatagaagatgaggtctcctggtggagttttgcttggttgactcacacagcagaggaatatttagtctataaaatattgccaccttatacctcagtttaagggacattttccagggagccaagtattataaatccttagggtcttaatttattaatgttttctacaggcaatcctttaccagggacattctgttaagaacttttcatagataaggacttttctagaaatatgaatagactatttgcccagagcttcagttatcatgttgacaaggagattatattgggtcacttgccctcttattttctcccagggtcagaaatgaatagccagtcagcagctttaactccttcctgttcaaaaaagtgtgcataaatataaaattcattgaatttttaaaaactgaatatatgcttgtaaccagcacacagatcaagaaatatccctattccagctgcccagaagcctcccctcatgcttgtttcctgtgactacttccatccaggggcaagtaatcaccatgatataattttataattaaaaatgtgttatttgaaattgttgattggtacccctataagaattcatatctagataatcacatatacacatgtgtagatagtaatctcttaaattatagaatggggtctaacttctgtctgttatgtgaaaatatgaagctttctaagcatgtggctttcaaaagttttcttaggatttggcaaatgtaaataatgcatagatcctgtcgttctttgtttatattaattatttgagtacaacatgaatatatttgtgctgtaaaaagattcaagcaataaaaagtagtaaaatgtaaaagctttttcatcaccttataacacaatcttctcctgaccccagaagtcacccctactaatagatatttttctattagagttttgcttttgacatgaacaacatgttatagaccattatgtgtcagaataattagactcttcctattgattgtaatggctttattttattatagcacaaaggttaccataaagtctctgaagtcagactatctgactttaaatcttgaccttgctacttccctgctgatgaccttgtgccagttacttgctttttccccagtttcttcacctaaaaatgggaacagtgataatcatagtattttcccagaggattaagtgaattaatagggataaagtttataacagaccctggcagaggtcaagcattggatatattttgccattattaagatgttatcatattgcacatttgattattaatattgctataattcacttaaatttttgtctgttcatggccaatatgttgtttctaaacttttcctataacaaagttacaatgaatataatgctttcatggctttttactcatggatgtatttatttcaataaattatatttgtagaaatgaaaaggtcaagtggaacataatgcacattttgatttgactggcattcccaaattcactttcaataagtcttatcattgtatccctaacactgtatgaaaatatttgcttccctgcatctgttgtcagccaacatcagatatcattaatcttttaaatttttgccagtgggatggatgtgaggtttgattattagaaatatgttcgctgtgactgggagggcatgggaataactgcgtctaaacaaggtcttagaccaagtctgagcatgtgtgtccttggtcttataggcagaggtgtagtgggtactattgggttcagctgatccaaaatcagcttccaagtttacctcaaataactcccctgggttgtctcctatttctgtatattgtaattctgatcttggagccatctctaaagcctccattttcatgaaagttctttcttagatgagttttaacctagaatttcctgcagtcttgtttctctttattcaaccttaacagccttttgtgttctggtcctttaagagcactcttcttttgttttccaatgtatctatagattgtttattaatagtcttcactattttctttagaacttttaatttagacttcataaaaggtattgttgcattaaagtggttctcactttcgaacaagtcattaaaattgatcattctagtttgggacaatattaatatctcttggattgtatgggcaatgaaactgtagtattctaatacacacattagaattaaaattaaaaattagtcatttttacacattgatttatacatttattaaaataagaatgaaaggatgccagagtaggatatccctagcaatatgtttttccactgcatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaagggaaggaaggggataaagggtgaaaaactacctattgtgtactatgctcactacctgggtgatgggatcattcgtaccccgaacctcaccatcacacaatatacccatgcaacaaatctgcacacgtacccctgaacctaaaataaaagttgaagttaaaaaagaaaaaaatagtacttttgaaataaaaagcaagaagaaaaatacttcactgacactataaaattaagagggaaacctataaacagttcacttgaggtgtaaaagtataacagtcatttaattaatgggcttatttcttttatgggcattcgtttgattaaatcttttgttcaggcatatttataattttatattatactgtcactctggtcttctacattgcctcatttactgtacttcttttgtttgtgttgtatcttcttttcagtttagttgtagttgttagggtccacccaactggacagtttccccctcctatagacctaagccccaaaggccaaaagtaaaaccccctaccccaaacctgcctgtatctgtctgaccagaggccagctgttccaggatggggtcaagacgtctaccttacacaacagaactggcaagaaaaacatctccaggaagtggtcagacacctggcacaaaggaccccccacccttttctttttccttcaccctgacccagttctatgccctataaaaccttgctatagcctgtaagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagcaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaacaatttcggtacccagtccttgagataactttctgaaggaatgatgttaacattaatgaataaaaaaggaacaaataaaaagtacaccacacatactttgcttgtgttctggtagcactagccctaaacacaatatgagtaaggtaacaaaaaagtaacctgagatatattaaaaatggttttaaagccaaaagggaggaagaaaggaaaaaaggaaggaagggggaagggcgaaagtgaaaaacatatggaggaaggaaaggaaaataatatcaaatgttcacagagtgcttattctgaattatgtaccctcttatgtgctttatataaattatattgtaaggttgaaaatatgtgctctggagaagagctgcacggaataaaatcccacttctgctttttactgatggtgtgacatttagcggattagttaatttggtcattgcttcagtttcctatttgactgtcctaccataagactataataaaccaatgcatataaaaatgcttagcactgagtctgacatatggtaagcatacaataaattttaactacaattatccaatgaaaacctaacaacaacactatgaagtttgtataattattatttttacttttttgataaggagtctgaatcacaaagggattaaataatttactcaaagtcacgcaggtattaatcatgaatctatcttccagtaaatatcaatagaaaacaagatgtgggatttgagtgcaggcaattagactccagagcctgtttttaaactctatgttattacaagaagacatgcacgtacctttaaaagaagaaaatttgagacagcaaatgcttaacaaccaagaaattacaaaagaaaaaaacctacaatctatgaaacaaaaattatatgatgagattaattaatacatttaacaaatacttattgagcaccaattattggttcaaccatgcttttaggtactgagaattcaactgtgaactggtctctactttcacagaatatactttataatacagtataaaatggcataacaaaatggaaatggggttggtaaaggcagcaaaaatcttcaacagaaaaataaatatttttataaaccaataatttttgaaagataggatatagcatataagcatatggaaaataggtatccatgatagagaatataatagtggaacagttaatgacttctgacatgaaggaagtactgagatgagaattgaacaggatttgttttccttcagaaaaaaaataatcggtagaaaaaatatatgctggtatagctaaaaaaatttgaggattaaaaaatctcttctatacaatatataaaaatgcatagcacctgtaagaaaacaaatatattgggttggattcaaatttttttgtaccaaaatttccaatagataatggagcaagtctgcaaggatatgggcaaaaaatagtgggatctaaatatgttgtacatagattgttattcctgtcaaagggatgaggagttggtctcatatatgtactaacacagcagatacaataattcggaaacttcttgagaagctttgtagttatatatacactgtaattatttataatactattaaatgcaatataacaatttaatacatagagaagctgccttattgaaatattgaaataagcattgaaaaatctaaatgtagctggcaagatggcctaatagaaacagctctggtctgcagctcccagcgagatcaacacagaaggcaggtgatttctggatttccaactgaggtacccagttcatctcattgggactggttagacagtgggtgcagcccacggagggtgagctgaagcagggtggggcatcaccccaccagggaagtgcaaggggtttgggaaatccctctcctagccaagggaagccctgagagattgtgccttaaggaatggtgcattctggcccaaatactacacttttcccatggtctttgcaacctgcagaccaggagattccctcaggtgcctatgccactagggccctgggtttcaagcataaaactggggatcatttgggcagacacccagctagctgcagtttttctttttttcataccccagtggcaccaggagcccgagtgagacagaacccttcaatcccctggagagagggctgaaatcagggagccaagtggtctggctcagtggtcccacccccacggagcccagcaagctaagatccactggcttgaatttctcactgtcagcacagcagtctgaagtagacctgggaggctccagcttagtggggggagggacgtccaccattactgaggcttgagtaggcagttttcctctcccagtgtaaacaaagcctccaggaagttcaaactgggtggcaaagccacagtagccagactacctctctagattcctcctctctgggcagggcatctctgaaagaaaggcagcagcccaaacaggggcttatagataaaatctccctgggacagagcacctgggggaagagcggctgtgggtgcaacttcaacaaacttaaacattcctgcctgctggctctgaaaagagcagcagatctcccagcacagtgctccagctctgctaagggccagactgcctcctcaagtgggtccctgacccctgagtcccctgactgggagacacctcccagcaagggttgacagacacctcaaacaggagagctctggctggcatctggcaggggcccctctgggacaaagcttccagaggaaggaacaggcagtaatctttgctgttctgcagcctctgctggtgatacccaggcaaatagggtctggagtgaacctccagcaaactctagtagacctgcagcagaggggcctgactgttagaaggaaaactaacaaacagaaaggaatagcatcaacatcaacaaaaaggaagtccacaccaaaaccccatccataggtcaccaacatcaaagaccaaaggtagataaatacatgaaaatgaggagaaaccagcacaaaaattccaaaaaccagaatgccttttctcctccaaaggaccacaactccttgccagcaaaggaacaaaactggatggagaatgagtttgacaaattgacagaagtgggcttcagaaggtgggtaataacaaactcttccaagctaaaggagcatgttctaacccaatgcaaggaagctaagaaccttgaaaaaaggttagaggaattgctaactagaataaccagtttagagaagaacataaatgacctgacggagctgaaaaacacagcacgagaacttcatgaaacataaacaactatcaatagccaaatcgatcaagcggaagaaaggatatcagagattgatgatcaacttaatgaaataaagcgtgaagacaagactagagaaaaaagaatgaaaaggaacaaacaaagcctccaagaaatatggtacaatgtgaaaagaccaaacctttgtttgactggtgtacctgaaagtgacagggagaatagaaccaagtgggaaaacacttttcaggatattatccaggagaacttccccaacctagcaagaaaggctgacattcaaattcaggaaatacagagaacaccacaaagatactccctgagaagagaaacaccaagaaacataatcatcagattcactgaggttgaaatgaaggaaaaaatcttaagggcaaccagagagaaaggttgcattacccacaaagggaagccagtcagattaacagccaatctctctgcagaaaccctacaagcaagaagagagtaggggccaatattcaacattcttaaagaaaagaattttcaacccagaatttcatatctagccaaactaagcttcataagtgaaggagaaataaaatcctttacagagaagcaaatgctgagagattttgtcaccaccaggcctgccttacaagagctcctgaaggaagcactaaacatggaaaggaaaaaccggtaccagccactgcaaaaacataccaaattgtaaagaccatcaacgctatgaagaaactgtatcaactaacaggcaaaattaccagctagcatcataatgagaggataaaattcacacatatcaatattaaccttaaatgtaaatgggctaaatgccccaagtaaaagacacacactggcaaatcggataaagagtcaaaatccactggtgtgctgtattcaggagacccatctcacttgcaaagaaacaaataggctcaaaataaagggatggaggaatatttaccaggcaaatgaaaagcaaaaaaaaaagcaggggttgcaatcctagtgtctgataaaacagactttaaactgacaaagatcaaaaaagataaggaaaagcattacataatggtaaagggatcaatgcaaccagaagagctaactaacttaaatttatatgcacccatacaggagcacccagattcataaaacaagttcttagacacctacaaagagacttagactcccacgcaatagtagtgggagactttaacaccccactgtcaatattagacagactgatgagacagaagttaacaaaaatattcaggacttgaactcagctctggaccaagcagacctaacagacatctacagaactctccagcccaaataaagagactatacgttcttctcagcaccacgtcacacttattctaaaattgaccacataattggaagtaaaatactcctcagcaaatgcaaaagaacagaaatcataacaaacagtctctcagaccacagtgcagtcaaattagaactcaggattaagaaactcactcaaaactgcacaactacatagaaaccgaacattctgctcccaaatgactactggttaaaaattgaaattaaggcagaaataagtaagttctttgaaaccaatgagaacaaagacaccatgtaccagaatctctaggacacaattaatagatcttcctgctttctcctgtgtgcatttagtgcccataagagaaagcaggaaagatctaaaattgacaccctaacatcacaattaaaagaactagagaagcaagagcaaacaaattcaaaagctagcagaagacaagaaataactaagatcagagcagagctgaaggagatagagacatgaaaaacgcttgaaaatatcaatgaatccaggagctggtttttttgaaaagattaacaaaatatgtagaccactaggcacattaataaagaagaaaagagagaagaatcaaatagacacaataaaaaattataaaggggatatcatcactgattatcatcactgatcccacagaaatataaactaccatcagaatactataaacacctctgtgcaaataaactagaaaatctagaagaaatggatacattcctggacacatacaccctcccaagactaaaccaggaagaagttgaatccctgaacagaccaataacaagttctgaaactgaggcagtaattaatagcctaacaaccaaaaaaagcccagaaccagatggattcacagccgaattctaccagaggtacaaagaggagctggtaccgttacttctgaaactcttccaaacaatagaaaaagagggactcctccctaactcatggaatgaggccagcatcatcaggataccaaaacctggcagagacacaacaaaaaagaaaatttcaggccaatatctctgatgaacattgatgcaaaaatcctcgataaaatactggcaaaccaaatgaggcagcacatcaaaaagtttaccaccatgatcaagttgacttcatccttgggatgcaaggctggttcaaaatatgtaaatcaatcaacgtaatccatcacataaacagaaccaatcacaaaaaccacatgattatctcaatagatgcagaaaaggcctttgacaaaattcaacagcccttcatgctaaaaactctcaataaactagatattgatggaatgtatcttaaaataataagagctatttatgacaaatccacagcaaatatcatactgaataggcaaaaactggaagcattgcctttgaaaactggcacaagtcagggatgacctctctcaccactcctattcaacatagtgttggaagttctggccaaggcaatcaggcaacagaaagcaataaggtgtattcaattaggaaaggaggaagtcaaattgttcctgtttgcagatgatatgattgtatatttagaaaaccccatcgtctcagcccaaaatctccttaagctgataagcaacttcagcaaagtctcaggataccaaatcaatgtgcaaaaatcacaaacattcctatataccagtaatagaaaaatagagccaaatcatgagtgaactcccattcacaattgctacaaaaagaataaaatacctaggaatacaacttacaaggtatgtgaaggacctcttcaaggagaactacaaaccactgctcaaggaactaagagaggacacaagcaatgcccatggataggaagaatcaatatcatgaaaaatggccttcctgacaaaagtattttatagagtcaatgctatccccatcaagctacgactgactttcttcacagaattagaaaaactactgtaaatttcatatggaaccaaaaaagagcccatatagccaagacaattctaagcaaaaagaacaaagctggaggcatcaggctacctgacttcaaactgtactacaaggctactgtaactgtacagttacagtacggtttggtaccagtaaacagcatggtaccagtaccaaaacagatatatagaccgtggaacagaatagaggcctcagaaataatgccacatatctacaaccatctgatctttgacaaacctgacaaaaacaagaaatggggaaaggattccctacttaataaatggtgctgggaaaactggctagccatatgtagaaggctgaaactggaccccttccttacaccttacacaaaaattaaccaagacggattaaagactaaatgtaagacctaaaaccataaaaaccctagaagaaaacctaggcaataccattcaggacataggcatgggcaaggacttcatgactaaaacaccaaaaacaatggcaataaaagccaaaattgacaaatgagatccaatgaaactaaagagcttctgtgcagcaaaagaaactatcatcagagtgaacaggcaacctacaaaatgggagaaaatttttgcaatctatccatctatccatctgacaaagggctaatatccagaatctacaaggaatttaaacaaatttaccagaaaaaacaaccccatcaaaaagtgggtgaaggatacgaacagacacttctcaaaagaggacatttatgaggctaacaaacatatggaaaaaaagctcatcatcactggtcattagagaaatgcaaatcaaaactacaatgagataccatctcacgccagttagaattgcaatcattaaaaagtcaggaaacaacagatgctggagaacatgtggagaaaagggaatgcttttacactgttgtggaagtttaaattagttcaaccattgtggaaaagaaaacctccaacctctcaactatgtatatagaaagtccaaggaaaagatctcaggtaatactacaaaaattgggaagtataggtggtctattgatttcctattagtgcggtaccaagttgtcacacttagtgtctaaaatagcacacatttgttatcttgtagttctgaaggccagaagtctggaatggtttccactaggctaaaatcaagatattggcaaggctgcgttttttttcttaaggctctacagaagaatctgacttcttgcttttcttttccagctactacacgttgtctgcattccttggctcatggtccttttaatctttaaagccagcaaaggcccatcaagttggtctcacctggaagagctctaatactgatgcttctttgtctcttccacttttaaggactctcacgattacattaagcccacctatataaccaggatatcctattttaatataagctaactagcaaccttaattcccctctgtcatgtaacctaacctattcagaagttctggagatttggacagagacacttgggaagccattatgctgctgaccataggtggtaggaagtttaaattttatagctaaggacaataagcattcattcatttctgaggtagattaatattgaaatattttacatttatggaatttttctaatttagaaattttctaatatttcctcaggataagattatgcatttttgacaaaaatattgctaaactgatgttgaattctcatgcattacatcaaggagcatatgatatacttgcatctcattatccaaaacgttatcttggatcatttaactacggtagaatctgcccagttttttcactgaaaagttacaattttaactttgaaattaataaagtatcttgtgggtagataatttcagactatgtaactatcctgtttcaaatttttgtccactgctttaagcagtcatttataattctttgctggaacacaccaacagtgtggggaggtcaattttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcatcctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcggtggctcacgcctgtaatcccagcactttgggaggctgaggcaggcagatcacgaggtcaggagatccagaccatcctggttaacacagtgaaaccccgtctctactaaaaatacaaaaaaaattcgctgggcgtggtggcgggtgcctgtagtcccagctactcgggagggtgaggcgggagaatggcgtgaacccgggaggtggagcttgcagtgagccgagatcgcgccactgcactccagcctgggtgacagagctagactccatctcaaaaaaaaaaaaaaaaaaaaaaaaaaaagtcatacagattctaaataatttcttttctttttttttttttttttttttgagacggagtctcgctctgtcgcccaggctggagtgcagtggcgcgatctcggctcactgcaagctccgcctcccgggttcacgccattctcctgcctcagcctcccgagtagctgggaccacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccaataatttcttgatacattgtgtaagaacagaattatgctaagtgaaaccaagacaagtaacctagccctatattaagagactcacaatatggtggctgtgtctgcatacagaaatataaaaaaataatattcaggccacgcacggtggctcatgcctgtaatcctagcattttgggaggctaaggtgggtggatcactcgaactcaggagttcaagaccagactgggcaacgtggcaaaactccatctctactagaaatacaaaaattagctggtcatgatggcgtgcacctgtggtctcagctacttggggggtgaggcaggaggatcacttgaacctgagagatcaaggctatagtgagctgagatggtgccactgcactcccatccaggtgacagagtgaaacccctgcaaaacaaattaataatattaaattaattgagtcagagcagaatatggcaaatacaagaagttatttctttaggagtttcaaaaatgtagacctcgtatcttcttcagattatcaggaaagctagaggcatgtgagttagctttaaattaataagtgagtcttgacagaatatgatacctggaggtagagggaaggagagttttggaaggcaagggaaatggatagagtgcatgccaaaagaagtgaaatatagagtgtattagaaataaaatataataataaccattacttatggcacaaattggaattttcaaatgctcttggttaaaatcctaataatttcagtgccttatttataattcagttttatgtaaaacttatagattattatagaaagaccacaaaaattccatggcattttacaagtgttcctcttaaactcaggcacagaatttatgctttactggttcctaattatgtttttcttttctgtctcttctttattaaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggtatgttggcttttgtgcagtttgaagataatatgaaatatttgtcccatatttcagcagccattggcagggctgttcattcattcatttatttacatatatttatggaattccaggaactgatccaggcacctgccctcattggatctgcattctgaaggactagatggacaataaataattatattagagaatgagaaggattctgaaggaaagtaaaagtgatataatagaaacagaaagtggaggctgctatttttatagagtattcactggaggtcatgagaaaataagatttattatgtgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttagatatgcatacacataaacatctcagtgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcctgcaccgcccttaatccattcaactctgagttgacacagcacatgtttcagagagcacggggttgggggtaaggtcatagattaacagaatctcaaggcagaagaatttttcttagtacctaacaaaatggagtctcctatgtctacttctttctacacagacacagtaacaatctgatctctcttgcttttccccacaattatgtcttacctgaaacctttgtattttcttaataaagttcagggcacatgtaagatgatagaaatatcactatgaactgtaaggtccaaagaactgacacatctgatatgattatgtcttcagtctgacataagtagaaatttaggccctcatgtggttagctagagagatttccaacagtttttgagagaagatgcaacaatattaatgatttttcaaaaagtggtagtttatgtgtgcaacataagtttacattgtaaagcttagggtagcaccctaaagtacttctgggcccacagaagtactttaccttactgcatagatctgagtttttgtgatgtttatcattaaaaaaaaattttattgaggttgtgatgaaaggacccttcccttgacccctgcttgggactggtgaaggggcggctcccttactccacctgcaactctcaagccccttgtgggagggggagcatgcaggtgagagggtgcaggagctagggcaagtgcttttgggtgccagcagtaactaatcctgtaccagccccagggctgtgtctagaggttgcctgtgacccctggagccccagaaagcagacagctaagtgttaaccagctcagtggagggtcagggtgacagcattttgcacctgtcctcttggtacctgagttcctgtctggcattcaggaagaatcaggtcgcatgaacgaattgaagtgtggtgaatgtggaggattttattgagcggtggaagtggctctcagcaggatagagagctggaacggggatggagtgggaagatgattgatggtccctggttgaactcctctccaaccatagtctccaatgcccagctgttttttttctcgatgttcagatgcttcttgtcttctctccttctctgccgcaccactctgctgctgtgccattggaacctggggtttttataggtataggatgcggggcgtggcagggcaggatggttttgaaaaaggcaaatttcaggtgggaaaacaggattgcatgttctcacttagagcccaaggtccaagcttgaaggtggagtccttgccagggactgcgcccttttctaactagtatttccttgcctcctgtccatatcagttacattatcaagatactgtgctaaacaaaaagagggtgtacaccgcatattctcactcataggtgggaattgaacaatgagatcacatggacacaggaaggggaatatcacactctggggactgttgtggggtggggggaggggggagggatagcactaggagatatacctaatgctagatgacgagttagtgggtgcagcgcaccagcatggcacatgtatacatatgtaactaacctgcacaatgtgcacatgtaccctaaaacttaaagtgtaataaaaaaaaattgctaggagttataacatttaacattataacattatataacattataacatgtaattcagactactggaaatagatttacatgggtgatttgtaagaacagtaaaatgtgattttactaaaagattataaaaaagcatggaaatgtaaatttttgcctagggttgaaggattgttttgaattagataagataaagctgaaggtttaaacaaatgatggaaggattctaaaaactaatcttgcaaaaactgtatgtgtgaacatatttactaaattcaaaggggtattataggatttttctgtaaattgagcattgaaataaaagtacaataaatgttaaaaaaaaaagagggtgtacaaattgataattattgttatcactcccagacaagtttttttttaatttaacttctatttttaattcaggggtacatgtacaagtttattacacaggtaaacttgtgtcatgggggtttgttgtacagattattttgtcacccaggtattaagcctagtacccattggttttttttttttcctgagtctcttcgtccttactccctctaccctctgataggccccagtacgtgtcgttcccctctatctcatcattagctcccacatataaatagtaacatgtagtattgggtttcctgttcctgcattagtttgctgcagataatggcctccagctccatccatgttccgtcaaaggacatgagctcattctttcttatggctacatagtattccatggtgtatatctaccacattttctttattcatctaccattgatgggtatttagattgattccatgtctttgctatcgtgaatagtgctgcagtgaacatacacatacatgtgtctttataatagaacaatttatattcctctgggtatatacctagtattgggattgctgggttgaatggtagttctgtctttaggtctttgaggcattgccacattgtcctccagaatggttgaactcatttacatttgcaccaacagtgtgaaagtgtttatttttctccacaattttgccaacatctgttactttttgactttttaatagtagccactctgactggtgtgggatgatatcccattgtggtttttatttacatttctctaatattcagtgatgttgagctttttttcatatgtttgttggccacatgtatgtcttcttttgaaaaatatctgttcatgtcctttgcccactttttaatggggttgtttattttttgtaaatttgtttaagttccttttagatgctggatattagaccttagtcaaatgcaaagtttgcaaaaattttctctcagtatgtaggttgtctctttactctgttgatattttcttttgtcatgtggaagctctttagtttaattattaatagattccatttgtaaatttttgcctttgttgtgattgcttttggtgtcttcctagtgaaatttttgcctgttcctatgtccagaatggtattgcctagttgtcttccagagttttcatagttttgggttttacctttaagtccttaatccatcttgagttaaattttgtacatggtataaggaaggggtgtggtttcaatcttctgcacatggctagccagttatcccagcatgatttattaaatagggagtcctttccccattacttgcccattgtttttgttagctttgttgaaggttagatatttgtaggtgcatggatttgtttctgggttctctattctgttccattggtctatgtgtctatttttgtactagtaccatgctattttcattaccatagccttgtggtatagtttgaagttgggtagcataatgcctccagctttgttctttttacttaggattgctttagctattcaggctcttttttgcttccatatgaattttaaaataatttttctagttctgtaaagaatgtcattggtgatttaatagggatagcatggaatctataaattgctttgggcagtatggccattttcatgatattgattcttcctatccgtgggcatggagtgtttttctatttgtttgtgtcatcatggatttctttgaacagtgttttgtagttctccttgtagaaatctttcacctccgtagttagctgtattcctagatattttattctgtttgtggaaattttgaatgagattgagttcctgatttggctctcggcttgactgttgtggatgtataggaatgccagtgatttttgtacattgatttttttttaccctgagacttttaggaaagttattttgccaataaaaagtgctctcaatattttgtcccatacatattttaaattacattaattagtttaaagttcttgcatacaaattacccatccttggccaggcagagtggctcacacctgtaatcccagcattttgggaggccaaggcagacagatcacttgaggccaggaattcaagaccagcctggccaacatggtgaaaccccatctctatgaaaaatacaaaaattagcctggtatggtggcgtgcacctgtaattccagccactcaggaagctgaagcatgataatcacttgaaccctggaggtgaggttgcagtgagccgagatcgtgccactgcactccagcctgggtgacagagagagagactgtctccaaaaataaaaaataaaaattacccatctttagctctttgtttgccttctcaggaggcagccaccttcagcaatttttgctttttttttgtaattactactatatttctaaataacatgttttcaatatttttccttcaaactctcatagatgtaaattgagttgtcatcaactttcaccacatcagcacaaacatacattcatacacttcaccttctcacattctcctggtataattatatcacaatttttgtttgaatcaacatacagaatatacattcttattttacatatatcttatccgtgctgagccttggaaagtgctgtatcaatttctctcttataaaatgtttttcattttcctagatttattaagggtatattttgatttgcttagtttgggtgtgtactcattagtaatgtatcctcaaattctcttccagaggtgttactctcttgtcaatacctttaaacatatcaggtatctataaatatacgtgcaggtacgtttcccggtgttttctgttctctttataggaacacgttactcccagggcagagcagctcctgctctgggataccccttcactgataccctaacaactctcttcacctctctttgtgtacaaccccattttctggatgccatgtccccttctttttttggtttattcctttctgagaaatggtttattgagatgaaacgtttgagctcttatttgtctgcaagtatctttattctgccctcacacttaattagttagctgtatgaagaagtctaggttggaaatttcttctgtcagaatttcaaaggaattactctattgctactgctataaaatatggtattactgctgaaaaaacatgatatttaattctttcttcttttgcccatgatttgtattttgtttttcttatggaaatcttttagaacttccctttatccctaatgttctcaattccatgaaactatgctttgaagtaagcctttttattttgtatttattgtgctggatataaattcgggctttgcaatctgaaaatgagtggcctttaatcttagggaattttcttgtggagttcttttctgtttttctttcttctactcatattaatcagatattagagattctggattgctcttttaatttttttcatctttttactttaattttttgcccctcattcttctattttcaaggattgtctcaactttctcttttaaactttatgttgaactcctcaatactgttaccgttatcttaaatattttgagttatttttattttctgcatatttctgtagttcccaccatgatacaacagtatcatgatacaagcagtatcatgtacatgtttcacggacaaagtgcattatatctctggtgttattagtaatagttttttctgttttctatttttcatatgtctgactcaatttggttttcctataagtatttttcttcctatgtgtgttagtctttttcttttatgtttgaggtttccctagtgttaactgcttatttttcattgcatttaaaaattgttttaatttgttttttttttagttaatatgggtacatatgtgtatatttatggggtacatatgatgttttgatataggcatataatgtgtaataatcatattagggtaataatcatattagggcatttgggatatccatcacctcaagcatttatcatttctttatgttaagaacatttcaattctactcttagttattgctaaatatacaataaattattcttgactgtagtcactctgttgtgctatcatatactagctctaaggctaggtgcagtggctcatgcctgtaatttcaacacttggggaggccaagatgagaggattacttgagcctaggagttcaaaaccagcctaggcaacataatgagaccccatctctactaaaaattttttttaaaataactggtgtggtggactgcacctgtattcccagctactcaggagcttgaggtaggaggatggcttgagcctggggacacagtggtggtaggagcagaggggttaaggctacagtgaaccatgatcacgccactgcactccaccctgtctcaaaacaaagaaacaaacaaaccaaaacaaaacaaaacaccaccagaaaaaaaaagactagatctagttaactgcttcttagcttctgtgtttcagagtgaggcatagcgtggctgcctggaagttctgcatgcctggaggataaggttaggactactgtccacttcattagtctggactattcattgggaaattcccaactgtaaaaatctgcatatcagtgttattgaacaggtcactttttccagaaggagattttctaacatactgccgtaggaatgtagggctggctgttacattccacattgccatgcagtgcagcggtatactttcgcttaatccttctgcatcacagtggcactcattacccccgcacctggtgactcggggtttagagtacttatggttctgcctcctcagagagtaaacctccattcttctatcaacatgaggaaaaagccagtggcatctaattggatttatatataatttccaccaatcatgttgttttctcaatctcacatttagtagtatctggcactttaatttctaaggatttatgctcttttatcctacacctatcatttcagtggaattgtgtgagggagataaggtaaaatatatgcttaatattccattttcaaccaacggctagacacagttttttgcatttttgttgacaaataatactatcataagctaacacattttagaactgaaaaagacattctcttttagtttccactcactagagtcactcaagcatttattataatatgatctggataggtgacttttaaaagatatacttgaattatttaggttatttaaaaatactttatgtgtaagaatattttgtttcagaaaataaattgcagaaaaattaaaaaaataaatttcaaaactctgagaaatgcataatattcatcttttgagaaatgagaatatttgctaggagaagaatattgttccttttctgtaatagcagatgggtgtttagaatagcaaactactacaataattttattattttcttttataaactttacagtagctaaggtttagtaggaaagtaatacttttgttcatgcaaagtgctctttattctggatgtgtctctggggttaattgtctcatttcagtctatattaataaaaacattttattctgtatgtaactcctgattcctcataattttggggtgcctttccaaactagaaaaccgacgttctgactgtttattcatttaaagggcattattgcatcagagtcaatggtttagactctggagtcttacttcccaggttcaaattcttaaaatgctcctaactagccgtggcaaagtatgtaatatttgtttatttgttacctcgtctatattgtgaggaaaataacaaagccttcaaaagcctgttgtgaggattagatatgttaatagacagagaccacttatagtgcctggaatgtgataactactatgtaagttttgacattattgttagtgtactgaaaagcagagctctggagatattaggggaaatactgagaaacattgatttttctctgcctatcatgtagaaaacagttacattagtctcgtttccacaactttctattttcattttcagtgagattttgaaaatatgatcttttgaaagactgtttcattttcctttcaggatggccatttggaaacacgatgtgcaagatcagtggattggtccagggaatatctgtcgcagcttcagtctttacgttagttgcaattgctgtagataggtaagtctgcaccaaactctgaatccagaaaaattggcatgtctgcaactagtataccagaaaaatatataacctactaaatttggacatatcttttcaaattgtattcacaatatctacctctttttttaaattattatactttaagttctagggtacatgtgcacaacgtgcaggtttcttccatatgtatacatgtgccatgttggtgtgctgcacccatcaactcgtcatttacattaggtatttctcctaatgttatccctgcccctgcccccccacccaatgcaggccccagtgtgtgatgttccctgccgtgtgtccaagtgttctcattgttctattcccacctatgagtgagaacatgtggtgtttggttttctgtccttgtgatagttagctgagaatgatggtttccagctgcatccatgtccctgtaaaggacatgaactcatcctttttatggctgcatagtattccatggtgtatatgtgccacaattttcttaatccagtatatcattgaaggatattttggttggttccaagtctttgctattgtgaatagtgccacaataaacatacgtgtgcatgtgtctttatagtagcatgctttataatcctttgggtatatacctagtaatgggattgctgggtcaaatggtatttctaattctaggtccttgaggaatcgtcacactgtcttccccagtgactgaactagtttacactcctaccaacagtgtaaaagtgttccaatttctgcacaccctctccagcatctgttgtttcctgactttttaatgatgacctttctaactggtgtgagatggtatctcattgtggttgtgatttgcatttctctgatgaccagtgatgatgagcattttttcatatatctgttggctgcacaaatgtcttcttttgagaggtgtctgttcatatactttgcccactttttgatggggttgtttttttcttgtaaatttgtttaagttctttgtagattctggatattagccctttgtcagaagggtagattgcaaaaattttctcccattctgtaggttgtctgttcactctgatggtagtttcttttgctgtgcagaaattctttagcttaattagatcccatttgtctattttggcttttgttgccattgcttttgttgttttagtcatgaagtccttgcccattcctatgtcctgaatggtattgcttaggttttcttctaggttttttatggtttcaggtctaacatttaagtctttaatccatcttgaattaatttttgtgtgaggtataaggaaaggatccagtttcagctttccacatatggctagacagttttcccagcaccgtttattaaatggggaatcctttcccattgcttgttttcgtcaggtttgtcaaaaatcagatggatgtagatgtgtggtgttatttctgaggcctctgttctgttccattggtctatctctctgttttgataccactaccatgctgttttggttactgtagccttgtagtatagtttgaagttgggtagcatgatgcctacagcttggttcttttggcttaggattatcttggcaatgcgggctcttttttagttccatatgaactttaaagtagatttttccaattctgtgaagaaagtcaatggtagcttgatggagatggcattgaatctataaattaccttgggcagtatggtcattttcacgatattgattctttctatccatgagcatgaatgttcttccgtttgtttgtgtcctcttttatttcgttgagcagtggtttgtagttctccttgaagaggtccttcacatcccttgtaagttggattcctaggtattttattctctttgtagcaattgtgaatgggagttcactcatgatttggctctctgtttgtctgttattggtgtataggaatgcttgtgatttttgcacattgattttgtatcctgagactttgctgaagttgcttatcagcttaaggagattttgggctgagattatggggttttctaaatatacaatgacgtcatctgcaaagaggaacaatttgacttcctcctttcctaattgaatacactttattgctttctgttgcctgattgccttggccagaacttccaacactatgttgaataggagtggtgagagaggtcgaccctgacttgtgccagttttcaaagggaatgctttcagtttttgcccattcagtataatgttggctgtgggtttgtcaaaaaatagctcttattattttgagatacattccatcaatacctagattattgagagtttttagcatgaagggctgttgaattttgtcaaaggccttttctgcatttattgagataatcatgtggtgtttgtcattggttctgttcatgtgatggcttacatttattgatttgcatatgttgaaccagccttgcatcacagggatgaagcagacttgatcatggtggataagttttttgatgtgctgctggattctatttgccagtatttcattgaggatttccggatcgatgttcatcagggatattggtctaaaattctcttttttttggggggtgtctctaccaggctttggtatcaggatgatgctggcctcataaaatgagttaaagaggattccctctttttctattgattggaatagtttcagaaggtatagtaccagctcctctttgtacctctggtagaattcagctgtgaattcgtctcgtcctggactttttttggttggtaagctattaattattgcctcaatttcagagcctgttattggtctgttcagagattcaacttcttggtttagtcttggaagggtgtacgtgtccaggaatttatccatttcttttagattttctagtttatttgcatagaggtgtttatagtattctctgatagtagtttgtatttctgtgggatcagtggtgatatcccctttatcatttttattgcgtctatttgattcttctctcttttctcctttattagtgttgctagtagtctatcaattttgttgatctttaaaaaaaaaccagctcctggattcattaatttttttaagggttttttgtgtctctatctccttcagttctgctctgatcttagttagttcttgccttctgttagcttttgaatttgtttgctcttgctcctctagttcttttaattgtgatgttagggtgtggattttagatctttcctgctttctcttgtaggcatttagtgctataaatttccctctacacactgctttaaatgtgtcccagagattctggtatgttgtgtctttgtcctcattgatttcaaagaacatctttatttctgccttcatttcattatttacccagtagtcattcaggagcaggttgttcagcttccatatagttgtgctgttttgagtgggtttcttaatcctgagttctaatttgattgcactgtggtctgagtgacagtttgttgtgatttctgttcttttacatttgctgaggagtgctttacttccaactatgtggtcagttttggagtaagtgtgatgtggtgctgagaagaatgtatatgctgttgatttggggtggagagttcggtaggcatctattaggtccacttgttgcgagctgagttcaagtcctggatatcattgttaacattctgtctcattgatctgtctaatattgacagtggggtgttaaagtctcccattattattgtgtgggagtctaagtctatttgtaggtctctaaggacttgctttatgaatctgggtgctcctgtattgggtgcatatatatttaggatcgttatttcttattgttgaattgatccctttaccattatgcaatggccttctttgtctcttttgatctttgtcagtttaacgtctgttttatcagagactagggttgcaacccctgcctttttttgctttccatttacttggtagatcttcctccatccctttcttttgattctatatgtgtctctgcatgtgagatgggtctcctgaatacggcacagtgatgggtcttgactctatccaatttgccagtctgtgtcttttaattggggcatttatcgcatttacatttaaggttaatagcgttatatttgaatttgatcctgtcattggcgagagtgtcccgattttccaggtacagtctgtcatggcttcccttggctaggaaagggaaattccccaaccccttttgcttcccagctaaggtgatgccccgtcctgctttggctcaccctccgtgggctgcacccactgtccaaccagtcccagtgagatgaaccaggtacctcaggtggaaatgcagaaataacccatcttctgcatctatcatgctgggagctgcagaccacagctgttcctatccggccattttggaacggaacctgagaatatctacctctttaaaagcaacatacctactaaagtttcagtaataagaaaatgaaactattgaattttccatactttaaaaataaataattggagatggtaaaatttccctatttttcacactacaatatagacgtttctaacagcagaaatgcaaatgagctaaaatctgaaattttatctagattttaagattgaaaatcattcatccattcattcattcacacatgttgttgagcatttatgatgtgccagatactgggctgggttggtaacatctaaaacaaattagaagtgctgcctcaggaaggctacaatctggcggagcaggcaaagtcattaacaaatatttacaaataatgctttctaataggtgaccagtgtttgacagctatgcaaaagagataataatcaattctacctattaggacagggagtagtggattcacaaaagaagtgagaccttctgattcctggagaagtcagaaatttacccttagaagaaactgggaaaagggcatcccttaagacaagtatatacttatggcattgaaataggaggcacttgttcagagaaatgtagagaggtagttcagctggaacaaggcaggtgaagtggtacatttgtccacaaagagagagatttattacgagaaattgactcataattatgaaaactgagaaatctcagaatatgctgcctgtaaattggagacctcagaaagccagtgatattattcagtccaagtcccaaagcctgagaactagggatagccaattgtgcaattggccatttgtgtaaattgcatcctgtgggcaggagaatatgatatgagatgtcctagctcaagcaatgagtcagggaaaaaagggggcaaattcctccttcctctacttcttgttctattcaggccctcagatgactggatgatgcctacccacactgggagggcaatccactttaccgaatccactgactaagatgctaatcttatccagaaacacttttataggcgcatccagaaataagattcaatctcagcaccccttggcccagtcaagtcgatagattaaattagccatcacacttttgtagcagagactgtcagtgctctgccagatctcttaaactttcagtgggttctgtcttacatccaactgccagtatcttcatctctgtatctcaaatccaaattgtgcaaagtcttagttcctaagcagaacagacaagaaatgtcagataattaatacccctagaagtagccctcaactaaaatctcatgagagttgatgtactcaccattctctccccttgggttgaataattctgcaacaaatggtttgattcacatccctcgttacctaccttcccattaatgaatgacttctctatactttcagttatctattgatatataatgaaccacccccaaatcaaaccacttagtgagttaaaatgacagcaatatttattatgtcatgaatctgtgatatgtacagatttagaaagtacagcttgtctctgttctacttgatgtcaggtggagcagcttcaaggttagggctgaaccttctttcactctcctgttggtacctagtccagggagaacttgaatatgtgggggcctaagagagctttgtctctattggtctctccaaatgggctctccagcaaggctacttgaaggtacctggacttcttatatgtcagttcagggctctgacggtttgtgtcccagaagagagtaccagcaaaaatcatgatgtggtatcatttttgttgcattctattcatgagactgagtcatcaatccttagccaaggaaaaaggaatagaatttggaagcaatgtcaaagaacttggaaatgttttaaaactgccacatctttatttcttgcacttgcactcaaatgctttttttttcagggctagcttttgcaggaagccaaactaaaaaaattcccaagctgatttctcctgactgaatcctttgcctgaattttacagttacgttccaaagcacctactgtacaacttcaactgcacattcaacaaaaggcaccttaaattaaacatgcccagagctgaactcattattccaagccccacaccatacacaaacaaaataaaaggcagctgtttttttcatgctccccaaatcagtgaaaggcaggaccactcactcaattcaaacaaaaaacctgagctttatccttgaatcttctttctgtcaactttgctggcactctccaaattctattatttctgagtgctaactagttctgaaccaggccactgccctttgccacttggaatactgagattgttttctaactggccttcgggctcaggaagccaacctccaatttattttcttctcatagcagcccaaataagcttcttaaattgtaaaaatgatcctgccttttacaatgtaaatccttcaatgaatccccattgctctttaaatgaagtccaaactttttagcagaattttagtaattattatacagtttttaatatttttatatttccattgactttctcagcagggactattctctatcttattcatctttgccttcctgaatatatacacacaaacacatatatatgtatgtttacaaatatataagtatatatactcatatatgtacatttattaaacaaatatgtaagtacatatattgttataaatataaatatataaatacatatatttgttataaatacaaatatataaatacatatatgtacagataagcatatgtacttttatatttgttcattattacttttattgttaatagtgtctgctatactccatttattcaaattttgagttaaaatttatctcctatataaatatatgtacttatatatttgtttaataagtaaattgaacaataatatccaaaaccctattagtaggtattcaaaaagagcaaaatacatacgtttgtgtctatgaaattacccataatttcacggcaggtgaatgggagaattcttggattagaagactggaagaacgcttgaagttgaagagagaagatcttacacatgaaggagttataaagaatgacaacagagcagtcaaagcccaggctaactagtcattctatgaagataagttagataagttaatttggagttgctgctcagccacttaaagctctacattttcttatctacagatctggaatgtaacaattttcataacatttcagttttatggagtcataaaaatcaaagaagattaaataggtaatagttactttgaaaaaatataaaatgttacacagttgcataatagtgtgattatcttttgattaacataatgaaattcaataataataacaagatccacaatatcaaaatcatagtaaaatgaatcaggcttactctacatactgatgctgaatttttgtactcaccagaggacatagaatgttaggaaggctcataatcagaactcataatgaatactctcagatttttacagctgtaaagcaaatcagcaaaacatttagtggcttcaaacaatattggtttattacatctcatgattttgtgggttaattgggcacctctttgttcatcctcctgctccatgtgttataactggaatcactcatgttgcagcattaatctgggagctaaactggggctggaacatccaaaatggctaagctcttatctcccggaatctttctctacatgcctttcatctaattcaagcttcttggaaattgaagtctggattttaagaggaagcattccagaaggacctgccccacatgcaagtgtataaaaagcttctgcttgcatcatgtttgctaatatcctattggtcaaagcaagttacacagataatgcgtaggggaccacacaagagcctgagggataaaaggttgattgattgctacagatcagcagtctaccacagcctaagagctacccatctaaagaggacgatgtagaggttgagtttgagctctgaagccaaactacttgtgttaaaatcctgtgtaattattggtaagatttttacatttccaagtctgttttgctatcttttaagcaaggaggcttaaagagacggtccatgcaaattaatggaacagagtctgaaacggttttaggcattcatgttcattattactttttattattaatagtgtctgctatactccatttgttcaaattttgaattaaaatttatctcatatcaattacagaaaatgacaatgcatgcctttctactacaaatggtaactttctatatttttgaggagactgtagggtgagaggcctgtaactacataaataaatttggtgtatgacttggtcagaagtgatgaagcagtgcctcatttatatttgtgtttaattgcaggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtttacaaagcctcatctttccaaacttaaccatttgtgtatgcgtcaaatcaagcctgcacgcgtgcgtgcatgtgtgtgtgtattttccccaaatggtgatgatgagcagtgctttgcatgaaactagattttatcaattt

SEQ ID NO: 974 - DNA, 109070 bp, Homo sapiens; identical to SEQ ID NO: 973
